United States Patent 11,446,398 (REGULATED BIOCIRCUIT SYSTEMS) - sequence listing, part 82

SEQ ID NO: 186229 - DNA, 2961 bp, Homo sapiens
  Payload ID: 16673
  Gene Symbol: SQLE
  Gene Name: squalene epoxidase
  Uniprot ID: Q14534
  ENST ID: ENST00000265896
  CDS Start-End: 899-2623
agacgcgtggagcctggcggcgagtgggggcgtgcgacggttactctggttactggggccgcgccgcgctggcgagagccgccgcccgcgagggatgctggtgaggaagccgtcgggagccgccgccgccatctgagggaggtaccctggaaaccaccttttatcggtggggaagtgcagtcgcggtgggcggctctgggggccagcgaaacgggaggcctctaaatctttaggttggggctgcattgccctggagccgcactcttgagtccgaggccatcttttgttggagaaggcgtcggcgttggcgttttcccgaggttgggctgtacagtgtctccgtccgcggaaaaagaagcctctgaacccgcgccggcccgcagcccccgtgccttccggccgctgctcgccgtcgccagaggctaggccacgtttcccccagtgccgaggtgtttctgtgaccctccctccactcccattcccttctgaaagggcacctgctcttggtgagaaaagaaattatagcacgaagagccagtatcagaagagtatccatcacccgcagcaaccgctcagggaacaccatcaaaaaagaaaaaaagggaatatctggatttcctgggcgaggaggagcgagtctgctcgggagctgttccagcaggcgatttttaaatactgctttctacgccctatacaacttggcttcacatacttttacactaactttatatgatttttaaaaactggtctgatcggacttctcgtcctgggacactgtttactggagtctggccggctctccgtgctcctcttggtacctcattttggggagaaccttaaacccactcgagcagataatctccgccttgaccggtgccaccaaagaagccttggaaccatgtggacttttctgggcattgccactttcacctatttttataagaagttcggggacttcatcactttggccaacagggaggtcctgttgtgcgtgctggtgttcctctcgctgggcctggtgctctcctaccgctgtcgccaccgaaacgggggtctcctcgggcgccagcagagcggctcccagttcgccctcttctcggatattctctcaggcctgcctttcattggcttcttctgggccaaatccccccctgaatcagaaaataaggagcagctcgaggccaggaggcgcagaaaaggaaccaatatttcagaaacaagcttaataggaacagctgcctgtacatcaacatcttctcagaatgacccagaagttatcatcgtgggagctggcgtgcttggctctgctttggcagctgtgctttccagagatggaagaaaggtgacagtcattgagagagacttaaaagagcctgacagaatagttggagaattcctgcagccgggtggttatcatgttctcaaagaccttggtcttggagatacagtggaaggtcttgatgcccaggttgtaaatggttacatgattcatgatcaggaaagcaaatcagaggttcagattccttaccctctgtcagaaaacaatcaagtgcagagtggaagagctttccatcacggaagattcatcatgagtctccggaaagcagctatggcagagcccaatgcaaagtttattgaaggtgttgtgttacagttattagaggaagatgatgttgtgatgggagttcagtacaaggataaagagactggagatatcaaggaactccatgctccactgactgttgttgcagatgggcttttctccaagttcaggaaaagcctggtctccaataaagtttctgtatcatctcattttgttggctttcttatgaagaatgcaccacagtttaaagcaaatcatgctgaacttattttagctaacccgagtccagttctcatctaccagatttcatccagtgaaactcgagtacttgttgacattagaggagaaatgccaaggaatttaagagaatacatggttgaaaaaatttacccacaaatacctgatcacctgaaagaaccattcttagaagccactgacaattctcatctgaggtccatgccagcaagcttccttcctccttcatcagtgaagaaacgaggtgttcttcttttgggagacgcatataatatgaggcatccacttactggtggaggaatgactgttgcttttaaagatataaaactatggagaaaactgctaaagggtatccctgacctttatgatgatgcagctattttcgaggccaaaaaatcattttactgggcaagaaaaacatctcattcctttgtcgtgaatatccttgctcaggctctttatgaattattttctgccacagatgattccctgcatcaactaagaaaagcctgttttctttatttcaaacttggtggcgaatgtgttgcgggtcctgttgggctgctttctgtattgtctcctaaccctctagttttaattggacacttctttgctgttgcaatctatgccgtgtatttttgctttaagtcagaaccttggattacaaaacctcgagcccttctcagtagtggtgctgtattgtacaaagcgtgttctgtaatatttcctctaatttactcagaaatgaagtatatggttcattaagcttaaaggggaaccatttgtgaatgaatatttggaacttaccaagtcctaagagacttttggaagaggatatatatagcatagtaccataccacttataaagtggaaactcttggaccaagatttggattaatttgtttttgaagttttttgtatataaatatgtaaatacatgctttaatttgcaatttaaaatgaaggggttaaataagttagacatttaaaagaaatgattgttaccataaattagtgctaatgctgaggagaactacagtttttcttttgaatttagtatttgagatgagttgttgggacatgcaaataaaatgaagaatgaa

SEQ ID NO: 186230 - DNA, 711 bp, Homo sapiens
  Payload ID: 16673
  Gene Symbol: SQLE
  Gene Name: squalene epoxidase
  ENST ID: ENST00000521232
  CDS Start-End: 159-711
ggttactctggttactggggccgcgccgcgctggcgagagccgccgcccgcgagggatgctggtgaggaagccgtcgggagccgccgccgccatctgagggagcattggttgagcctcagatggaggttggatatttgattatgaaagatggaacgaaatgttagaatttcattttgaaggagaagaacaaccactttccatgatgaaaaagtttttaaaaagttcttgggtaaggattggatttgtgcctgaggaagaaagaaacgtgctgcggcgcagaaaaggaaccaatatttcagaaacaagcttaataggaacagctgcctgtacatcaacatcttctcagaatgacccagaagttatcatcgtgggagctggcgtgcttggctctgctttggcagctgtgctttccagagatggaagaaaggtgacagtcattgagagagacttaaaagagcctgacagaatagttggagaattcctgcagccgggtggttatcatgttctcaaagaccttggtcttggagatacagtggaaggtcttgatgcccaggttgtaaatggttacatgattcatgatcaggaaagcaaatcagaggttcagattccttaccctctgtcagaaaacaatcaagtgcagagtggaagagctttccatcacggaagattcatcatgagtctccggaaagcagctatggcagagcccaagt

SEQ ID NO: 186231 - DNA, 554 bp, Homo sapiens
  Payload ID: 16673
  Gene Symbol: SQLE
  Gene Name: squalene epoxidase
  ENST ID: ENST00000518931
  CDS Start-End: 1-492
agaggagaaatgccaaggaatttaagagaatacatggttgaaaaaatttacccacaaatacctgatcacctgaaagaaccattcttagaagccactgacaattctcatctgaggtccatgccagcaagcttccttcctccttcatcagtgaagaaacgaggtgttcttcttttgggagacgcatataatatgaggcatccacttactggtggaggaatgactgttgcttttaaagatataaaactatggagaaaactgctaaagggtatccctgacctttatgatgatgcagctattttcgaggccaaaaaatcattttactgggcaagaaaaacatctcattcctttgtcgtgaatatccttgctcaggctctttatgaattattttctgccacagatgattccctgcatcaactaagaaaagcctgttttctttatttcaaacttggtggcgaatgtgttgcgggtcctgttgggctgctttctgtgtaagttgtgatggcacagaggatacaaacctgccagattttcttaggactgttcagttgatgaat

SEQ ID NO: 186232 - DNA, 1879 bp, Homo sapiens
  Payload ID: 16673
  Gene Symbol: SQLE
  Gene Name: squalene epoxidase
  ENST ID: ENST00000523430
  CDS Start-End: 104-1543
agctggctgagacgcgtggagcctggcggcgagtgggggcgtgcgacggttactctggttactggggccgcgccgcgctggcgagagccgccgcccgcgagggatgctgcgcagaaaaggaaccaatatttcagaaacaagcttaataggaacagctgcctgtacatcaacatcttctcagaatgacccagaagttatcatcgtgggagctggcgtgcttggctctgctttggcagctgtgctttccagagatggaagaaaggtgacagtcattgagagagacttaaaagagcctgacagaatagttggagaattcctgcagccgggtggttatcatgttctcaaagaccttggtcttggagatacagtggaaggtcttgatgcccaggttgtaaatggttacatgattcatgatcaggaaagcaaatcagaggttcagattccttaccctctgtcagaaaacaatcaagtgcagagtggaagagctttccatcacggaagattcatcatgagtctccggaaagcagctatggcagagcccaatgcaaagtttattgaaggtgttgtgttacagttattagaggaagatgatgttgtgatgggagttcagtacaaggataaagagactggagatatcaaggaactccatgctccactgactgttgttgcagatgggcttttctccaagttcaggaaaagcctggtctccaataaagtttctgtatcatctcattttgttggctttcttatgaagaatgcaccacagtttaaagcaaatcatgctgaacttattttagctaacccgagtccagttctcatctaccagatttcatccagtgaaactcgagtacttgttgacattagaggagaaatgccaaggaatttaagagaatacatggttgaaaaaatttacccacaaatacctgatcacctgaaagaaccattcttagaagccactgacaattctcatctgaggtccatgccagcaagcttccttcctccttcatcagtgaagaaacgaggtgttcttcttttgggagacgcatataatatgaggcatccacttactggtggaggaatgactgttgcttttaaagatataaaactatggagaaaactgctaaagggtatccctgacctttatgatgatgcagctattttcgaggccaaaaaatcattttactgggcaagaaaaacatctcattcctttgtcgtgaatatccttgctcaggctctttatgaattattttctgccacagatgattccctgcatcaactaagaaaagcctgttttctttatttcaaacttggtggcgaatgtgttgcgggtcctgttgggctgctttctgtattgtctcctaaccctctagttttaattggacacttctttgctgttgcaatctatgccgtgtatttttgctttaagtcagaaccttggattacaaaacctcgagcccttctcagtagtggtgctgtattgtacaaagcgtgttctgtaatatttcctctaatttactcagaaatgaagtatatggttcattaagcttaaaggggaaccatttgtgaatgaatatttggaacttaccaagtcctaagagacttttggaagaggatatatatagcatagtaccataccacttataaagtggaaactcttggaccaagatttggattaatttgtttttgaagttttttgtatataaatatgtaaatacatgctttaatttgcaatttaaaatgaaggggttaaataagttagacatttaaaagaaatgattgttaccataaattagtgctaatgctgaggagaactacagtttttcttttgaatttagtatttgagatgagttgttgggacatgcaaataaaatgaagaatg

SEQ ID NO: 186233 - DNA, 3293 bp, Homo sapiens
  Payload ID: 16674
  Gene Symbol: SART1
  Gene Name: squamous cell carcinoma antigen recognized by T cells 1
  Uniprot ID: O43290
  ENST ID: ENST00000312397
  CDS Start-End: 93-2495
aacacgacagcggctgccgagcgacccggaagtattcccattttgcgttgtctgggctcggcggcagccgggctcggagtggacgtgccactatggggtcgtccaagaagcatcgcggagagaaggaggcggccgggacgacggcggcggccggcaccgggggtgccaccgagcagccgccgcggcaccgggaacacaaaaaacacaagcaccggagtggcggcagtggcggtagcggtggcgaacgacggaagcggagccgggaacgtgggggcgagcgcgggagcgggcggcgcggggccgaagctgaggcccggagcagcacgcacgggcgggagcgcagccaggcagagccctccgagcggcgcgtgaagcgggagaagcgcgatgacggctacgaggccgctgccagctccaaaactagctcaggcgatgcctcctcactcagcatcgaggagactaacaaactccgggcaaagttggggctgaaacccttggaggttaatgccatcaagaaggaggcgggcaccaaggaggagcccgtgacagctgatgtcatcaaccctatggccttgcgacagcgagaggagctgcgggagaagctggcggctgccaaggagaagcgcctgctgaaccaaaagctggggaagataaagaccctaggagaggatgacccctggctggacgacactgcagcctggatcgagaggagccggcagctgcagaaggagaaggacctggcagagaagagggccaagttactggaggagatggaccaagagtttggtgtcagcactctggtggaggaggagttcgggcagaggcggcaggacctgtacagtgcccgggacctgcagggcctcaccgtggagcatgccattgattccttccgagaaggggagacaatgattcttaccctcaaggacaaaggcgtgctgcaggaggaggaggacgtgctggtgaacgtgaacctggtggataaggagcgggcagagaaaaatgtggagctgcggaagaagaagcctgactacctgccctatgccgaggacgagagcgtggacgacctggcgcagcaaaaacctcgctctatcctgtccaagtatgacgaagagcttgaaggggagcggccacattccttccgcttggagcagggcggcacggctgatggcctgcgggagcgggagctggaggagatccgggccaagctgcggctgcaggctcagtccctgagcacagtggggccccggctggcctccgaatacctcacgcctgaggagatggtgacctttaaaaagaccaagcggagggtgaagaaaatccgcaagaaggagaaggaggtagtagtgcgggcagatgacttgctgcctctcggggaccagactcaggatggggactttggttccagactgcggggacggggtcgccgccgagtgtccgaagtggaggaggagaaggagcctgtgcctcagcccctgccgtcggacgacacccgagtggagaacatggacatcagtgatgaggaggaaggtggagctccaccgccggggtccccgcaggtgctggaggaggacgaggcggagctggagctgcagaagcagctggagaagggacgccggctgcgacagttacagcagctacagcagctgcgagacagtggcgagaaggtggtggagattgtgaagaagctggagtctcgccagcggggctgggaggaggatgaggatcccgagcggaagggggccatcgtgttcaacgccacgtccgagttctgccgcaccttgggggagatccccacctacgggctggctggcaatcgcgaggagcaggaggagctcatggactttgaacgggatgaggagcgctcagccaacggtggctccgaatctgacggggaggagaacatcggctggagcacggtgaacctggacgaggagaagcagcagcaggatttctctgcttcctccaccaccatcctggacgaggaaccgatcgtgaatagggggctggcagctgccctgctcctgtgtcagaacaaagggctgctggagaccacagtgcagaaggtggcccgggtgaaggcccccaacaagtcgctgccctcagccgtgtactgcatcgaggataagatggccatcgatgacaagtacagccggagggaggaataccgaggcttcacacaggacttcaaggagaaggacggctacaaacccgacgttaagatcgaatacgtggatgagacgggccggaaactcacacccaaggaggctttccggcagctgtcgcaccgcttccatggcaagggctcaggcaagatgaagacagagcggcggatgaagaagctggacgaggaggcgctcctgaagaagatgagctccagcgacacgcccctgggcaccgtggccctgctccaggagaagcagaaggctcagaagaccccctacatcgtgctcagcggcagcggcaagagcatgaacgcgaacaccatcaccaagtgacagcgccctcccgccccggccctgcctcaaccttcatattaaataaagctccctccttattttttcctccctggtcgtggtacagattccagggttggatctttggttgggtgtggcacagagtctggctcctgctaggtgagacctggccatcaaatgacacaaacaactaaacgatggaagagagagcgagcccgggtcctctaaggctccttccttctcccctggctgtcggtcacacctctgcagggccggctctctgatagaaagtggaaggcggttttagaaactcatcaccctgctctctcctggcctcgggggctgcacaggtcactgtcctgtaatgtctcccggtcagggcagcccaggactgcccagcctggtgggctggggattgggctttgggtagggcacaggtgccaccttctgtcctggctgtcctgtgccaccctggtctgtgtctagaggagtgaaactcccagggttgggctgggagtatttggtgcacgcggtatggggagggctgagctcagtgcctcctgggagacttgtcccgtgtacagtgacccagaaagatgagattccttggcctgaactctgtgatagagtgtgactgagctgctgggggacatgtgagcctcaaatccatagaaagacaaacggccaccttgggtgcccaggatactggtgcctggccccacgtacacccacatacttctcagatggctcccacattttaagattttaaaaatgaaaccaaaaaataaattgaagaaaactgtaaactttaaagaataa

SEQ ID NO: 186234 - DNA, 753 bp, Homo sapiens
  Payload ID: 16674
  Gene Symbol: SART1
  Gene Name: squamous cell carcinoma antigen recognized by T cells 1
  ENST ID: ENST00000530251
  CDS Start-End: 53-547
ttttgcgttgtctgggctcggcggcagccgggctcggagtggacgtgccactatggggtcgtccaagaagcatcgcggagagaaggaggcggccgggacgacggcggcggccggcaccgggggtgccaccgagcagccgccgcggcaccgggaacacaaaaaacacaagcaccggagtggcggcagtggcggtagcggtggcgaacgacggaagcggagccgggaacgtgggggcgagcgcgggagcgggcggcgcggggccgaagctgaggcccggagcagcacgcacgggcgggagcgcagccaggcagagccctccgagcggcgcgtgaagcgggagaagcgcgatgacggctacgaggccgctgccagctccaaaactagctcaggcgatgcctcctcactcagcatcgaggagactaacaaactccgggcaaagttggggctgaaacccttggaggttaatgccatcaagaaggccatgggcgggcatagcctcacgtctgggccccccttccagaggcgggcaccaaggaggagcccgtgacagctgatgtcatcaaccctatggccttgcgacagcgagaggagctgcgggagaagctggcggctgccaaggagaagcgcctgctgaaccaaaagctggggaagataaagaccctaggagaggatgacccctggctggacgacactgcagcctggatcgagaggagccggcagctgcagaaggagaaggacctggcagagaagagg

SEQ ID NO: 186235 - DNA, 4004 bp, Homo sapiens
  Payload ID: 16675
  Gene Symbol: SART3
  Gene Name: squamous cell carcinoma antigen recognized by T cells 3
  Uniprot ID: Q15020
  ENST ID: ENST00000228284
  CDS Start-End: 236-3127
agttgtgacggaacgcatgccattataatgagtttttatatctggtgggagcttttacagggtataaaataatgtgaatttagtgtatgtggagattttcctgttatctaagttcccagtttctctttcaatggcaagaaaacgggtttttgataaggcgcgcgccgcgggcagcttctgcctcagcgggtcttcggcggccgcgggaagacccgagagtcattagaagcgcaagatggcgactgcggccgaaacctcggcttcagaacccgaggctgagtccaaggctgggcccaaggctgacggagaggaggatgaggttaaggcggctaggacaaggaggaaggtgttatcgcgggctgtggccgctgcgacatacaagaccatggggccagcgtgggatcagcaggaggaaggcgtgagcgagagcgatggggatgagtacgccatggcttcctccgcggagagctcccccggggagtacgagtgggaatatgacgaagaggaggagaaaaaccagctggagattgagagactggaggagcagttgtctatcaacgtctatgactacaactgccatgtggacttgatcagactgctcaggctggaaggggagcttaccaaggtgaggatggcccgccagaagatgagtgaaatctttcccttgactgaagagctctggctggagtggctgcatgacgagatcagcatggcccaggatggcctggacagagagcacgtgtatgacctctttgagaaagccgtgaaggattacatttgtcctaacatttggctagagtatggccagtactcagttggtgggattggtcagaaaggtggccttgagaaagttcgctccgtgtttgaaagggctctctcgtctgttggtttacatatgaccaaaggactcgccctctgggaggcttaccgagagtttgaaagtgcgattgtggaagctgctcggcttgagaaagtccacagtcttttccggcgacagttggcgatcccactctatgatatggaggccacatttgcagagtatgaagaatggtcagaagacccaataccagagtcagtaattcagaactataacaaagcactacagcagctggagaaatataaaccctatgaagaagcactgttgcaggcagaggcaccaaggctggcagaatatcaagcatatatcgattttgagatgaaaattggcgatcctgctcgcattcagttgatctttgagcgcgccctggtcgagaactgccttgtcccagacttatggatccgttacagtcagtacctagatcgacaactgaaagtaaaggatttggttttatctgtacataaccgcgctattagaaactgcccctggacagttgccttatggagtcggtacctcttggccatggagagacatggagttgatcatcaagtaatttctgtaaccttcgagaaagctttgaatgccggcttcatccaggccactgattatgtggagatttggcaggcataccttgattacctgaggagaagggttgatttcaaacaagactccagtaaagagctggaggagttgagggccgcctttactcgtgccttggagtatctgaagcaggaggtggaagagcgtttcaatgagagtggtgatccaagctgcgtgattatgcagaactgggctaggattgaggctcgactgtgcaataacatgcagaaagctcgggaactctgggatagcatcatgaccagaggaaatgccaagtacgccaacatgtggctagagtattacaacctggaaagagctcatggtgacacccagcactgccggaaggctctgcaccgggccgtccagtgcaccagtgactacccagagcacgtctgcgaagtgttactcaccatggagaggacagaaggttctttagaagattgggatatagctgttcagaaaactgaaacccgattagctcgtgtcaatgagcagagaatgaaggctgcagagaaggaagcagcccttgtgcagcaagaagaagaaaaggctgaacaacggaaaagagctcgggctgagaagaaagcgttaaaaaagaagaaaaagatcagaggcccagagaagcgcggagcagatgaggatgatgagaaagagtggggcgatgatgaagaagagcagccttccaaacgcagaagggtcgagaacagcatccctgcagctggagaaacacaaaatgtagaagtagcagcagggcccgctgggaaatgtgctgccgtagatgtggagcccccttcgaagcagaaggagaaggcagcctccctgaagagggacatgcccaaggtgctgcacgacagcagcaaggacagcatcaccgtctttgtcagcaacctgccctacagcatgcaggagccggacacgaagctcaggccactcttcgaggcctgtggggaggtggtccagatccgacccatcttcagcaaccgtggggatttccgaggttactgctacgtggagtttaaagaagagaaatcagcccttcaggcactggagatggaccggaaaagtgtagaagggaggccaatgtttgtttccccctgtgtggataagagcaaaaaccccgattttaaggtgttcaggtacagcacttccctagagaaacacaagctgttcatctcaggcctgcctttctcctgtactaaagaggaactagaagaaatctgtaaggctcatggcaccgtgaaggacctcaggctggtcaccaaccgggctggcaaaccaaagggcctggcctacgtggagtatgaaaatgaatcccaggcgtcgcaggctgtgatgaagatggacggcatgactatcaaagagaacatcatcaaagtggcaatcagcaaccctcctcagaggaaagttccagagaagccggagaccaggaaggcaccaggtggccccatgcttttgccgcagacatacggagcgagggggaagggaaggacgcagctgtctctactgcctcgtgccctgcagcgcccaagtgctgcagctcctcaggctgagaacggccctgccgcggctcctgcagttgccgccccagcagccaccgaggcacccaagatgtccaatgccgattttgccaagctgtttctgagaaagtgaacgggacgctgggagacaggaaatgccttacttcactctggcccggcggacctcccaccacccagcagtgcactggggatggacaggcctggtgtgctgcgtgctcgcaaccacagatggctcctcggctttagacagaaaggggaaggggttctaagtcaagagcctttcagtgctccctcatattgagggcagtggcagaaaagtgaccactctgcaggctgggcccaggatgtggtgtcctgagatagttttgtatcttaaagactgaggcacagaagcgaaacgagaacacactgtttttgagacacagttgtccaaatgtttctggccagctccggcccctttttgtatgacacttctcttccaccctgcacagcacatgtgcccgtcattcttttaattttaaaagatgaaatggcagatgctagtaattcacagaatggcctcttgtgggggtgggtctgagggaagtcagctataaaacatttgctggagttttgttcaatggggctgtgcatttttatattatgtgtttgtaaatgacatgtcagccattgtttcatgtttcctaaaagcagaatatttgcaacatttgttttgtataggaattatttgtgccacctgctgtggactgttttctttgcctagtgactagtgacctgtgttgtctaaacatgagtttcagccctttggttttgtttaataccatgtcaaatgcaaacttcaattctccccatttagctttattaaactgacgttctcttcaaaacttcttgctgaatggtactcagatgtgcattcacatacagatgtgttttgaagtgggtgtaccttgctttacctaatagatgtgtaaatagaacttttgtaagtc

SEQ ID NO: 186236 - DNA, 2834 bp, Homo sapiens
  Payload ID: 16675
  Gene Symbol: SART3
  Gene Name: squamous cell carcinoma antigen recognized by T cells 3
  Uniprot ID: Q15020
  ENST ID: ENST00000431469
  CDS Start-End: 6-2789
gcaagatggcgactgcggccgaaacctcggcttcagaacccgaggctgagtccaaggctgggcccaaggctgacggagaggaggatgaggttaaggcggctaggacaaggaggaaggtgttatcgcgggctgtggccgctgcgacatacaagaccatggggccagcgtgggatcagcaggaggaaggcgtgagcgagagcgatggggatgagtacgccatggcttcctccgcggagagctcccccggggagtacgagtgggaatatgacgaagaggaggagaaaaaccagctggagattgagagactggaggagcagttgtctatcaacgtctatgactacaactgccatgtggacttgatcagactgctcaggctggaaggggagcttaccaaggtgaggatggcccgccagaagatgagtgaaatctttcccttgactgaagagctctggctggagtggctgcatgacgagatcagcatggcccaggatggcctggacagagagcacgtgtatgacctctttgagaaagccgtgaaggattacatttgtcctaacatttggctagagtatggccagtactcagttggtgggattggtcagaaaggtggccttgagaaagttcgctccgtgtttgaaagggctctctcgtctgttggtttacatatgaccaaaggactcgccctctgggaggcttaccgagagtttgaaagtgcgattgtggaagctgctcggcttgagaaagtccacagtcttttccggcgacagttggcgatcccactctatgatatggaggccacatttgcagagtatgaagaatggtcagaagacccaataccagagtcagtaattcagaactataacaaagcactacagcagctggagaaatataaaccctatgaagaagcactgttgcaggcagaggcaccaaggctggcagaatatcaagcatatatcgattttgagatgaaaattggcgatcctgctcgcattcagttgatctttgagcgcgccctggtcgagaactgccttgtcccagacttatggatccgttacagtcagtacctagatcgacaactgaaagtaaaggatttggttttatctgtacataaccgcgctattagaaactgcccctggacagttgccttatggagtcggtacctcttggccatggagagacatggagttgatcatcaagtaatttctgactccagtaaagagctggaggagttgagggccgcctttactcgtgccttggagtatctgaagcaggaggtggaagagcgtttcaatgagagtggtgatccaagctgcgtgattatgcagaactgggctaggattgaggctcgactgtgcaataacatgcagaaagctcgggaactctgggatagcatcatgaccagaggaaatgccaagtacgccaacatgtggctagagtattacaacctggaaagagctcatggtgacacccagcactgccggaaggctctgcaccgggccgtccagtgcaccagtgactacccagagcacgtctgcgaagtgttactcaccatggagaggacagaaggttctttagaagattgggatatagctgttcagaaaactgaaacccgattagctcgtgtcaatgagcagagaatgaaggctgcagagaaggaagcagcccttgtgcagcaagaagaagaaaaggctgaacaacggaaaagagctcgggctgagaagaaagcgttaaaaaagaagaaaaagatcagaggcccagagaagcgcggagcagatgaggatgatgagaaagagtggggcgatgatgaagaagagcagccttccaaacgcagaagggtcgagaacagcatccctgcagctggagaaacacaaaatgtagaagtagcagcagggcccgctgggaaatgtgctgccgtagatgtggagcccccttcgaagcagaaggagaaggcagcctccctgaagagggacatgcccaaggtgctgcacgacagcagcaaggacagcatcaccgtctttgtcagcaacctgccctacagcatgcaggagccggacacgaagctcaggccactcttcgaggcctgtggggaggtggtccagatccgacccatcttcagcaaccgtggggatttccgaggttactgctacgtggagtttaaagaagagaaatcagcccttcaggcactggagatggaccggaaaagtgtagaagggaggccaatgtttgtttccccctgtgtggataagagcaaaaaccccgattttaaggtgttcaggtacagcacttccctagagaaacacaagctgttcatctcaggcctgcctttctcctgtactaaagaggaactagaagaaatctgtaaggctcatggcaccgtgaaggacctcaggctggtcaccaaccgggctggcaaaccaaagggcctggcctacgtggagtatgaaaatgaatcccaggcgtcgcaggctgtgatgaagatggacggcatgactatcaaagagaacatcatcaaagtggcaatcagcaaccctcctcagaggaaagttccagagaagccggagaccaggaaggcaccaggtggccccatgcttttgccgcagacatacggagcgagggggaagggaaggacgcagctgtctctactgcctcgtgccctgcagcgcccaagtgctgcagctcctcaggctgagaacggccctgccgcggctcctgcagttgccgccccagcagccaccgaggcacccaagatgtccaatgccgattttgccaagctgtttctgagaaagtgaacgggacgctgggagacaggaaatgccttacttcactctggcccg

SEQ ID NO: 186237 - DNA, 1935 bp, Homo sapiens
  Payload ID: 16675
  Gene Symbol: SART3
  Gene Name: squamous cell carcinoma antigen recognized by T cells 3
  ENST ID: ENST00000547528
  CDS Start-End: 7-924
cgcaagatggcgactgcggccgaaacctcggcttcagaacccgaggctgagtccaaggctgggcccaaggctgacggagaggaggatgaggttaaggcggctaggacaaggaggaaggtgttatcgcgggctgtggccgctgcgacatacaagaccatggggccagcgtgggatcagcaggaggaaggcgtgagcgagagcgatggggatgagtacgccatggcttcctccgcggagagctcccccggggagtacgagtgggaatatgacgaagaggaggagaaaaaccagctggagattgagagactggaggagcagttgtctatcaacgtctatgactacaactgccatgtggacttgatcagactgctcaggctggaaggggagcttaccaaggtgaggatggcccgccagaagatgagtgaaatctttcccttgactgaagagctctggctggagtggctgcatgacgagatcagcatggcccaggatggcctggacagagagcacgtgtatgacctctttgagaaagccgtgaaggattacatttgtcctaacatttggctagagtatggccagtactcagttggtgggattggtcagaaaggtggccttgagaaagttcgctccgtgtttgaaagggctctctcgtctgttggtttacatatgaccaaaggactcgccctctgggaggcttaccgagagtttgaaagtgcgattgtggaagctgctcggcttgagaaagtccacagtcttttccggcgacagttggcgatcccactctatgatatggaggccacatttgcagagtatgaagaatggtcagaagacccaataccagagtcagtaattcagaactataacaaagcactacagcagctggagaaatataaaccctatgaagaagcactggttaagaaatagaacattgccagtaccttagaagtctcctatgtgcccctctccgattgcctcctcctccctctcccgagagttgcaggcagaggcaccaaggctggcagaatatcaagcatatatcgattttgagatgaaaattggcgatcctgctcgcattcagttgatctttgagcgcgccctggtcgagaactgccttgtcccagacttatggatccgttacagtcagtacctagatcgacaactgaaagtaaaggatttggttttatctgtacataaccgcgctattagaaactgcccctggacagttgccttatggagtcggtacctcttggccatggagagacatggagttgatcatcaagtaatttctgtaaccttcgagaaagctttgaatgccggcttcatccaggccactgattatgtggagatttggcaggcataccttgattacctgaggagaagggttgatttcaaacaagactccagtaaagagctggaggagttgagggccgcctttactcgtgccttggagtatctgaagcaggaggtggaagagcgtttcaatgagagtggtgatccaagctgcgtgattatgcagaactgggctaggattgaggctcgactgtgcaataacatgcagaaagctcgggaactctgggatagcatcatgaccagaggaaatgccaagtacgccaacatgtggctagagtattacaacctggaaagagctcatggtgacacccagcactgccggaaggctctgcaccgggccgtccagtgcaccagtgactacccagagcacgtctgcgaagtgttactcaccatggagaggacagaaggttctttagaagattgggatatagctgttcagaaaactgaaacccgattagctcgtgtcaatgagcagagaatgaaggctgcagagaaggaagcagcccttgtgcagcaagaagaagaaaaggctgaacaacggaaaagagctcgggctgagaagaaagcgttaaaaaagaagaaaaa

SEQ ID NO: 186238 - DNA, 582 bp, Homo sapiens
  Payload ID: 16675
  Gene Symbol: SART3
  Gene Name: squamous cell carcinoma antigen recognized by T cells 3
  ENST ID: ENST00000550322
  CDS Start-End: 114-582
agatagcacgtttattttgtttgtggcagttgtctatcaacgtctatgactacaactgccatgtggacttgatcagactgctcaggctggaaggggagcttaccaaggtgaggatggcccgccagaagatgagtgaaatctttcccttgactgaagagctctggctggagtggctgcatgacgagatcagcatggcccaggatggcctggacagagagcacgtgtatgacctctttgagaaagccgtgaaggattacatttgtcctaacatttggctagagtatggccagtactcagttggtgggattggtcagaaaggtggccttgagaaagttcgctccgtgtttgaaagggctctctcgtctgttggtttacatatgaccaaaggactcgccctctgggaggcttaccgagagtttgaaagtgcgattgtggaagctgctcggcttgagaaagtccacagtcttttccggcgacagttggcgatcccactctatgatatggaggccacatttgcagagtatgaagaatggtcagaagacccaataccagagtcagtaattcagaactataacaaagcac

SEQ ID NO: 186239 - DNA, 878 bp, Homo sapiens
  Payload ID: 16675
  Gene Symbol: SART3
  Gene Name: squamous cell carcinoma antigen recognized by T cells 3
  ENST ID: ENST00000547397
  CDS Start-End: 1-435
gcactggagatggaccggaaaagtgtagaagggaggccaatgtttgtttccccctgtgtggataagagcaaaaaccccgattttaaggtgttcaggtacagcacttccctagagaaacacaagctgttcatctcaggcctgcctttctcctgtactaaagaggaactagaagaaatctgtaaggctcatggcaccgtgaaggacctcaggctggtcaccaaccgggctggcaaaccaaagggcctggcctacgtggagtatgaaaatgaatcccaggcgtcgcaggctgtgatgaagatggacggcatgactatcaaagagaacatcatcaaagtggcaatcagcaaccctcctcagaggaaagttccagagaagccggagaccaggaaggcaccaggtggccccatgcttttgccgcagacatacggagcgtaagtgcttgcatggtagactagtgcaaacttcgtcctggctggcaccagttcatggatcacggggggattaacccgggatgaattagcttcctgttaggacagaaaagccaagatgtgctgttccttgtggtaatcactgtggttccactggagcaaggcgtccagagcaggatgcaagcctaggcagtgacctctgcctggtactggccaatttacacttgtcatttatttcagacagaaataaggcagtgattattttaaagtcccctttgccagttggatctgtgtgtttacaaagaaatctcatacccatgtgtgtgccagtctacggccctagctatgatccacataagctgtgctgttcgctggtttgggatgaggaggagatagcagaattgccaggtgactggtgaggtctgagaggtgatagtcacactgatcccc

SEQ ID NO: 186240 - DNA, 1184 bp, Homo sapiens
  Payload ID: 16675
  Gene Symbol: SART3
  Gene Name: squamous cell carcinoma antigen recognized by T cells 3
  Uniprot ID: Q15020
  ENST ID: ENST00000546611
  CDS Start-End: 247-636
cttctgtccgaagttgtgacggaacgcatgccattataatgagtttttatatctggtgggagcttttacagggtataaaataatgtgaatttagtgtatgtggagattttcctgttatctaagttcccagtttctctttcaatggcaagaaaacgggtttttgataaggcgcgcgccgcgggcagcttctgcctcagcgggtcttcggcggccgcgggaagacccgagagtcattagaagcgcaagatggcgactgcggccgaaacctcggcttcagaacccgaggctgagtccaaggctgggcccaaggctgacggagaggaggatgaggttaaggcggctaggacaaggaggaaggtgttatcgcgggctgtggccgctgcgacatacaagaccatggggccagcgtgggatcagcaggaggaaggcgtgagcgagagcgatggggatgagtacgccatggcttcctccgcggagagctcccccggggagtacgagtgggaatatgacgaagaggaggagaaaaaccagctggagattgagagactggaggagcaggtgggcccgggggtgggcagcgggcatcttccagtctttcaggtcctcgggtccccatgtcctggcccgcctccctagtcctcggcggcgataaagccgccaaggctgcaaacccgcttttcgtgacagtagctcctgtcggatttgagtgcttactgcctgcccattgccttgcaaacgttatctcattgaatcctcgccacgaccctgtgaaggaagccctgttatctatccccattttactggaggaaactgaggctcgtggaggaaagtttcttgctcaagataacacttcctgcaagtcaggccttgtactttgatcccattccagaactcccactcttaaccacacgtccaacagtagaaataaactcattcgcaagagagtgttattttgttatgtaggaatgacggcgatgatgaaacttgtggtaagaaaaatattgaccgcgatggtgataatagaaatggaaaggtttctggttctggaggttaaggcctcagttctagctgttcaactcttgtatgtgcttgtaagaatttcttaatttctctcaccctctcgacttccttatctgcagattgggagcaacaatttctgcataatataattgttgtaacagtaa

SEQ ID NO: 186241 - DNA, 2318 bp, Homo sapiens
  Payload ID: 16675
  Gene Symbol: SART3
  Gene Name: squamous cell carcinoma antigen recognized by T cells 3
  ENST ID: ENST00000546815
  CDS Start-End: 6-2318
gcaagatggcgactgcggccgaaacctcggcttcagaacccgaggctgagtccaaggctgggcccaaggctgacggagaggaggatgaggttaaggcggctaggacaaggaggaaggtgttatcgcgggctgtggccgctgcgacatacaagaccatggggccagcgtgggatcagcaggaggaaggcgtgagcgagagcgatggggatgagtacgccatggcttcctccgcggagagctcccccggggagtacgagtgggaatatgacgaagaggaggagaaaaaccagctggagattgagagactggaggagcagttgtctatcaacgtctatgactacaactgccatgtggacttgatcagactgctcaggctggaaggggagcttaccaaggtgaggatggcccgccagaagatgagtgaaatctttcccttgactgaagagctctggctggagtggctgcatgacgagatcagcatggcccaggatggcctggacagagagcacgtgtatgacctctttgagaaagccgtgaaggattacatttgtcctaacatttggctagagtatggccagtactcagttggtgggattggtcagaaaggtggccttgagaaagttcgctccgtgtttgaaagggctctctcgtctgttggtttacatatgaccaaaggactcgccctctgggaggcttaccgagagtttgaaagtgcgattgtggaagctgctcggcccgtagctggcttcctttccccttttgaccgggaacaaacctttgattcacagcttgagaaagtccacagtcttttccggcgacagttggcgatcccactctatgatatggaggccacatttgcagagtatgaagaatggtcagaagacccaataccagagtcagtaattcagaactataacaaagcactacagcagctggagaaatataaaccctatgaagaagcactgttgcaggcagaggcaccaaggctggcagaatatcaagcatatatcgattttgagatgaaaattggcgatcctgctcgcattcagttgatctttgagcgcgccctggtcgagaactgccttgtcccagacttatggatccgttacagtcagtacctagatcgacaactgaaagtaaaggatttggttttatctgtacataaccgcgctattagaaactgcccctggacagttgccttatggagtcggtacctcttggccatggagagacatggagttgatcatcaagtaatttctgtaaccttcgagaaagctttgaatgccggcttcatccaggccactgattatgtggagatttggcaggcataccttgattacctgaggagaagggttgatttcaaacaagactccagtaaagagctggaggagttgagggccgcctttactcgtgccttggagtatctgaagcaggaggtggaagagcgtttcaatgagagtggtgatccaagctgcgtgattatgcagaactgggctaggattgaggctcgactgtgcaataacatgcagaaagctcgggaactctgggatagcatcatgaccagaggaaatgccaagtacgccaacatgtggctagagtattacaacctggaaagagctcatggtgacacccagcactgccggaaggctctgcaccgggccgtccagtgcaccagtgactacccagagcacgtctgcgaagtgttactcaccatggagaggacagaaggttctttagaagattgggatatagctgttcagaaaactgaaacccgattagctcgtgtcaatgagcagagaatgaaggctgcagagaaggaagcagcccttgtgcagcaagaagaagaaaaggctgaacaacggaaaagagctcgggctgagaagaaagcgttaaaaaagaagaaaaagatcagaggcccagagaagcgcggagcagatgaggatgatgagaaagagtggggcgatgatgaagaagagcagccttccaaacgcagaagggtcgagaacagcatccctgcagctggagaaacacaaaatgtagaagtagcagcagggcccgctgggaaatgtgctgccgtagatgtggagcccccttcgaagcagaaggagaaggcagcctccctgaagagggacatgcccaaggtgctgcacgacagcagcaaggacagcatcaccgtctttgtcagcaacctgccctacagcatgcaggagccggacacgaagctcaggccactcttcgaggcctgtggggaggtggtccagatccgacccatcttcagcaaccgtggggatttccgaggttactgctacgtggagttt

SEQ ID NO: 186242 - DNA, 548 bp, Homo sapiens
  Payload ID: 16675
  Gene Symbol: SART3
  Gene Name: squamous cell carcinoma antigen recognized by T cells 3
  ENST ID: ENST00000550619
  CDS Start-End: 216-548
gatggaaaacagcttgcagcatatagggggctacttaagaaagagtggcataggaggggggccgggggcgccctctgaggaagtgaagtttatacctgaagtatgaaaaggggtggctaggcagagagaagttgtctatcaacgtctatgactacaactgccatgtggacttgatcagactgctcaggctggaaggggagcttaccaaggtgaggatggcccgccagaagatgagtgaaatctttcccttgactgaagagctctggctggagtggctgcatgacgagatcagcatggcccaggatggcctggacagagagcacgtgtatgacctctttgagaaagccgtgaaggattacatttgtcctaacatttggctagagtatggccagtactcagttggtgggattggtcagaaaggtggccttgagaaagttcgctccgtgtttgaaagggctctctcgtctgttggtttacatatgaccaaaggactcgccctctgggaggcttaccgagagtttgaaagtgcgattgtggaagctgctcgg

SEQ ID NO: 186243 - DNA, 3637 bp, Homo sapiens
  Payload ID: 16675
  Gene Symbol: SART3
  Gene Name: squamous cell carcinoma antigen recognized by T cells 3
  Uniprot ID: Q15020
  ENST ID: ENST00000546728
  CDS Start-End: 8-1102
gcgcaagatggcgactgcggccgaaacctcggcttcagaacccgaggctgagtccaaggctgggcccaaggctgacggagaggaggatgaggttaaggcggctaggacaaggaggaaggtgttatcgcgggctgtggccgctgcgacatacaagaccatggggccagcgtgggatcagcaggaggaaggcgtgagcgagagcgatggggatgagtacgccatggcttcctccgcggagagctcccccggggagtacgagtgggaatatgacgaagaggaggagaaaaaccagctggagattgagagactggaggagcagttgtctatcaacgtctatgactacaactgccatgtggacttgatcagactgctcaggctggaaggggagcttaccaaggtgaggatggcccgccagaagatgagtgaaatctttcccttgactgaagagctctggctggagtggctgcatgacgagatcagcatggcccaggatggcctggacagagagcacgtgtatgacctctttgagaaagccgtgaaggattacatttgtcctaacatttggctagagtatggccagtactcagttggtgggattggtcagaaaggtggccttgagaaagttcgctccgtgtttgaaagggctctctcgtctgttggtttacatatgaccaaaggactcgccctctgggaggcttaccgagagtttgaaagtgcgattgtggaagctgctcggcttgagaaagtccacagtcttttccggcgacagttggcgatcccactctatgatatggaggccacatttgcagagtatgaagaatggtcagaagacccaataccagagtcagtaattcagaactataacaaagcactacagcagctggagaaatataaaccctatgaagaagcactgttgcaggcagaggcaccaaggctggcagaatatcaagcatatatcgattttgagatgaaaattggcgatcctgctcgcattcagttgatctttgagcgcgccctggtcgagaactgccttgtcccagacttatggatccgttacagatcgacaactgaaagtaaaggatttggttttatctgtacataaccgcgctattagaaactgcccctggacagttgccttatggagtcggtacctcttggccatggagagacatggagttgatcatcaagtaatttctgtaaccttcgagaaagctttgaatgccggcttcatccaggccactgattatgtggagatttggcaggcataccttgattacctgaggagaagggttgatttcaaacaagactccagtaaagagctggaggagttgagggccgcctttactcgtgccttggagtatctgaagcaggaggtggaagagcgtttcaatgagagtggtgatccaagctgcgtgattatgcagaactgggctaggattgaggctcgactgtgcaataacatgcagaaagctcgggaactctgggatagcatcatgaccagaggaaatgccaagtacgccaacatgtggctagagtattacaacctggaaagagctcatggtgacacccagcactgccggaaggctctgcaccgggccgtccagtgcaccagtgactacccagagcacgtctgcgaagtgttactcaccatggagaggacagaaggttctttagaagattgggatatagctgttcagaaaactgaaacccgattagctcgtgtcaatgagcagagaatgaaggctgcagagaaggaagcagcccttgtgcagcaagaagaagaaaaggctgaacaacggaaaagagctcgggctgagaagaaagcgttaaaaaagaagaaaaagatcagaggcccagagaagcgcggagcagatgaggatgatgagaaagagtggggcgatgatgaagaagagcagccttccaaacgcagaagggtcgagaacagcatccctgcagctggagaaacacaaaatgtagaagtagcagcagggcccgctgggaaatgtgctgccgtagatgtggagcccccttcgaagcagaaggagaaggcagcctccctgaagagggacatgcccaaggtgctgcacgacagcagcaaggacagcatcaccgtctttgtcagcaacctgccctacagcatgcaggagccggacacgaagctcaggccactcttcgaggcctgtggggaggtggtccagatccgacccatcttcagcaaccgtggggatttccgaggttactgctacgtggagtttaaagaagagaaatcagcccttcaggcactggagatggaccggaaaagtgtagaagggaggccaatgtttgtttccccctgtgtggataagagcaaaaaccccgattttaaggtgttcaggtacagcacttccctagagaaacacaagctgttcatctcaggcctgcctttctcctgtactaaagaggaactagaagaaatctgtaaggctcatggcaccgtgaaggacctcaggctggtcaccaaccgggctggcaaaccaaagggcctggcctacgtggagtatgaaaatgaatcccaggcgtcgcaggctgtgatgaagatggacggcatgactatcaaagagaacatcatcaaagtggcaatcagcaaccctcctcagaggaaagttccagagaagccggagaccaggaaggcaccaggtggccccatgcttttgccgcagacatacggagcgagggggaagggaaggacgcagctgtctctactgcctcgtgccctgcagcgcccaagtgctgcagctcctcaggctgagaacggccctgccgcggctcctgcagttgccgccccagcagccaccgaggcacccaagatgtccaatgccgattttgccaagctgtttctgagaaagtgaacgggacgctgggagacaggaaatgccttacttcactctggcccggcggacctcccaccacccagcagtgcactggggatggacaggcctggtgtgctgcgtgctcgcaaccacagatggctcctcggctttagacagaaaggggaaggggttctaagtcaagagcctttcagtgctccctcatattgagggcagtggcagaaaagtgaccactctgcaggctgggcccaggatgtggtgtcctgagatagttttgtatcttaaagactgaggcacagaagcgaaacgagaacacactgtttttgagacacagttgtccaaatgtttctggccagctccggcccctttttgtatgacacttctcttccaccctgcacagcacatgtgcccgtcattcttttaattttaaaagatgaaatggcagatgctagtaattcacagaatggcctcttgtgggggtgggtctgagggaagtcagctataaaacatttgctggagttttgttcaatggggctgtgcatttttatattatgtgtttgtaaatgacatgtcagccattgtttcatgtttcctaaaagcagaatatttgcaacatttgttttgtataggaattatttgtgccacctgctgtggactgttttctttgcctagtgactagtgacctgtgttgtctaaacatgagtttcagccctttggttttgtttaataccatgtcaaatgcaaacttcaattctccccatttagcttta

SEQ ID NO: 186244 - DNA, 394 bp, Homo sapiens
  Payload ID: 16676
  Gene Symbol: SLIRP
  Gene Name: SRA stem-loop interacting RNA binding protein
  Uniprot ID: Q9GZT3
  ENST ID: ENST00000238688
  CDS Start-End: 34-357
gacctcggctcgagaaggtgctttagtctgaagatggcggcctcagcagcgagaggtgctgcggcgctgcgtagaagtatcaatcagccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggttcacactagaaggccaaaacttccgcaaacatctgatgatgaaaagaaagatttttgagactgcagcctattaataaagttaacataactgagaa

SEQ ID NO: 186245 - DNA, 285 bp, Homo sapiens
  Payload ID: 16676
  Gene Symbol: SLIRP
  Gene Name: SRA stem-loop interacting RNA binding protein
  ENST ID: ENST00000553981
  CDS Start-End: 1-171
gtgagaagaattccttggactgcggcgtcgagtcagctgaaagaacactttgcacagttcggccatgtcagaaggacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcagcctattaataaagttaacataactgagaa

SEQ ID NO: 186246 - DNA, 729 bp, Homo sapiens
  Payload ID: 16676
  Gene Symbol: SLIRP
  Gene Name: SRA stem-loop interacting RNA binding protein
  ENST ID: ENST00000556831
  CDS Start-End: 1-290
cctcagcagcgagaggtgctgcggcgctgcgtagaagtatcaatcagccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtaaatttatttctatgccagatacatacatgatatacatgtaggtactatttaattatgtatcaattaaatagatcataaatgtggaatgatggggacttggagagatttgtaactgaagctgccttaatgcttgttaagaatggtggggtggaggctgggcacggtggctcacgcctgtaatcccagcactttgggaggccgaggcgggcggatcacaaggtcaggagatcgagaccatcctggctaacacggtgaaaccccgtctctactaaaaatacaaaaaattagcctggcaaggtggcgggcgcctgtagtcccagctactcgggaggctgaggcaggagaatggcgtgaaccccagggggtggagcctgcagtgagccgagattgcgccactgcactccagcctgggcgatagcgagactccatctcaaacaaacaaacaaacaaaacaacaacaaaaaaagaa

SEQ ID NO: 186247 - DNA, 725 bp, Homo sapiens
  Payload ID: 16676
  Gene Symbol: SLIRP
  Gene Name: SRA stem-loop interacting RNA binding protein
  ENST ID: ENST00000557431
  CDS Start-End: 10-384
agtctgaagatggcggcctcagcagcgagaggtgctgcggcgctgcgtagaagtatcaatcagccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggaatccttgtttcgggacacccagtggacagcgaaaggagagagaccaccacaggcaaacggccggaaagccgcgcagtcgcagcccgcgcgcttcactccgcccaaataagccactaccgtcaccaaccccatctcgttcgcccgagccgcggacctgagggagcgctgtccgctccccgcaagatgctcacgcgaaaaacccactcttcagtgtctgagaccactccgcagctttcggcctcggtgagcgggtgaactaaacccgggaaaccgctgaaagaccccagcttcgactaggcctagtcgtagcggcggccagcgggagggcgtagccgtagtcttggcccacgtcattctgtgccccgggtcaggtcaccgcccggagggtatgggaagagaaatgaagaagactggtactcccagacccttccgtatcgaggaccccaatca

SEQ ID NO: 186248 - DNA, 408 bp, Homo sapiens
  Payload ID: 16676
  Gene Symbol: SLIRP
  Gene Name: SRA stem-loop interacting RNA binding protein
  Uniprot ID: Q9GZT3
  ENST ID: ENST00000557342
  CDS Start-End: 42-371
ggggccgcgacctcggctcgagaaggtgctttagtctgaagatggcggcctcagcagcgagaggtgctgcggcgctgcgtagaagtatcaatcagccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcagcctattaataaagttaacataactgagaa

SEQ ID NO: 186249 - DNA, 471 bp, Homo sapiens
  Payload ID: 16676
  Gene Symbol: SLIRP
  Gene Name: SRA stem-loop interacting RNA binding protein
  ENST ID: ENST00000555890
  CDS Start-End: 1-121
ggcggcctcagcagcgagaggtgctgcggcgctgcgtagaagtatcaatcagccggttgcttttgtgagaagaattccttggactgcggcgtcgaggatcatagtccacatagcacagtaactggtatgaaaacactcgatatttgctgaggatggagactgcagccaactcaacaacttctctgtccatctcaccaccaagtctggtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcagcctattaataaagttaacataact

SEQ ID NO: 186250 - DNA, 865 bp, Homo sapiens
  Payload ID: 16676
  Gene Symbol: SLIRP
  Gene Name: SRA stem-loop interacting RNA binding protein
  ENST ID: ENST00000557623
  CDS Start-End: 10-306
agtctgaagatggcggcctcagcagcgagaggtgctgcggcgctgcgtagaagtatcaatcagccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaagtgtctcaaatctcagcccactataagaagttaaaatcagaactgtttcatcttgtctcaagtttcaacatacaacttccaatttttttgtcatcatgctggcatttacatccaaatgtaaagtatgttaattttcgtttccctgaggataggtattcacatcaacacacacaatatgctgttcctaaacttgtaccttggattggttgaagagcctttggtcatactgaacttcattggaagtccgaggattaggaacaccgagagcaataacttcactgatatcccgattttcatttctctgaagtttcgacctattttgaaatacgacatcactaactgaaaactctttatagacaagctgaatatgttcaatagaaatacaaccaatctcagaaacaaaggatgtgaatatgtcacattcacatcttgtgaacatatattccttgatgatacataatcaagctggcagcccttataaagcatttcagattagagggagagttttacaattaggacgtcctgttagctcaaaagaacatctaacagattcgttgacatggaattctttaatataagcaatcaccttacaa

SEQ ID NO: 186251 - DNA, 408 bp, Homo sapiens
  Payload ID: 16676
  Gene Symbol: SLIRP
  Gene Name: SRA stem-loop interacting RNA binding protein
  ENST ID: ENST00000556375
  CDS Start-End: 1-219
aatcagccggttgcttttgtgagaagaattccttggactgcggcgtcgagtcagctgaaagaacactttgcacagttcggccatgtcagaaggtgcattttaccttttgaatccttgtttcgggacacccagtggacagcgaaaggagagagaccaccacaggcaaacggccggaaagccgcgcagtcgcagcccgcgcgcttcactccgcccaaataagccactaccgtcaccaaccccatctcgttcgcccgagccgcggacctgagggagcgctgtccgctccccgcaagatgctcacgcgaaaaacccactcttcagtgtctgagaccactccgcagctttcggcctcggtgagcgggtgaactaaacccgggaaaccgctgaaagaccccagcttcgactagg

SEQ ID NO: 186252 - DNA, 626 bp, Homo sapiens
  Payload ID: 16676
  Gene Symbol: SLIRP
  Gene Name: SRA stem-loop interacting RNA binding protein
  ENST ID: ENST00000556310
  CDS Start-End: 1-231
aatcagccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaagtccatggtctcataataaaatgaagcattatagaaccagctcaagataccatccagttacaaaataccaatcaactcaaatcagaccagtcggcaacctctttgtttagggaatccttgtttcgggacacccagtggacagcgaaaggagagagaccaccacaggcaaacggccggaaagccgcgcagtcgcagcccgcgcgcttcactccgcccaaataagccactaccgtcaccaaccccatctcgttcgcccgagccgcggacctgagggagcgctgtccgctccccgcaagatgctcacgcgaaaaacccactcttcagtgtctgagaccactccgcagctttcggcctcggtgagcgggtgaactaaacccgggaaaccgctgaaagaccccagcttcgactagg

SEQ ID NO: 186253 - DNA, 420 bp, Homo sapiens
  Payload ID: 16676
  Gene Symbol: SLIRP
  Gene Name: SRA stem-loop interacting RNA binding protein
  ENST ID: ENST00000613856
  CDS Start-End: 42-320
ggggccgcgacctcggctcgagaaggtgctttagtctgaagatggcggcctcagcagcgagaggtgctgcggcgctgcgtagaagtatcaatcagccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaagtgcttatttttttaaggtccaggttcacactagaaggccaaaacttccgcaaacatctgatgatgaaaagaaagatttttgagactgcagcctattaataaagttaacataactg

SEQ ID NO: 186254 - DNA, 2783 bp, Homo sapiens
  Payload ID: 16677
  Gene Symbol: SHB
  Gene Name: Src homology 2 domain containing adaptor protein B
  Uniprot ID: Q15464
  ENST ID: ENST00000377707
  CDS Start-End: 567-2096
gccgccgggacgggcacgggcgcgcgggctccggcgggcgccggctgccttcctccgtcgctcgctgtctctcccggccgcattctcctccgctgcggggccgagctctccccagcgctcgcaggaaggaagaagggagccgaggacgccgagaagttcccgcggcagccgcggatcccggccaaggcggaggctgcggctccgacggggcaggagcgcgatccacggcgaggggcgtacggccaaagggtccgcggcgtggagcgctcggaccttccgctctcccccgggcgtgggccgggaccccatgagacgcgcccacgaggggcgcgagattcctagcttgggcggcgctaggcggagggaggtgttgcagccgccggagccagagagctgccggcaggaggcggcggcggcaagaacttgaacttggcgtcgggagcgggcgccccggacgccccccgccggggccggggcgccgagggacctgcgccgcagcgctgccccccgaatggccgcggcggcggaccgggctcccgcgccgcggccctaggcggcctctcgccatggccaagtggctaaacaagtacttcagcttgggcaacagcaagaccaagagccccccgcagccgccgcggccagactaccgcgagcagcggcgccgaggcgagcggccttcgcagcccccccaggccgtgccgcaggcctcctccgccgcctcggcgtcctgcggtccggccaccgcctcctgcttctcagcctcttcgggctcgctgcccgacgacagcggcagcaccagcgacctcatccgcgcctaccgcgcgcagaaggagcgagacttcgaggacccctacaacgggcctggctcgtcgctgcgcaaactgcgcgccatgtgccgcctggactactgcggcggcagcggggagccaggcggggtccagcgcgccttctcggcctcgtccgcgtcgggcgccgcgggctgttgctgcgcctcctcgggcgcgggggccgccgcgtcctcgtcctcgtcctccggctctccgcatctctaccgcagcagcagcgagcggcggcccgccacgccggccgaggtgcgctacatctcccccaagcaccgcctcatcaaagtggagagcgccgcgggcggtggggccggggaccccctggggggcgcctgcgcgggcggccgcacctggagcccgacggcctgcggaggcaagaaactgctcaacaagtgcgccgcctcagccgcggaggagagcggggccggcaagaaggacaaggtgaccatagccgatgactactcagatccctttgatgccaagaatgatctcaagagcaaagcaggaaagggggagagtgctggctacatggagccctatgaggcacagaggatcatgacagaatttcagaggcaggaaagtgtccggtcccagcataaaggtatccagttatatgacaccccttacgaacctgaaggccaaagtgttgactcagactcggagagcacagtcagcccccgactgcgggagagcaagctgccccaggatgacgacaggcccgccgatgagtacgaccagccttgggagtggaaccgggtcaccatcccagccctggcagcacagtttaatggcaacgagaagcggcagtcatccccctcaccttcgcgggaccggcggcgccagcttcgtgcccctggagggggctttaagcctatcaaacatgggagccctgagttctgcgggatcctaggagaaagggtggatcctgccgtccccctggagaagcaaatatggtatcacggagccatcagcagaggagacgccgagaacctgctgcgactctgcaaggagtgtagctaccttgtccggaacagccagaccagcaagcatgactactccctctccctgaggagcaaccagggttttatgcacatgaaactggccaaaaccaaagagaaatacgttctgggtcagaacagccctccgttcgacagtgtcccggaagtcatccactactacaccaccagaaagctacccatcaaaggggctgagcacttgtccctcctctatcccgtggctgtgaggaccctgtgagcggaccagacctgccctgctctgtgacagagcctgagacttggaggtgccagaggccccccaccaaccagcccagccactgttgctggctgtgtcgtttgtgttgtgtgtatggtactagcacaccactgcatgtctctagaatgctgttgccacttacgggggctggagaaggcctggataaagacagaagggcggcaacacaccaccccagcccccacccccaccctctccttgagtttctgtgaattaaaatatttgcaaatccaaagagatgccttccaggatgaacaaaggcagaccagctccgaggggcggggtagggtggggcgggagctccctggctgacatctctttgttctccagctgtctcaaattcacacctctgtacagggcaaagttttcccacaggagcccccctactgatgctgggagccaaatgctggtgctttgagagtcccggaggccccggggttcccgccccgctggtgtgtatatgtgtgtctgtgtgagtgtgtgtgtgagtacagatgtgagaaggtggtcacacacagatgggtaagcccactgatctacttgtagtcactcagtgtaatcattaggctatcttcaaggaatcattgtgcagtcaaaaagaggattcaattatttatgaatagggtgtgtaaataaaatagtcatttaata

SEQ ID NO: 186255 - DNA, 6243 bp, Homo sapiens
  Payload ID: 16678
  Gene Symbol: SHE
  Gene Name: Src homology 2 domain containing E
  Uniprot ID: Q5VZ18
  ENST ID: ENST00000304760
  CDS Start-End: 88-1575
gccgggcgtgggcgacggccggccgggggcgcacggagcagccgtcgcggggcctcgccgcggcctccagcgccccagtcacggggaatgcagtggtccccgacccctggcgcctctgcgtgtctgggctgggcttcctcgctcgcctgctccacggccccgacgctcctgggccgagccggccggggccccctcatggcggccaagtggttcaaggagttccccctgaacctgaagaccgtgtcggagcgggccaagcccgggggcggcggcggcaaattgcgcaagaactcggaggcgggcggcgctgggccgggtcctggcaagggccgcaagaactcggcggccgagctggggagcggcagggccggcgtcggccccaaggacagccggctgtcccgcgacagcctgcagggtctgattcaggccgccgcgggcaagggccgcaaaaactcccgggccacggaggaggagccccaccggggtgcaaccaagagctcgggctgcagcacctacatcaacaggctcatcaaggtggacactcaggagaagaacgggaagagcaactaccccagcagcagtagctccagctccagctcctcttcctccgcgtcctcttccccttcctccctggggcccgagctggacaagggcaagattattaagcagcaagagacggtcatcattttagaagactatgctgacccttatgatgccaaacggacaaagggtcaaagggatgcagagagagtcggagagaacgacggttacatggaaccatatgatgcacagcaaatgataacagaaattagacgacggggttccaaagatcccctggtgaaggctctccagctgcttgacagtccctgtgaacccgcagacggtggcctgaaatcagagaccttggccaaaagacggagttccaaggacctcctggggaagccgccacagctatacgacactccctacgagcctgcagaaggggggcccagggcagaggggaaggcgcggcccccagacagccggctgcccgagaacgacgagaggcccgcggcagagtacgagcagccatgggagtggaagaaggagcagatcgtgcgggctctgtcagtccagtttgaaggagctgagcgaccttccttcagggaggagacagtgaggcagcaccaccggcagaagagctggacccagaagatcctgaagccagccctctcggaccacagtgagggagagaaagtggacccgggcctgcccctggagaagcagccctggtatcatggtgccatcagccgtgctgaggctgagagtcgactacagccctgcaaagaagctggttacctggttcgaaatagtgagtcagggaacagcaggtactccattgccctaaagactagtcaaggatgtgtccacatcatagtggctcagaccaaagacaacaaatacacactgaatcagacaagcgctgtgtttgacagcatccctgaagtggtacactattattccaatgaaaagttgcctttcaaaggggcagaacacatgactttactctacccagtgcacagcaagcttcactaagattcagccactgcaagccctgggcctctggcaccttcaagggcatcatcagcgcacaaccagcatctcagaggacaaggctggactagcaactgctagaaaatgggagtcttccttgaaaagtcagagagtgatttgttttgttttgtttgagacgaagtctcgctgtgttgcccaggctggagtgcaatggcgcaatcttggctcactgcaacatctgactcctgggttcaagcagttcttccccatcagcctcccaagtaggtgggactataggttcgcaccaccactcccagctaatttttttttttgtatttttagtagagatggggtttcgccgtcttcgtcaggctggtctcaaactcctgacctcaaatgatccacccacctcagtctccccgagtgcctggattacaggcatgagccactgcacccggccaagtctttggtcttaaagtgattccatgacactttgtttgtggcctgtcccttgtttccttgctaagtagttctacaataagaaatcatgatttagctgttgcctccagctctggggtagggtgttctttttatggtgtgaccctcaggaaggttaagtcaggagttcaggagcatcagagttctctagaaatgtgcctacttgttacctggaatacctggtctctaaacaaaccaacaaaaaatccacgtggcttttccacatgatggtgcagactggaagaggatgttatattggactcgttattggggaaatgaatgagcgggagaaaatgtgaatgacgggcaagaaggtggtctttctccctcagaagtcctaattcagctctggagttcatggaaatccgcaacttcagagtgtggcctaaggattattttgttggtcagcctttccaagaaagtgtgtgttctctcaatctctgtggattttctcattttttagcaaatcagtgagataagcataaataggaaggaagataccccaggtttaagaatcaccaatatcattaggcattggcatcattattagaattctgaattatagaataaaaggtacaacaaaaatttcatttctgaattttaaaattctggaaatttgcaaagctccacaactgtttttttactgaattaattacatagaacttcgatgtcttttgtttcatcatcattgggcattttagttgctatggaataatttttaatttttgtctctaaaattagatttgctttgtagtaaattttttaaaaatgcaaccctaagatctgattatatgaactgggtctctaaagcctacaaagattctctcgttctgtaccaagcagactgccttgtactatacagaagtgtttgaaaagacctagaggttttctcttaaataccattacttaagattcatagtattaggatctttatgatttatcatgagcttatatcaccagtttatttactgtgaaaaaaaccatgggaatggcatactgtgagaagagtactatggtgaatggctccagaattaaaattcagcagatgtgtctgtattctggggttggtcatttgggtctcaaaactgccccatatgcaaatgtactgactgtcatcaatgaaaagttaacctttgtagcttataaatacacacaaaatgttgatttggttaattttttaggaaagtatacctttgtagttactagttacatttgactgtaagatttagaggttagtaaatttttgcttctttattcagataagatctcagccaaaaggttgtgtgatctttgattttaaaaatttaagaggaacttttcctcactggaacacaatgattttattaataaagaatgtaggctgggtgcggtggctcatgcacgtaatcccaacaatttgggaggctgaggcaggcagatcacgtgaggtcaggagtttgagaccagcctggccaacatggtgaaaccctgtctgtagtaaaaatacaaaaattagctgggcacggtggcgggcacctgtagttccagctgcttgggaggctgaggcacgagaatcacttgagcccaggaggtggaggttgcagtgagccaagattatgtcactgcactccatcctgggtgacaagagcgaaactccatctcaaaaaaaaaaaaaaaaaaaagcctggcctggtggtggatgcctgtggttccagctattcgggaggctgaggtaggtggatcacctctgctcaggtcaaggctgcagcgagccatgatcgcaccattgcactccagcctgagtgacagagtgagaccctgtctcaacaagcaagcaaacaaaaaaccaaaaggaatgtttttttcagatactgatagaatgttttcagtgtgtattggttcatttactatatctttagtgtaagattttaaaaggttttttcagcatccattcaacaaatatttattatctttatacaaattattcattgtgttaaacttatttttagtttaacattctagaaatgaaacgtttttacttaaccttattctacaaagggaatacagcagttattctaattttaataaatgctaaaagctttatacaatttttctttgtgcactaaatgatttttggcccatacccagcaactgtgatgaatgtataatgaaataacatcttgaaaacaggccagatacattaagtatttattgagcttctgtcatatgcccagtattatgcttcttctatactgtttctctgtgacaagtcatactatattctttatagaattaaaagtagaggagaggcagagtttacatattgtccagttgctttacagttgtacaggaggttataagaagaaatatagtaaattagtgggaagtcagaggtgggggcgttagtgagctattttcttcttgaggttgtgacacaagctgacaaaagccagggagttcacagctgtgtggtggcacaaagttccatatgttctaaaaacaattaggcccagcagggtgtccctaatggcttccttgttaaacctccatggccagctgatctgaagctctgtgacatgttctctgagctctgaatgctctggctttttgtcattttgtcttgagacaagtattttcctgtagtcctcattccttcgagttattccatctcccaggatattctctggtgagaagaatgtctttcagtgaatttgccttgaatttagcatccatagagctgtgtcagtgttcttcttgatcacaccttctttaaaaaaaatacttgcttgcgatgactggacaagttcagttggttagtttcaggcctataagaagagagagtaaaggaccttgctatttactttgataccatagttgtatctcaggatggcctgcaaaccactggccttgtgtgtatttaagctaggaataaaataatggagaagtgttaatatgtatacaaaaaggtaaatattgatatatctactctctgttgggggcagaagtgtcattttaagttattcaaagcactttcttaagcattttagaaagcctttattctttgctgttggaagtctccgtactttgcagaattggtatttgtgtactagcctctgccgcaggatggggaggtgggcaggtagctgataggggcagccaggagtttttgaggcaggtggtgggaaattgtcctaatttgttaattggattatgtaactctgttactagtctgttattggctgttgttactggatgcatcttgatattcagaagaataactgtgaggcattcttcagttgcgggttaagtggggttagtttctgttctgtcagatgccctttttcagtcaaaggttagccccttgtttctccctccttccagggtttagggagtgcagtgatgtcgatttcatttcccttccccgcaccccttgacactcagcaggattgcactgaaacccttcacagatctctcgttcactagttgtctcctatttttccataactagcactagtttggccttatgacctggttagaatcactcttctgtattctcatttccaatttttgtgccccactaacgtggactagagaaacttggcctgctgtgcagtgggccttctgttcaacttaccctccaccgctgaccctgtgtgaagagagatggtgcgttactgccatctaatgggaaaagagaaaactgcagttgggaaaagcagctgtgcatttaagggtagggctttctgaaggatttctgatacagtccagaaaagggaaaatgatgacacagcagttgccatcttgaaaaatgccctttcctgcggaaagggtgttttgaagtctaatacaactatcatcacaaggtccctggactaaggctggatcgtgtaatttagaatctcaaattgtattttaattaatatgctggcaacagaatcattgaaacaggcgtctcattttgtcaagttcttagccgttcagtttgtcaggggctttaatattttagatatcaactaatacatagtttcaacttttaaaaatgtttgaagattgtatgtaatataggtgtctatctatagtgccttagtaatttaaatcagaaatattttataaaacttctggttgttttgcagtagccaatataggcttcatgccctcctgaagatagtttcctctgaaatgtaactttaaataaacattattccaagaaaa

SEQ ID NO: 186256 - DNA, 6855 bp, Homo sapiens
  Payload ID: 16678
  Gene Symbol: SHE
  Gene Name: Src homology 2 domain containing E
  ENST ID: ENST00000555188
  CDS Start-End: 1-397
agaggggaaggcgcggcccccagacagccggctgcccgagaacgacgagaggcccgcggcagagtacgagcagccatgggagtggaagaaggagcagatcgtgcgggctctgtcagtccagtttgaaggagctgagcgaccttccttcagggaggagacagtgaggcagcaccaccggcagaagagctggacccagaagatcctgaagccagccctctcggaccacagtgagggagagaaagtggacccgggcctgcccctggagaagcagccctggtatcatggtgccatcagccgtgctgaggctgagagtcgactacagccctgcaaagaagctggttacctggttcgaaatagtgagtcagggaacagcaggtactccattgccctaaagtaagtaagccccatggctttcctcatctccaaggggaaggaacactgtgtgacagtcttctagtcaaaaaaaacatactgtgaaggtgtttcacaggggtgtgcattgcagaaaataagaggcatttgtttggacaatggaacatgagacacttggatgagaatgcaaaattggtattgggtaaatgcctccattatctattatgataatgaaggtcttattgcattatctttgtgcattagtcaatgtctaccttacattacctaatctggagtaggccctctcagtagagaaataattcctgatgaaaagaattatttctaacagggtagtacagtcattcttcttttattccctagtattggggactttaataaatcaagatccccctgattgtcaaaatgccaactgcaattttgacaccagtttcttctggtgaagaaggaaatgctgacttgcctgttgctccctctgtctgattgtacacagaaaattcacttttgcctggtaggcctggtggagtgtgtatcatggaaattctcactgctccgtgagttcagtgtccctgtattggaggatcattgtcaagagccctaacagcatttccttcctgaggaagctgagcccctgcagctgaaacaatcaggctggaggagaacagagtcgggcgggggagttgagcaatatggctcagaaaatgggataggccaccagatatacaataccaggaatagctcgactgtgttcctgaaattggtgcttgtggattaaatctttgagcttttggtgccagctttcattttatacaaccaggaatggtctttccagatgcgaggggaggaaatggtttttattattattatttatgtgttctttttggaaaaaaagaagaagaacccttacttacgtccttttagctgtggtgaggaggatgagtttttttggggtttcttttctttttctttttttttttttttgagatggagtctcactctgttgcctaggctagagttcagtggcataatctcggctcactacaaccttcgcctcctgggttcaagtgattctcctgcctcagcctcccaagtagctgggattacaggtgcctgccaccatgcccggctaatttttttgtattttttagtagagatggggttttaccatgttggccaggctggtcttgaactcctgacctcaagtgatccgcccacttcggcctcccacagtgctgggatacaggcgtgagccaccgtgcccagccgaggatgagtttctacctcaccttagtagcctcgtgcttgggcgtaagcactggttttgcaatttgagagctagaagggacttggcattctttttaattgttttctttgttccactacctgatgactcatatgtgataaggataaaccactcaaggattacatgcgtttagactgtgaaatttctgagagtaccactagagtgtggaatgcatttctgtgtgtgtagaaccattacgggatggatgagaacctatcaacctagtgtgaatctggctgcaattgttttcagtggggagggatcctctgcccactcattcatgtctcctccttgattttcattccaggactagtcaaggatgtgtccacatcatagtggctcagaccaaagacaacaaatacacactgaatcagacaagcgctgtgtttgacagcatccctgaagtggtacactattattccaatgaaaagttgcctttcaaaggggcagaacacatgactttactctacccagtgcacagcaagcttcactaagattcagccactgcaagccctgggcctctggcaccttcaagggcatcatcagcgcacaaccagcatctcagaggacaaggctggactagcaactgctagaaaatgggagtcttccttgaaaagtcagagagtgatttgttttgttttgtttgagacgaagtctcgctgtgttgcccaggctggagtgcaatggcgcaatcttggctcactgcaacatctgactcctgggttcaagcagttcttccccatcagcctcccaagtaggtgggactataggttcgcaccaccactcccagctaatttttttttttgtatttttagtagagatggggtttcgccgtcttcgtcaggctggtctcaaactcctgacctcaaatgatccacccacctcagtctccccgagtgcctggattacaggcatgagccactgcacccggccaagtctttggtcttaaagtgattccatgacactttgtttgtggcctgtcccttgtttccttgctaagtagttctacaataagaaatcatgatttagctgttgcctccagctctggggtagggtgttctttttatggtgtgaccctcaggaaggttaagtcaggagttcaggagcatcagagttctctagaaatgtgcctacttgttacctggaatacctggtctctaaacaaaccaacaaaaaatccacgtggcttttccacatgatggtgcagactggaagaggatgttatattggactcgttattggggaaatgaatgagcgggagaaaatgtgaatgacgggcaagaaggtggtctttctccctcagaagtcctaattcagctctggagttcatggaaatccgcaacttcagagtgtggcctaaggattattttgttggtcagcctttccaagaaagtgtgtgttctctcaatctctgtggattttctcattttttagcaaatcagtgagataagcataaataggaaggaagataccccaggtttaagaatcaccaatatcattaggcattggcatcattattagaattctgaattatagaataaaaggtacaacaaaaatttcatttctgaattttaaaattctggaaatttgcaaagctccacaactgtttttttactgaattaattacatagaacttcgatgtcttttgtttcatcatcattgggcattttagttgctatggaataatttttaatttttgtctctaaaattagatttgctttgtagtaaattttttaaaaatgcaaccctaagatctgattatatgaactgggtctctaaagcctacaaagattctctcgttctgtaccaagcagactgccttgtactatacagaagtgtttgaaaagacctagaggttttctcttaaataccattacttaagattcatagtattaggatctttatgatttatcatgagcttatatcaccagtttatttactgtgaaaaaaaccatgggaatggcatactgtgagaagagtactatggtgaatggctccagaattaaaattcagcagatgtgtctgtattctggggttggtcatttgggtctcaaaactgccccatatgcaaatgtactgactgtcatcaatgaaaagttaacctttgtagcttataaatacacacaaaatgttgatttggttaattttttaggaaagtatacctttgtagttactagttacatttgactgtaagatttagaggttagtaaatttttgcttctttattcagataagatctcagccaaaaggttgtgtgatctttgattttaaaaatttaagaggaacttttcctcactggaacacaatgattttattaataaagaatgtaggctgggtgcggtggctcatgcacgtaatcccaacaatttgggaggctgaggcaggcagatcacgtgaggtcaggagtttgagaccagcctggccaacatggtgaaaccctgtctgtagtaaaaatacaaaaattagctgggcacggtggcgggcacctgtagttccagctgcttgggaggctgaggcacgagaatcacttgagcccaggaggtggaggttgcagtgagccaagattatgtcactgcactccatcctgggtgacaagagcgaaactccatctcaaaaaaaaaaaaaaaaaaaagcctggcctggtggtggatgcctgtggttccagctattcgggaggctgaggtaggtggatcacctctgctcaggtcaaggctgcagcgagccatgatcgcaccattgcactccagcctgagtgacagagtgagaccctgtctcaacaagcaagcaaacaaaaaaccaaaaggaatgtttttttcagatactgatagaatgttttcagtgtgtattggttcatttactatatctttagtgtaagattttaaaaggttttttcagcatccattcaacaaatatttattatctttatacaaattattcattgtgttaaacttatttttagtttaacattctagaaatgaaacgtttttacttaaccttattctacaaagggaatacagcagttattctaattttaataaatgctaaaagctttatacaatttttctttgtgcactaaatgatttttggcccatacccagcaactgtgatgaatgtataatgaaataacatcttgaaaacaggccagatacattaagtatttattgagcttctgtcatatgcccagtattatgcttcttctatactgtttctctgtgacaagtcatactatattctttatagaattaaaagtagaggagaggcagagtttacatattgtccagttgctttacagttgtacaggaggttataagaagaaatatagtaaattagtgggaagtcagaggtgggggcgttagtgagctattttcttcttgaggttgtgacacaagctgacaaaagccagggagttcacagctgtgtggtggcacaaagttccatatgttctaaaaacaattaggcccagcagggtgtccctaatggcttccttgttaaacctccatggccagctgatctgaagctctgtgacatgttctctgagctctgaatgctctggctttttgtcattttgtcttgagacaagtattttcctgtagtcctcattccttcgagttattccatctcccaggatattctctggtgagaagaatgtctttcagtgaatttgccttgaatttagcatccatagagctgtgtcagtgttcttcttgatcacaccttctttaaaaaaaatacttgcttgcgatgactggacaagttcagttggttagtttcaggcctataagaagagagagtaaaggaccttgctatttactttgataccatagttgtatctcaggatggcctgcaaaccactggccttgtgtgtatttaagctaggaataaaataatggagaagtgttaatatgtatacaaaaaggtaaatattgatatatctactctctgttgggggcagaagtgtcattttaagttattcaaagcactttcttaagcattttagaaagcctttattctttgctgttggaagtctccgtactttgcagaattggtatttgtgtactagcctctgccgcaggatggggaggtgggcaggtagctgataggggcagccaggagtttttgaggcaggtggtgggaaattgtcctaatttgttaattggattatgtaactctgttactagtctgttattggctgttgttactggatgcatcttgatattcagaagaataactgtgaggcattcttcagttgcgggttaagtggggttagtttctgttctgtcagatgccctttttcagtcaaaggttagccccttgtttctccctccttccagggtttagggagtgcagtgatgtcgatttcatttcccttccccgcaccccttgacactcagcaggattgcactgaaacccttcacagatctctcgttcactagttgtctcctatttttccataactagcactagtttggccttatgacctggttagaatcactcttctgtattctcatttccaatttttgtgccccactaacgtggactagagaaacttggcctgctgtgcagtgggccttctgttcaacttaccctccaccgctgaccctgtgtgaagagagatggtgcgttactgccatctaatgggaaaagagaaaactgcagttgggaaaagcagctgtgcatttaagggtagggctttctgaaggatttctgatacagtccagaaaagggaaaatgatgacacagcagttgccatcttgaaaaatgccctttcctgcggaaagggtgttttgaagtctaatacaactatcatcacaaggtccctggactaaggctggatcgtgtaatttagaatctcaaattgtattttaattaatatgctggcaacagaatcattgaaacaggcgtctcattttgtcaagttcttagccgttcagtttgtcaggggctttaatattttagatatcaactaatacatagtttcaacttttaaaaatgtttgaagattgtatgtaatataggtgtctatctatagtgccttagtaatttaaatcagaaatattttataaaacttctggttgttttgcagtagccaatataggcttcatgccctcctgaagatagtttcctctgaaatgtaactttaaataaacattattccaagaaaa

SEQ ID NO: 186257 - DNA, 693 bp, Homo sapiens
  Payload ID: 16678
  Gene Symbol: SHE
  Gene Name: Src homology 2 domain containing E
  ENST ID: ENST00000486773
  CDS Start-End: 1-124
cagccgtgctgaggctgagagtcgactacagccctgcaaagaagctggttacctggttcgaaatagtgagtcagggaacagcaggtactccattgccctaaaaaatcaccatctgctctcctaagttcttctggaaagagcaccgtaaccatgtcatcctaacagcaatgccatgaagaaagggaggcagctccctccacgtcctggctccagtgcccactcccgtgccccctccatggcccacgcagcctggccacctgggtgacatctggtccctgtgtcactttctgcaagacaaggaccagcctcaaagaggagagcatggtgtcctgaaggagatggcggccaccatcacctgtcctgtggctttcctctgactgcccaggtgggggcccagaggcggcgcctctcagtccagctttgagtggagttacataatttccaggcttccctgcagttctcgcctccccatccctgaactgtttacacagtagctctcacccacaaagagtccgcatgatggcttttcctctgtttggaagatgtggatggctgtgtcccaagtttttcctacctaagatccttttcagtaggggatggatttggtctatctgatgatcaagagttcagggtggcctttgtgatagtgttacaccccctcccaggtccaataaacagtcttctgacaaataa

SEQ ID NO: 186258 - DNA, 2500 bp, Homo sapiens
  Payload ID: 16679
  Gene Symbol: SHF
  Gene Name: Src homology 2 domain containing F
  Uniprot ID: Q7M4L6
  ENST ID: ENST00000290894
  CDS Start-End: 496-1767
gtactaaccactatacgatcacggcgagctaccgggacgccacgacgagcagctgacccagtgttgcccttctcgtctagatggcggccattccagctttcctaagcgtccattatctaccaggttcctcccgcacccacgttcacccgcaagagcagccgggagcgctgtggactccctagcccgaagtctcctcttggctgtacgcacggaccgcaaaagaagggacatgaaagtgctttgcaaccaaaggattcctatgaggccgggcctgcaatgatgtgaagcccctgaggacgcccgaatggtggcccaaagtctctctgacgctcaccatgccctgactatcatgctatctgaacgactttggctgggactggagctcttaaattttacaagaaggaaaatcagttctgacccaccaccatacaacttccttgaggcgcgagggtgtccacaatctccacagaggcggcattgggtcaccgctggaggatgcagcaggagggaggacccgtgaggagcgccccctgtaggaccggaaccctggagggttcgcggcaagggtctccggggcataggaaacgggcatcccccaagggtagtctgagttccgcccagccccattcctggatgctcacgccgtctcccctaaactcccactgcgctcaccgggagcccatctcatcatcaccacagcccgtggctaatgggccaaaacagaagaagaaaagcaactggcggagtacaacgcgcctgcgcattatcagactcagggacaggctggaacctcgccccctagctatcctagaagactatgcggacccgtttgatgttcaggagactggcgaaggctcagcaggagcttcaggagccccagagaaggtccctgaaaatgatggctacatggagccctatgaggctcaaaagatgatggccgagatccggggctccaaggagacagcaactcagcccttgcctctgtatgacacaccctatgagccagaggaggatggggccaccgcggaaggtgagggggccccctggccccgggagtcccgcctgccagaggatgatgagaggccccctgaggagtatgaccagccctgggagtggaagaaggagcggatttccaaagcctttgcagttgacattaaggtcatcaaagacctaccttggcctccacctgtgggacagctggacagcagcccctccctgcctgatggggacagggacatctccggtccagcctcgcccctccctgagcccagcctggaggacagcagcgcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccaggtctggtatcacggggccatcagccgaaccgacgccgagaacctgctccggctgtgcaaagaggccagctacctggtgcgcaacagtgagaccagcaagaatgacttctccctctccctcaagagcagccagggattcatgcacatgaagctgtcccgaaccaaggaacacaaatatgtgctgggccagaacagcccgcccttcagcagcgtccctgaaattgtgcaccactatgccagccgcaagctacccattaagggagccgaacacatgtccctgctctaccctgtggccatccggactctttagatgtgaagccagggcactgtgatagacctgtacccagccctgtgcccatcacctggctgagggctgtggctcttgccagggacgtgatctttcaaacctttcttctcctgggatccagtagaagctggagattccttaatttattctaaagggaaagggctcctggggccttggagtaaggggttgtctggagctggggaaagaggaatccctggagagaaaggatagcccctggaggaagggggttccagagctactgggatggtagggagtttcagactggcagctccggctcctttccgaccttagggcagaggtggtgacctccaccaccaccaccctctccccactgggtccgtgcgaggtagtgcagaattcggccccttggggcgccttaccacctctctgcctccgtccccgacttccaccccagaccgtcggagggctccgcccagagtctggtaagaggtttggggaagacaggcccctgggaagcagccggctttggggggtggggagagaaggggaggggctcgggcagagggaactgtgcagtccccaggccgccccggctccgggccagaggcaataaataaacccgatcctgccgggcacagccgcgcccgcgcctccggcgccgtccccgggctgacgggggagggagcggagaagcgagcgcagattctgcgtataaatcagctctggagcagacacagcccggctgtgaaaagca

SEQ ID NO: 186259 - DNA, 1163 bp, Homo sapiens
  Payload ID: 16679
  Gene Symbol: SHF
  Gene Name: Src homology 2 domain containing F
  ENST ID: ENST00000458022
  CDS Start-End: 210-929
gagttgccacctgggtgcccatgggcactgcaggctagagctgaggaggcccacgccagcctcggaggggtcgcagctctgggcatgggcccaggacttggctagctatcctagaagactatgcggacccgtttgatgttcaggagactggcgaaggctcagcaggagcttcaggagccccagagaaggtccctgaaaatgatggctacatggagccctatgaggctcaaaagatgatggccgagatccggggctccaaggagacagcaactcagcccttgcctctgtatgacacaccctatgagccagaggaggatggggccaccgcggaaggtgagggggccccctggccccgggagtcccgcctgccagaggatgatgagaggccccctgaggagtatgaccagccctgggagtggaagaaggagcggatttccaaagcctttgcagcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccaggtctggtatcacggggccatcagccgaaccgacgccgagaacctgctccggctgtgcaaagaggccagctacctggtgcgcaacagtgagaccagcaagaatgacttctccctctccctcaagagcagccagggattcatgcacatgaagctgtcccgaaccaaggaacacaaatatgtgctgggccagaacagcccgcccttcagcagcgtccctgaaattgtgcaccactatgccagccgcaagctacccattaagggagccgaacacatgtccctgctctaccctgtggccatccggactctttagatgtgaagccagggcactgtgatagacctgtacccagccctgtgcccatcacctggctgagggctgtggctcttgccagggacgtgatctttcaaacctttcttctcctgggatccagtagaagctggagattccttaatttattctaaagggaaagggctcctggggccttggagtaaggggttgtctggagctggggaaagaggaatccctggagagaaaggatagcccctg

SEQ ID NO: 186260 - DNA, 884 bp, Homo sapiens
  Payload ID: 16679
  Gene Symbol: SHF
  Gene Name: Src homology 2 domain containing F
  ENST ID: ENST00000559566
  CDS Start-End: 1-599
ctggcgaaggctcagcaggagcttcaggagccccagagaaggtccctgaaaatgatggctacatggagccctatgaggctcaaaagatgatggccgagatccggggctccaaggagacagcaactcagcccttgcctctgtatgacacaccctatgagccagaggaggatggggccaccgcggaaggtgagggggccccctggccccgggagtcccgcctgccagaggatgatgagaggccccctgaggagtatgaccagccctgggagtggaagaaggagcggatttccaaagcctttgcagcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccaggtctggtatcacggggccatcagccgaaccgacgccgagaacctgctccggctgtgcaaagaggccagctacctggtgcgcaacagtgagaccagcaagaatgacttctccctctccctcaagtgagtggggacagttgtggtttcagggacagcaagcagggtggaaggggactccagtattccccttatgcccaaccaagctggggaggtccccatcccccatgaacaatccccaggcactgggggtcctgagatgtctgagactcagcccctgctctcaaggagctcagagtccattgggagaaatagttgatccgcagcatccagctcagaagggttctgttctagttgtgtggcctggcccccttaacctctctaggcctcagtttccttactaatgaaatggatg

SEQ ID NO: 186261 - DNA, 1731 bp, Homo sapiens
  Payload ID: 16679
  Gene Symbol: SHF
  Gene Name: Src homology 2 domain containing F
  ENST ID: ENST00000560734
  CDS Start-End: 2-874
catgttactgagcggagctcctccggctggctcccgcccggggccgcgaacgcaggggagcgctgggggcggcccgggggggtcccgccggggcgccgggggtgcgggagccggcccaggagggggcggcagcggcggagtagccaagtggctccgggagcacctgggcttccgcggggggggcggcggcggagggggcagcaagccggcgccccccgagcccgactaccgcccccctgcgccctctccggccgcgccccccgcgccgcccccggacatcctggccgcctacaggctgcagcgggagcgcgacttcgaagacccctactccggggggtcgtccggctccgccgccctcgccacccctgtcgcccccggacccacgccgcccccgcgccacggctctcccccacaccgccttattcgggtcgagaccccggggcccccggcgccgcctgctgatgagcggatctccggaccccccgccagcagcgataggctagctatcctagaagactatgcggacccgtttgatgttcaggagactggcgaaggctcagcaggagcttcaggagccccagagaaggtccctgaaaatgatggctacatggagccctatgaggctcaaaagatgatggccgagatccggggctccaaggagacagcaactcagcccttgcctctgtatgacacaccctatgagccagaggaggatggggccaccgcggaaggtgagggggccccctggccccgggagtcccgcctgccagaggatgatgagaggccccctgaggagtatgaccagccctgggagtggaagaaggagcggatttccaaagcctttgcaggagcagccagggattcatgcacatgaagctgtcccgaaccaaggaacacaaatatgtgctgggccagaacagcccgcccttcagcagcgtccctgaaattgtgcaccactatgccagccgcaagctacccattaagggagccgaacacatgtccctgctctaccctgtggccatccggactctttagatgtgaagccagggcactgtgatagacctgtacccagccctgtgcccatcacctggctgagggctgtggctcttgccagggacgtgatctttcaaacctttcttctcctgggatccagtagaagctggagattccttaatttattctaaagggaaagggctcctggggccttggagtaaggggttgtctggagctggggaaagaggaatccctggagagaaaggatagcccctggaggaagggggttccagagctactgggatggtagggagtttcagactggcagctccggctcctttccgaccttagggcagaggtggtgacctccaccaccaccaccctctccccactgggtccgtgcgaggtagtgcagaattcggccccttggggcgccttaccacctctctgcctccgtccccgacttccaccccagaccgtcggagggctccgcccagagtctggtaagaggtttggggaagacaggcccctgggaagcagccggctttggggggtggggagagaaggggaggggctcgggcagagggaactgtgcagtccccaggccgccccggctccgggccagaggcaataaataaacccgatcctgccgggcacagccgcgcccgcgcctccggcgccgtccccgggctgacgggggagggagcggagaagcgagcgcagattctgcgtataaat

SEQ ID NO: 186262 - DNA, 2499 bp, Homo sapiens
  Payload ID: 16679
  Gene Symbol: SHF
  Gene Name: Src homology 2 domain containing F
  ENST ID: ENST00000560471
  CDS Start-End: 5-1249
ccccatgttactgagcggagctcctccggctggctcccgcccggggccgcgaacgcaggggagcgctgggggcggcccgggggggtcccgccggggcgccgggggtgcgggagccggcccaggagggggcggcagcggcggagtagccaagtggctccgggagcacctgggcttccgcggggggggcggcggcggagggggcagcaagccggcgccccccgagcccgactaccgcccccctgcgccctctccggccgcgccccccgcgccgcccccggacatcctggccgcctacaggctgcagcgggagcgcgacttcgaagacccctactccggggggtcgtccggctccgccgccctcgccacccctgtcgcccccggacccacgccgcccccgcgccacggctctcccccacaccgccttattcgggtcgagaccccggggcccccggcgccgcctgctgatgagcggatctccggaccccccgccagcagcgataggctagctatcctagaagactatgcggacccgtttgatgttcaggagactggcgaaggctcagcaggagcttcaggagccccagagaaggtccctgaaaatgatggctacatggagccctatgaggctcaaaagatgatggccgagatccggggctccaaggagacagcaactcagcccttgcctctgtatgacacaccctatgagccagaggaggatggggccaccgcggaaggtgagggggccccctggccccgggagtcccgcctgccagaggatgatgagaggccccctgaggagtatgaccagccctgggagtggaagaaggagcggatttccaaagcctttgcagttgacattaaggtcatcaaagacctaccttggcctccacctgtgggacagctggacagcagcccctccctgcctgatggggacagggacatctccggtccagcctcgcccctccctgagcccagcctggaggacagcagcgcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccagctggtatcacggggccatcagccgaaccgacgccgagaacctgctccggctgtgcaaagaggccagctacctggtgcgcaacagtgagaccagcaagaatgacttctccctctccctcaagtgagtggggacagttgtggtttcagggacagcaagcagggtggaaggggactccagtattccccttatgcccaaccaagctggggaggtccccatcccccatgaacaatccccaggcactgggggtcctgagatgtctgagactcagcccctgctctcaaggagctcagagtccattgggagaaatagttgatccgcagcatccagctcagaagggttctgttctagttgtgtggcctggcccccttaacctctctaggcctcagtttccttactaatgaaatggatgggggataatatagggaaggattaggtgaaataatgcatgggaagtgcttagcatagtgctaagggctcaataaattatcactgtcattattaatggaagcccaagatgttctagaagcataggcaaggagataggagctttgcgtgagggagtctgtagggtgttggggggggctggttcctggaaggagggcagggcagtggacacaaagtatttctgtttactctgaggaagagtgtgtgtgtctgtgtgtgtgttcggggatggggggtgtctgagcttttgggtcctggaagacgtagaggaggcaaggccctccctccccatcaggctttcctcccaggagcagcagatcagcctcccagactccctggtagcatggccagccctgccctgggcaaccaggagttctgcctggtagaccctgcaccccgttaggaagccagtggggtggtatgttcatttgccccccaccatcactagtaggacacctgcaccactttctaccacattctctgggaccatcagagtacagatataccctcccattcagacaaatccaatctatgggaacttggggctgctaaacaagacatatttgggggataattattcaacttccctcaaagataatagaaaaagtggtgggtgtgttggctcacatctgtaatcccagcactttcaaaggccgtggcaggtggatcacctgaagtcaggagttcgagaccaacctgaccaacatggtgaaaccccgtctctactaaaaatacaaaaattagttgggtgtgatggtgagcactggtaatgccagctactcgggaggctgaggcaggaaaatcgcttgaacccaggaggcggaggttgcagtgagccgatattgcgccattgcactccagcccaggccaacaacagcaagactctgtctcag

SEQ ID NO: 186263 - DNA, 2062 bp, Homo sapiens
  Payload ID: 16679
  Gene Symbol: SHF
  Gene Name: Src homology 2 domain containing F
  ENST ID: ENST00000560540
  CDS Start-End: 6-1109
gccccatgttactgagcggagctcctccggctggctcccgcccggggccgcgaacgcaggggagcgctgggggcggcccgggggggtcccgccggggcgccgggggtgcgggagccggcccaggagggggcggcagcggcggagtagccaagtggctccgggagcacctgggcttccgcggggggggcggcggcggagggggcagcaagccggcgccccccgagcccgactaccgcccccctgcgccctctccggccgcgccccccgcgccgcccccggacatcctggccgcctacaggctgcagcgggagcgcgacttcgaagacccctactccggggggtcgtccggctccgccgccctcgccacccctgtcgcccccggacccacgccgcccccgcgccacggctctcccccacaccgccttattcgggtcgagaccccggggcccccggcgccgcctgctgatgagcggatctccggaccccccgccagcagcgataggctagctatcctagaagactatgcggacccgtttgatgttcaggagactggcgaaggctcagcaggagcttcaggagccccagagaaggtccctgaaaatgatggctacatggagccctatgaggctcaaaagatgatggccgagatccggggctccaaggagacagcaactcagcccttgcctctgtatgacacaccctatgagccagaggaggatggggccaccgcggaaggtgagggggccccctggccccgggagtcccgcctgccagaggatgatgagaggccccctgaggagtatgaccagccctgggagtggaagaaggagcggatttccaaagcctttgcagcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccagctggtatcacggggccatcagccgaaccgacgccgagaacctgctccggctgtgcaaagaggccagctacctggtgcgcaacagtgagaccagcaagaatgacttctccctctccctcaagagcagccagggattcatgcacatgaagctgtcccgaaccaaggaacacaaatatgtgctgggccagaacagcccgcccttcagcagcgtccctgaaattgtgcaccactatgccagccgcaagctacccattaagggagccgaacacatgtccctgctctaccctgtggccatccggactctttagatgtgaagccagggcactgtgatagacctgtacccagccctgtgcccatcacctggctgagggctgtggctcttgccagggacgtgatctttcaaacctttcttctcctgggatccagtagaagctggagattccttaatttattctaaagggaaagggctcctggggccttggagtaaggggttgtctggagctggggaaagaggaatccctggagagaaaggatagcccctggaggaagggggttccagagctactgggatggtagggagtttcagactggcagctccggctcctttccgaccttagggcagaggtggtgacctccaccaccaccaccctctccccactgggtccgtgcgaggtagtgcagaattcggccccttggggcgccttaccacctctctgcctccgtccccgacttccaccccagaccgtcggagggctccgcccagagtctggtaagaggtttggggaagacaggcccctgggaagcagccggctttggggggtggggagagaaggggaggggctcgggcagagggaactgtgcagtccccaggccgccccggctccgggccagaggcaataaataaacccgatcctgccgggcacagccgcgcccgcgcctccggcgccgtccccgggctgacgggggagggagcggagaagcgagcgcagattctgcgtataaatcagctctggagcagacacagcccggctgtgaaaagca

SEQ ID NO: 186264 - DNA, 603 bp, Homo sapiens
  Payload ID: 16679
  Gene Symbol: SHF
  Gene Name: Src homology 2 domain containing F
  ENST ID: ENST00000561239
  CDS Start-End: 1-484
cagcccctccctgcctgatggggacagggacatctccggtccagcctcgcccctccctgagcccagcctggaggacagcagcgcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccaggtctggtatcacggggccatcagccgaaccgacgccgagaacctgctccggctgtgcaaagaggccagctacctgctgtcatactctaggagtctgaattgtaaaatcaaagaagcatttcccagaaaagtttttgtcaaaaatttgatttacataacctcagaaatgtgtattgctttaaaaattataaagttcatggagcataccaagcagcctgtataccatttctaaaccaactactcccctgcaagatagatctcttttttatagacagaaaataaattcaaagaggtttgttacttgcccaaggccacccggtaataaagtccccaaaccaggatttgaaccca

SEQ ID NO: 186265 - DNA, 597 bp, Homo sapiens
  Payload ID: 16679
  Gene Symbol: SHF
  Gene Name: Src homology 2 domain containing F
  ENST ID: ENST00000558685
  CDS Start-End: 1-440
atgaccagccctgggagtggaagaaggagcggatttccaaagcctttgcagttgacattaaggtcatcaaagacctaccttggcctccacctgtgggacagctggacagcagcccctccctgcctgatggggacagggacatctccggtccagcctcgcccctccctgagcccagcctggaggacagcagcgcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccaggtgggacacccacaatgggtgggcctggacagcgagggacccagcagagatgccccccttcctctctctcatccttagctggtatcacggggccatcagccgaaccgacgccgagaacctgctccggctgtgcaaagaggccagctacctggtgcgcaacagtgagaccagcaagaatgacttctccctctccctcaagtgagtggggacagttgtggtttcagggacagcaagc

SEQ ID NO: 186266 - DNA, 578 bp, Homo sapiens
  Payload ID: 16679
  Gene Symbol: SHF
  Gene Name: Src homology 2 domain containing F
  ENST ID: ENST00000561278
  CDS Start-End: 499-578
agtgttgcccttctcgtctagatggcggccattccagctttcctaagcgtccattatctaccaggttcctcccgcacccacgttcacccgcaagagcagccgggagcgctgtggactccctagcccgaagtctcctcttggctgtacgcacggaccgcaaaagaagggacatgaaagtgctttgcaaccaaaggattcctatgaggccgggcctgcaatgatgtgaagcccctgaggacgcccgaatggtggcccaaagtctctctgacgctcaccatgccctgactatcatgctatctgaacgactttggctgggactggagctcttaaattttacaagaaggaaaatcagttctgacccaccaccatacaacttccttgaggcgcgagctagctatcctagaagactatgcggacccgtttgatgttcaggagactggcgaaggctcagcaggagcttcaggagccccagagaaggtccctgaaaatgatggctacatggagccctatgaggctcaaaagatgatggccgagatccggggctccaaggagacagcaactcagcccttgcctctgta

SEQ ID NO: 186267 - DNA, 604 bp, Homo sapiens
  Payload ID: 16679
  Gene Symbol: SHF
  Gene Name: Src homology 2 domain containing F
  ENST ID: ENST00000558294
  CDS Start-End: 1-491
ccccctggccccgggagtcccgcctgccagaggatgatgagaggccccctgaggagtatgaccagccctgggagtggaagaaggagcggatttccaaagcctttgcaggggacacccacaatgggtgggcctggacagcgagggacccagcagagatgccccccttcctctctctcatccttagctggtatcacggggccatcagccgaaccgacgccgagaacctgctccggctgtgcaaagaggccagctacctggtgcgcaacagtgagaccagcaagaatgacttctccctctccctcaagagcagccagggattcatgcacatgaagctgtcccgaaccaaggaacacaaatatgtgctgggccagaacagcccgcccttcagcagcgtccctgaaattgtgcaccactatgccagccgcaagctacccattaagggagccgaacacatgtccctgctctaccctgtggccatccggactctttagatgtgaagccagggcactgtgatagacctgtacccagccctgtgcccatcacctggctgagggctgtggctcttgccagggacgtgatctttcaaacctttcttctcctggga

SEQ ID NO: 186268 - DNA, 2577 bp, Homo sapiens
  Payload ID: 16680
  Gene Symbol: SHD
  Gene Name: Src homology 2 domain containing transforming protein D
  Uniprot ID: Q96IW2
  ENST ID: ENST00000543264
  CDS Start-End: 1464-2486
caaaaggacagatgcagaggacaggcgccaggcacagataccatctcccttccccaagccagctgcccccaaccctccccctgcccgcaattagtcctctggggcgggagcggggcacagagcagagccctcttgggggaggggaagcccgatccgcacccacccttcctttgcccccctcttccttctgctgctccaatatcaatttcagccagtgacctctccaccaatttgcacatccccactctcccggtccgtttcaccgccagacatcggttccatttcgaccctcactggcggtcattcccaccccctctgctggtcaatttcaccccttttggcggtcaagtgcagtcccccatttcccgggcaatttccccctcccctccttctccctctcccctcccctccccagcagtgtcactcccagctgctccccacctcccgcgctccgcgctcgctgcggccagtctcgggcgtcccggtcagtgtccagctgccgcggcctcggccccggcgactcccgcccccagccccccttccctccgcgggcagcggctccctccctccccagaacagctgaaggtctcagtcacctccgaggggagcgcagggggaggggaggggcgggggacgcggcggaggggaggtgggggagccttgacgctgctgcccgggacgcggcccggggctggtgggaacaggggcgtcctcctgcgcgcccccctccccagcgtcccacctcccggcggcggcggggaaagtctctccgaaagcgtgaagggggattggaggaggtttttatttccctttgtgcgggtggctggggccggatcgaggcggcgggggccgcgggactgggggctccccgctgagccgagaggagcgcgacaaaggatgcgtcccgccggggtcacagtctccgcggcccaactttgcgcgcggcgcccgcgcccctggggagcccgcccgctgcgctgagaacccaggcgtccgggctgggagaggggccgggagcgtccgcaggtggcgctggcccggatctcccgaccccaggaagggatcccggagcttcctggaggcggcgggcggccgtgtcgctccagggaaccgcgctgcccgcggaaactccgcgcgcctccgcggatgcccctcgccctagcccccagcgcgcggggttcggggccctgcgaggtccccccttcccccgcggtgcttcccaagctgggctaaggcgggcttctcttcctccctcctctgtcgcctccttttcctccccctcgttcaccttttccttccctctatccatccagagccccgccaaagggcgcacctgatctttctcatccttccctgctcttcccttcctctccacctcctcctcctccttggggaaaggggcccggagaagggcatgtgggggcccctctgacagtggcccgattggggtgacaggcgcccaaatggccaagtggctacgggactacctgagctttgggggtcggaggccccctccgcagccgcccaccccggactacaccgagagcgacatcctgagggcctaccgcgcgcagaagaacctggacttcgaggacccctatgaggacgcggagagccgcttggagccggaccccgcgggccctggggactccaagaaccccggagatgccaagtatggttctcccaagcaccggctcatcaaggtggaggctgcggatatggccagagccaaggcccttctgggcggccccggggaggagctggaagccgacactgagtatttagacccctttgatgctcagcctcatcctgcacccccggatgatgggtacatggagccctacgatgcccaatgggtcatgagtgaacttcccggcagaggggtgcagctctatgacaccccttatgaggaacaggacccagagacagcagatggacccccttctgggcagaagcctcggcagagccggatgccccaggaagatgaacggccagcagatgagtatgatcagccctgggagtggaagaaagaccacatctccagggcgtttgcagtgcagtttgacagtccagagtgggagaggactccaggctcagccaaggagctccggagacctccgcccagaagcccccagcctgcggagcgtgtggacccagccctgcccctggagaaacagccgtggtttcatggccccctgaacagggcggatgcagagagcctcctgtccctctgcaaggaaggcagctacctagtgcggctcagtgagaccaacccccaggactgctccttgtctctcaggagcagccagggcttcctgcatctgaagttcgcgcggacccgtgagaaccaggtggtgctgggccaacacagcgggcccttccccagcgtgcccgagctcgtcctccactacagttcacgcccactgccggtgcagggtgccgagcatctggctctgctgtaccccgtggtcacgcagaccccctgacagtgaccctcggcccccttttgagtcctcgggcccagaatcgtatcccaaagccctcccatggcctagaaaataaataagttattgtttg

SEQ ID NO: 186269 - DNA, 1729 bp, Homo sapiens
  Payload ID: 16680
  Gene Symbol: SHD
  Gene Name: Src homology 2 domain containing transforming protein D
  ENST ID: ENST00000599689
  CDS Start-End: 769-1671
tgggaacaggggcgtcctcctgcgcgcccccctccccagcgtcccacctcccggcggcggcggggaaagtctctccgaaagcgtgaagggggattggaggaggtttttatttccctttgtgcgggtggctggggccggatcgaggcggcgggggccgcgggactgggggctccccgctgagccgagaggagcgcgacaaaggatgcgtcccgccggggtcacagtctccgcggcccaactttgcgcgcggcgcccgcgcccctggggagcccgcccgctgcgctgagaacccaggcgtccgggctgggagaggggccgggagcgtccgcaggtggcgctggcccggatctcccgaccccaggaagggatcccggagcttcctggaggcggcgggcggccgtgtcgctccagggaaccgcgctgcccgcggaaactccgcgcgcctccgcggatgcccctcgccctagcccccagcgcgcggggttcggggccctgcgaggtccccccttcccccgcggtgcttcccaagctgggctaaggcgggcttctcttcctccctcctctgtcgcctccttttcctccccctcgttcaccttttccttccctctatccatccagagccccgccaaagggcgcacctgatctttctcatccttccctgctcttcccttcctctccacctcctcctcctccttggggaaaggggcccggagaagggcatgtgggggcccctctgacagtggcccgattggggtgacaggcgcccaaatggccaagtggctacgggactacctgagctttgggggtcggaggccccctccgcagccgcccaccccggactacaccgagagcgacatcctgagggcctaccgcgcgcagaagaacctggacttcgaggacccctatgaggacgcggagagccgcttggagccggaccccgcgggccctggggactccaagaaccccggagatgccaagtatggttctcccaagcaccggctcatcaaggtggaggctgcggatatggccagagccaaggcccttctgggcggccccggggaggagctggaagccgacactgagtatttagacccctttgatgctcagcctcatcctgcacccccggatgatgggtacatggagccctacgatgcccaatgggtcatgagtgaacttcccggcagaggggtgcagctctatgacaccccttatgaggaacaggacccagagacagcagatggacccccttctgggcagaagcctcggcagagccggatgccccaggaagatgaacggccagcagatgagtatgatcagccctgggagtggaagaaagaccacatctccagggcgtttgcagtgcagtttgacagtccagagtgggagaggactccaggctcagccaaggagctccggagacctccgcccagaagcccccagcctgcggagcgtgtggacccagccctgcccctggagaaacagccgagcagccagggcttcctgcatctgaagttcgcgcggacccgtgagaaccaggtggtgctgggccaacacagcgggcccttccccagcgtgcccgagctcgtcctccactacagttcacgcccactgccggtgcagggtgccgagcatctggctctgctgtaccccgtggtcacgcagaccccctgacagtgaccctcggcccccttttgagtcctcgggcccagaatcgtatcccaaagccctc

SEQ ID NO: 186270 - DNA, 558 bp, Homo sapiens
  Payload ID: 16680
  Gene Symbol: SHD
  Gene Name: Src homology 2 domain containing transforming protein D
  ENST ID: ENST00000593383
  CDS Start-End: 1-117
gacaccccttatgaggaacaggacccagagacagcagatggacccccttctgggcagaagcctcggcagagccggatgccccaggaagatgaacggccagcagatgatgcagtttgacagtccagagtgggagaggactccaggctcagccaaggagctccggagacctccgcccagaagcccccagcctgcggagcgtgtggacccagccctgcccctggagaaacagccgtggtttcatggccccctgaacagggcggatgcagagagcctcctgtccctctgcaaggaaggcagctacctagtgcggctcagtgagaccaacccccaggactgctccttgtctctcaggagcagccagggcttcctgcatctgaagttcgcgcggacccgtgagaaccaggtggtgctgggccaacacagcgggcccttccccagcgtgcccgagctcgtcctccactacagttcacgcccactgccggtgcagggtgccgagcatctggctctgctgtaccccgtggtcacgcagaccccctgacagtgaccctcggccccctt

SEQ ID NO: 186271 - DNA, 1534 bp, Homo sapiens
  Payload ID: 16681
  Gene Symbol: SKAP1
  Gene Name: src kinase associated phosphoprotein 1
  Uniprot ID: Q86WV1
  ENST ID: ENST00000336915
  CDS Start-End: 71-1150
gtcgccttccagcccgtccgcctcccgaccagggcccgcgccccgtcccgcctctctcccgcccagccaaatgcaggccgccgccctccctgaggagatccgttggctcctggaagatgctgaagagtttctggcagaaggtttgcggaatgagaacctcagcgctgttgcaagggatcacagagaccatattctacggggctttcagcaaatcaaagccaggtactattgggattttcagccccaagggggagacattggacaggacagctctgatgataatcacagcgggactcttggcctgtccctcacatccgatgcaccctttttgtcagattatcaggatgagggaatggaagacatcgtaaaaggagctcaagaacttgataacgtaatcaagcaaggatacttggagaagaaaagcaaagatcatagtttctttggatcggagtggcagaagcgatggtgtgttgtcagcagaggtctcttctactactatgctaatgagaagagcaagcagcccaaagggaccttcctcattaagggctacggtgtacggatggccccccacctgcgaagagattccaagaaagaatcctgctttgaactgacctcccaggataggcgcagctatgagtttacagctactagtccagcagaagccagagactgggtggatcaaataagtttcttgttaaaggatctgagctccttaaccattccatatgaagaggatgaggaggaagaagaaaaagaagagacatatgatgatattgatggttttgactccccaagttgtggttcccagtgcagacccactatcttgcctgggagtgtggggataaaagagcctacagaggagaaagaagaagaagatatttatgaagtcttgccagatgaagagcatgatctagaagaggatgagagtggcactcgacgaaaaggagtagactatgccagttactaccagggcctatgggattgccatggtgaccagccagatgaactgtccttccaacggggtgacctcatccgtattctgagcaaggagtataacatgtatggctggtgggtgggagaactgaacagcctcgttgggattgttccaaaggagtatctcaccactgcctttgaagtggaagaaagatgaaacccaggaaatatattcttccctctctcctgcctttatgaggaaactgatcatcaaaagttcccactccctacttctgccaccccaccaacgccttggactcctctctttgctgaagagacccaagtctcttgacacctcagagtgactgtaagctaccagtaagacaagtgggaagaggcacgttcatcaaacctgttactaaaccagcctagtcatagctcatccccatctctaaatgtgtccacacaaccacatctgccttttccacaagcttttcacaaagaaggtgagagagaaggaaaccttgggaggaggacattactggttgttctggctggtttgaaaagcacaaataaacttgggatgtggttccttgccatg

SEQ ID NO: 186272 - DNA, 783 bp, Homo sapiens
  Payload ID: 16681
  Gene Symbol: SKAP1
  Gene Name: src kinase associated phosphoprotein 1
  ENST ID: ENST00000581400
  CDS Start-End: 1-277
gggagacattggacaggacagctctgatgataatcacagcgggactcttggcctgtccctcacatccgatgcaccctttttgtcagattatcaggatgagggaatggaagacatcgtaaaaggagctcaagaacttgataacgtaatcaagcaaggatacttggagaagaaaagcaaagatcatagtttctttggatcggagtggcagaagcgatggtgtgttgtcagcagaggtctcttctactactatgctaatgagaagatttacagctactagtccagcagaagccagagactgggtggatcaaataagtttcttgttaaaggatctgagctccttaaccattccatatgaagaggatgaggaggaagaagaaaaagaagagacatatgatgatattgatggttttgactccccaagttgtggttcccagtgcagacccactatcttgcctgggagtgtggggataaaagagcctacagaggagaaagaagaagaagatatttatgaagtcttgccagatgaagagcatgatctagaagaggatgagagtggcactcgacgaaaaggagtagactatgccagttactaccagggcctatgggattgccatggtgaccagccagatgaactgtccttccaacggggtgacctcatccgtattctgagcaaggagtataacatgtatggctggtgggtgggagaactgaacagcctcgttgggattgttccaaaggagtatctcaccactgcctttgaagtggaagaaagatgaaacccag

SEQ ID NO: 186273 - DNA, 696 bp, Homo sapiens
  Payload ID: 16681
  Gene Symbol: SKAP1
  Gene Name: src kinase associated phosphoprotein 1
  ENST ID: ENST00000581419
  CDS Start-End: 1-117
gggactcttggcctgtccctcacatccgatgcaccctttttgtcagattatcaggatgaggtagagacggggtttcaccgtgttagccaggatggtctcgatctcctgacctcgtgatccgcccgcctcggcctcccaaagtgctgggattactggcttgagccaccgcgccggcctaattaaatgttcttatctaaacttggggaatggaagacatcgtaaaaggagctcaagaacttgataacgtaatcaagcaaggatacttggagaagaaaagcaaagatcatagtttctttggatcggagtggcagaagcgatggtgtgttgtcagcagaggtctcttctactactatgctaatgagaagagcaagcagcccaaagggaccttcctcattaagggctacggtgtacggatggccccccacctgcgaagagattccaagaaagaatcctgctttgaactgacctcccaggataggcgcagctatgagtttacagctactagtccagcagaagccagagactgggtggatcaaataagtttcttgttaaaggatctgagctccttaaccattccatatgaagaggatgaggaggaagaagaaaaagaagagacatatgatgatattgatggttttgactccccaagttgtggttcccagtgcagacccactatcttgcctgggagtgtgggga

SEQ ID NO: 186274 - DNA, 1687 bp, Homo sapiens
  Payload ID: 16681
  Gene Symbol: SKAP1
  Gene Name: src kinase associated phosphoprotein 1
  ENST ID: ENST00000584709
  CDS Start-End: 156-467
cccggggacccacggccccgccccgcggccgggctgggcgggcggcgaccgcggctgaggtacaggtgcctcgcggtgcagccgggtcgccttccagcccgtccgcctcccgaccagggcccgcgccccgtcccgcctctctcccgcccagccaaatgcaggccgccgccctccctgaggagatccgttggctcctggaagatgctgaagagtttctggcagaaggtttgcggaatgagaacctcagcgctgttgcaagggatcacagagaccatattctacggggctttcagcaaatcaaagccaggtactattgggattttcagccccaagggggagacattggacaggacagctctgatgataatcacagcgggactcttggcctgtccctcacatccgatgcaccctttttgtcagattatcaggatgagggtattttgagaagaatgaataggagagtatagagaaaataggaattatagaagataaagccaacttatccatcagtgaatggaagacatcgtaaaaggagctcaagaacttgataacgtaatcaagcaaggatacttggagaagaaaagcaaagatcatagtttctttggatcggagtggcagaagcgatggtgtgttgtcagcagaggtctcttctactactatgctaatgagaagagcaagcagcccaaagggaccttcctcattaagggctacggtgtacggatggccccccacctgcgaagagattccaagaaagaatcctgctttgaactgacctcccaggataggcgcagctatgagtttacagctactagtccagcagaagccagagactgggtggatcaaataagtttcttgttaaaggatctgagctccttaaccattccatatgaagaggatgaggaggaagaagaaaaagaagagacatatgatgatattgatggttttgactccccaagttgtggttcccagtgcagacccactatcttgcctgggagtgtggggataaaagagcctacagaggagaaagaagaagaagatatttatgaagtcttgccagatgaagagcatgatctagaagaggatgagagtggcactcgacgaaaaggagactatgccagttactaccagggcctatgggattgccatggtgaccagccagatgaactgtccttccaacggggtgacctcatccgtattctgagcaaggagtataacatgtatggctggtgggtgggagaactgaacagcctcgttgggattgttccaaaggagtatctcaccactgcctttgaagtggaagaaagatgaaacccaggaaatatattcttccctctctcctgcctttatgaggaaactgatcatcaaaagttcccactccctacttctgccaccccaccaacgccttggactcctctctttgctgaagagacccaagtctcttgacacctcagagtgactgtaagctaccagtaagacaagtgggaagaggcacgttcatcaaacctgttactaaaccagcctagtcatagctcatccccatctctaaatgtgtccacacaaccacatctgccttttccacaagcttttcacaaagaaggtgagagagaaggaaaccttgggaggaggacattactggttgttctggctggtttgaaaagcacaaataaacttgggatgtggttccttg

SEQ ID NO: 186275 - DNA, 678 bp, Homo sapiens
  Payload ID: 16681
  Gene Symbol: SKAP1
  Gene Name: src kinase associated phosphoprotein 1
  ENST ID: ENST00000579336
  CDS Start-End: 380-678
gagcctcacatttacagccacactctctctgctgtaataattccttctttctgttgttatagatctcttaacattctaataaattctctgtctctgttgtactcttttggcaaaataacctttcacgttgcatttccctagcttggcagtgatatctgccttactgtcgcagtagcctcttcttaagcttctctaataacctttccttgactattgtggttcctcagggatgtaacagctgtttctgtgcttttattttacataccagagaggatgccttcccttggcagttgcatctctctagggatacagggagctttcctgtcttgcaggcaagcagcccaaagggaccttcctcattaagggctacggtgtacggatggccccccacctgcgaagagattccaagaaagaatcctgctttgaactgacctcccaggataggcgcagctatgagtttacagctactagtccagcagaagccagagactgggtggatcaaataagtttcttgttaaaggatctgagctccttaaccattccatatgaagaggatgaggaggaagaagaaaaagaagagacatatgatgatattgatggttttgactccccaagttgtggttcccagtgcagacccactatcttgcctgggagtgtggggataaaagagcctacaga

SEQ ID NO: 186276 - DNA, 1477 bp, Homo sapiens
  Payload ID: 16681
  Gene Symbol: SKAP1
  Gene Name: src kinase associated phosphoprotein 1
  Uniprot ID: Q86WV1
  ENST ID: ENST00000584924
  CDS Start-End: 100-1179
gaggtacaggtgcctcgcggtgcagccgggtcgccttccagcccgtccgcctcccgaccagggcccgcgccccgtcccgcctctctcccgcccagccaaatgcaggccgccgccctccctgaggagatccgttggctcctggaagatgctgaagagtttctggcagaaggtttgcggaatgagaacctcagcgctgttgcaagggatcacagagaccatattctacggggctttcagcaaatcaaagccaggtactattgggattttcagccccaagggggagacattggacaggacagctctgatgataatcacagcgggactcttggcctgtccctcacatccgatgcaccctttttgtcagattatcaggatgagggaatggaagacatcgtaaaaggagctcaagaacttgataacgtaatcaagcaaggatacttggagaagaaaagcaaagatcatagtttctttggatcggagtggcagaagcgatggtgtgttgtcagcagaggtctcttctactactatgctaatgagaagagcaagcagcccaaagggaccttcctcattaagggctacggtgtacggatggccccccacctgcgaagagattccaagaaagaatcctgctttgaactgacctcccaggataggcgcagctatgagtttacagctactagtccagcagaagccagagactgggtggatcaaataagtttcttgttaaaggatctgagctccttaaccattccatatgaagaggatgaggaggaagaagaaaaagaagagacatatgatgatattgatggttttgactccccaagttgtggttcccagtgcagacccactatcttgcctgggagtgtggggataaaagagcctacagaggagaaagaagaagaagatatttatgaagtcttgccagatgaagagcatgatctagaagaggatgagagtggcactcgacgaaaaggagtagactatgccagttactaccagggcctatgggattgccatggtgaccagccagatgaactgtccttccaacggggtgacctcatccgtattctgagcaaggagtataacatgtatggctggtgggtgggagaactgaacagcctcgttgggattgttccaaaggagtatctcaccactgcctttgaagtggaagaaagatgaaacccaggtatcagaaccatggccaatgaactgcctaatagttgagtggaacttgtgggccactactttgtttctctgaaagatgagagttgccagtgaagtagcttttcttcatttctcatactaatgctagtgattcaccactgatggaaagaaaatgcctctggaattgtttttttcttaaatttggggacagtgtcacttaggataaggttcaactaatagcaacataaaatctaaactaaaaatgacttaattaacacagaaagccaggcacagtggctcacacctgtaatcc

SEQ ID NO: 186277 - DNA, 563 bp, Homo sapiens
  Payload ID: 16681
  Gene Symbol: SKAP1
  Gene Name: src kinase associated phosphoprotein 1
  ENST ID: ENST00000583844
  CDS Start-End: 1-99
tataacatgtatggctggtgggtgggagaactgaacagcctcgttgggattgttccaaaggagtatctcaccactgcctttgaagtggaagaaagatgaaacccaggttacctcaaggccaagacagatgctcaatctccagccatcctgtctgcaacctacacagcacagcaggaaagataaaaggagaaggaaatatattcttccctctctcctgcctttatgaggaaactgatcatcaaaagttcccactccctacttctgccaccccaccaacgccttggactcctctctttgctgaagagacccaagtctcttgacacctcagagtgactgtaagctaccagtaagacaagtgggaagaggcacgttcatcaaacctgttactaaaccagcctagtcatagctcatccccatctctaaatgtgtccacacaaccacatctgccttttccacaagcttttcacaaagaaggtgagagagaaggaaaccttgggaggaggacattactggttgttctggctggtttgaaaagcacaaataaacttgggatgtggttcctt

SEQ ID NO: 186278 - DNA, 3998 bp, Homo sapiens
  Payload ID: 16682
  Gene Symbol: SKAP2
  Gene Name: src kinase associated phosphoprotein 2
  Uniprot ID: O75563
  ENST ID: ENST00000345317
  CDS Start-End: 315-1394
aggctctttcttctggggccgggaaaaccgaggaatacacatgcgcagttggacccctcaggcccttcgtgtcccttcccacccatctccccgccccggccctctgggcggggctgggccgacagtccagctgcagctcgctggagattcagtgacttccttgttgtgagccccggcccggcagtgtcccgactcgtagccccgctgttcttaatccgggccgctagcctgagtctaggtcgcagccgcagccccaccccgtcggtcaccttttcagcgcaggtcctttccccgcacgccctgcgctccctaacatgcccaaccccagcagcacctcctctccctaccccctccctgaggaaattaggaacctgttggcagatgttgaaacatttgtagcagatatactgaaaggagaaaatttatccaagaaagcaaaggaaaagagagaatcccttattaagaagataaaagatgtaaagtctatctatcttcaggaatttcaagacaaaggtgatgcagaagatggggaagaatatgatgacccttttgctgggcctccagacactatttcattagcctcagaacgatatgataaagacgatgaagccccctctgatggagcccagtttcctccaattgcagcacaagaccttccttttgttctaaaggctggctaccttgaaaaacgcagaaaagatcacagctttctgggatttgaatggcagaaacggtggtgtgctctcagtaaaacggtattctattattatggaagtgataaagacaaacaacagaaaggtgaatttgcaatagatggctacagtgtcagaatgaataacactctaagaaaggatggaaagaaagattgctgttttgaaatctctgctcctgataaacgtatatatcagtttacagcagcttctcccaaagatgctgaagaatgggtacagcagctgaaatttgtattgcaagatatggaatctgatattattcctgaggattatgatgagagaggagaattatatgatgatgttgatcatcctctaccaataagcaatccactaacaagcagtcaaccaatagatgatgaaatttatgaagaacttccagaagaagaagaggacagtgctccagtgaaagtggaagaacaaaggaagatgagtcaggatagtgtccatcacacctcaggggataagagcactgattatgctaatttttaccagggattgtgggattgtactggagctttttctgatgagttgtcatttaagcgtggtgatgtgatttacattcttagcaaggaatacaatagatatggctggtgggtaggagaaatgaagggagccattggcttggtgcctaaagcctacataatggagatgtatgatatttgagagtcctggaaaaggaaaattcttctgcttgtctgcaaatgctttggatttagaagcgtcatgaaagcacgagtgacagctcctaacctctccttgttttattaaacattacttatctttgactgttattttatgcagtcgctcattaaaatattcctctgatgtgaaattaaatgaaggatattaatgtaaattagatgcaaccagttaagttatacctgttgctattttgcaaagaaataattatagtttttatttacccatttgatttgtgtgaagaattcatcactattttatacgtaacatatagtctactatagcatagtatgctactattgctacttctggtgtgatttgtaatgtttcttaatcattggacatcaattatttttagagagtaatgtataatttcatagcattttaaatttagtgtatcatgcgagttttttttggtagatgctgaagaatgtggttgctaaacaaagaatgctaaagaatgttcaaactttatagataactttattgttattatttattttcacacatttaattcctattaagtacagccgcaagaaagaaaaaatgatgaagttgcaaatggcagtgtgctgtcacctgcaacagaagtgcgtaccagaagtatgactcatgcaaagcattttaccgtacaaatatcctggtgcgatgatgggcctggcaacattttctactgtacttttgtttaaatttaatgaaacaaaaaattcctaagaaataccaccctaccactaacaaaatggtataaagaatctcccagccaggccaacatggtgaaaccctgtctctactaaaaattagccaagtgtggtaatgttcacctgcagtcccagctacttgggaggccaaggcacgagaattgcttgaacaaggtaggcagaggttgcagtgagccaagatcgcgccactgcactccagcctgggcgacagagtgagactccatctcagaaaaaaaaaaaaaaaaaaacagaatctcagtgtattctcaaagtaaaaaggcataaccaagcactctcttatcttgccttattgctatactatttacatcccactgcagaacagcagatttgaggcttttctatatacttctcagagcactgaaaagaaaggaagggtttgcagaggagagtgtagaaatcccagtggtagcatgtaccaacaggtgagtagaaaggtagtgttagcctgacatttgagttatactctgtgctgcctgagcaagatttgtagaatcatataattaccttttcatgtatatttgaaatcagaggtgtttaaaatacctatgagataccaatgtagccttaacatatgtcaaaatgcattgctggttagataattatttggactacacataaactcctaatattgaatcattacctatcaggtattatctttatggaacttttcaatatctttgctttataaagattctaaacatgtatctgagctggtaatattttaaaatctccattatttgtgtaaaactgtttataagcagtgtttgagagggtctgctttaccattaccccctcaatatcatgatcatccaatctcaaatgtgaaaaaaaaaaagaaatttgattttagggattgtgagtaaacaagtttatatagagagacattgtgaagttaaagttttcagaagttacatttgtgcagttcttaccttttcctcatatagtgccattgaaatagactgaaattatcttggcaaaagttagacaaccaaagacgactttagtggactggttttcaaaacttgagcagctgaaaagcaaaagccgttgtttcccatgacaatgtagcctttgtggatttgggtttgtgctttgggttgaaaagaagtttttagtcctaggccagtagatggcagcagcttttcattgcagacaaaacctcttgaaacccttcccccatggcacaaactcgcccatgatggaaagcatctagatttctgcctccttttacagttaatccaggagagggagtcctttgccaactgatgaccaacagttccaagccagatagtctcgtgaacagtgacaatacagaaataaggtgttatttctgttcagatctccaccggcctttgttcttttaaaacttgaatataggtgggagacataagaaaggaaagaaaagacttaaaactggagtgacaggacaaataatcattactttcaattcatgactgctttatattcatttgatgaaatcatttgtatacaaaccagggagagttttctttacacccttgacaatatatcacatactcttcaagatcataataatatcattaatataaatttaaacaacatggcttgttagaaaatatgctaattgctatggtctcattatgtttgcttagcttttatttgtttttctgtgaacagttagagagctaatttttttcaaaggtgattgtaagtcatattttatatagcattttgcttgattatttgctctgtactgaatttgtactctattgccattagatcttacaataatgttccactctgcaaatttttaaggttcaaataaagtttaattgtttgcaaactgtta

SEQ ID NO: 186279 - DNA, 577 bp, Homo sapiens
  Payload ID: 16682
  Gene Symbol: SKAP2
  Gene Name: src kinase associated phosphoprotein 2
  ENST ID: ENST00000432747
  CDS Start-End: 199-577
aatttttctctgcttgttggacatgaagagagggagacaaaggctctcagaaagagaaagacgggctggtgaaggacaaactaaggaatttgattattcacttttccaagataaagtggcatggagtggggaaagaccattaaggaatgctgaacataaaggaatcctggggacctgaccctcagttaagacataagaatgacaaccaggagtgtgctcgatgttgaaacatttgtagcagatatactgaaaggagaaaatttatccaagaaagcaaaggaaaagagagaatcccttattaagaagataaaagatgtaaagtctatctatcttcaggaatttcaagacaaaggtgatgcagaagatggggaagaatatgatgacccttttgctgggcctccagacactatttcattagcctcagaacgatatgataaagacgatgaagccccctctgatggagcccagtttcctccaattgcagcacaagaccttccttttgttctaaaggctggctaccttgaaaaacgcagaaaagatcacagctttctgggatttgaatggcagaaacggtggt

SEQ ID NO: 186280 - DNA, 1150 bp, Homo sapiens
  Payload ID: 16683
  Gene Symbol: SRCIN1
  Gene Name: SRC kinase signaling inhibitor 1
  ENST ID: ENST00000613927
  CDS Start-End: 1-919
gtccgaggagctggaggtgcagaagccccaggtgaagctgcgccgggctgtgtctgaggtggcccgcccagcctccacaccacccatcatggcctcggccatcaaggacgaggatgacgaggatcgcatcatcgcagagctagaggtgtttgagagaagctcagtgtcttccctcccccccacgccccgccgccagctgatccccaccttgctgtccccccaggacctggggccccccgggggctcagccccaggccctacacggaaggctgccccaggtcccagggccttctgcgtcccaaggatcatcttgacagagtgtgcccccaaccctccctccccgccagaggccagacttgaggaactgggacccaggacagctcccaccccaagacctcagaccctggctgacagcacgaggggctgggatggcccacagtccccaccaggggtagtgggggagacttctgggccgaggagcagcttcatgccccggaaggagggggcagctctgaagagactgggtggaggaggcagcagcctagaggatggaggagccagagtacagtgtcctcagggaccagcccaggatgggactccagagacctctactgctgacacctacccagaggagatcctcaaggactctggacatgatgcccaaacctgcagtagggagcatcagggccaggctgctgccaactcaggccgcaccacgtggggcgccactgcccagcagatggacagcttggaggagacgctccgggagctggaagccaccctgagcaacatgggcacaggccctgccatggggtcccctggcagccccccacccctacccctccgcccccaggtggctgcccgcttttcatcctcctctgctgccttcctcctccatttccagagtcagacagagtagggggcagcagaaatgccaggccagccccctcctcccaccggccttctctcagctcttaccactctcctgggagcctggtgccagagcagggtttgcaggcagagtccgggggaggctgggaagccggcctacccaggggccggccaatccccagccttggcaagaaccagggcctcccccttctgctctgtatctgtaaaccaacaaataaagttctctccccaccttcca

SEQ ID NO: 186281 - DNA, 1431 bp, Homo sapiens
  Payload ID: 16683
  Gene Symbol: SRCIN1
  Gene Name: SRC kinase signaling inhibitor 1
  ENST ID: ENST00000612431
  CDS Start-End: 11-1431
acgcgtccccatgcagccctggcagtgcctccggcgctttgccctggcctggtgggagaggacggcggagggcagagcccgctctcccagggaggaggctggaccgagggaccctgggggccgaggggagccagatccggagcggagcagcccccccatgctgtctgcggacgatgcggagtacccgcgggagtaccggaccctggggggcgggggcggcgggggcagcgggggccggcgcttctccaacgtggggctggtgcacacgtccgagcggcggcacacggtgatcgcggcccagagtctggaggcgctcagcgggctccagaaggcggacgccgaccgcaagcgtgatgccttcatggaccacctgaagagcaagtacccacagcacgccctggccctgcgaggccagcaggacaggatgcgagagcaggttggcggctggaccgtggaccccgtatgcctcctcagctccctctgctcccacctccatggcgactccgccccctccggggctggccagccggcccagacccgcagctcacgccacactcagggagcccagcccgggctggcagaccaggcggcaaagctgtcctacgcctccgccgagtcgctggagaccatgtcggaggccgagctgcccctgggcttcagcaggatgaaccgcttccgacagagcctgcctctctcccgctcggccagccagaccaagctgcgctccccaggggtgctgttcctgcagttcggggaggagactcggcgcgtgcacatcacgcacgaggtcagcagcctggacacgctgcacgcactcatcgcgcacatgttcccgcagaagctcaccatgggcatgcttaagtcgcccaataccgccatcctcatcaaagacgaggctcgcaacgtcttctacgagctggaggacgtccgggacatccaggaccgcagtattatcaagatctacagaaaggagcccctctacgctgccttccctggctcacatctcaccaacggggacctccggagagagatggtgtacgcatcgcgggagtcctcgcccacgcggcgcctcaacaacctgtcaccagcgccgcacctggcatccggctcgccgccgcccgggctgccgtcggggctgccgtccgggctgcagtccggttcgccgtcgcgttcgcgcctatcgtacgccggggggcgcccgccttcgtacgccggcagcccggtgcaccacgcggccgagaggctgggaggcgccccggccgcccagggcgtcagccccagccccagcgccatcctggagcggcgcgacgtgaagccggacgaggacctggcgagcaaggcgggcggcatggtgctggtgaaaggcgagggcctctatgctgacccctacgggctgctgcacgagggccgtctgagcctggccgcggccgc

SEQ ID NO: 186282 - DNA, 4635 bp, Homo sapiens
  Payload ID: 16683
  Gene Symbol: SRCIN1
  Gene Name: SRC kinase signaling inhibitor 1
  ENST ID: ENST00000622190
  CDS Start-End: 1-2785
gttcccgcagaagctcaccatgggcatgcttaagtcgcccaataccgccatcctcatcaaagacgaggctcgcaacgtcttctacgagctggaggacgtccgggacatccaggaccgcagtattatcaagatctacagaaaggagcccctctacgctgccttccctggctcacatctcaccaacggggacctccggagagagatggtgtacgcatcgcgggagtcctcgcccacgcggcgcctcaacaacctgtcaccagcgccgcacctggcatccggctcgccgccgcccgggctgccgtcggggctgccgtccgggctgcagtccggttcgccgtcgcgttcgcgcctatcgtacgccggggggcgcccgccttcgtacgccggcagcccggtgcaccacgcggccgagaggctgggaggcgccccggccgcccagggcgtcagccccagccccagcgccatcctggagcggcgcgacgtgaagccggacgaggacctggcgagcaaggcgggcggcatggtgctggtgaaaggcgagggcctctatgctgacccctacgggctgctgcacgagggccgtctgagcctggccgcggccgccggcgacccgttcgcctacccgggcgccggcggcctctacaagcgcggctcggtgcgctcgctcagcacctactcggccgccgcgctgcagtccgatctggaggactccctgtacaaggcggcgggcggcggcggcccgctgtacggcgacggctacggcttccgcctgccgccttcgtcaccgcagaagctggccgacgtggcagcaccccccggaggtcccccgccaccgcacagcccctactcggggccgcccagccgcggctcgccagtgcgccagtccttccgcaaggactcgggctcctcgtccgtctttgccgagagtcctggagggaagacccgcagcgcggggagcgcctcgacggccggagctcccccttcggagctcttccctgggcctggggaacgctcgctggttgggttcgggccgccagtgccagccaaggacacggagaccagggagcgcatggaggccatggagaagcagattgccagcctcacaggcctggtgcagagcgccttactgcgaggctctgagcctgagacccccagcgagaagattgaaggctccaatggagcagccaccccctcagcaccctgtgggtcaggcggccggagcagcggggccaccccggtgtccggcccgcccccgccctcggccagcagcacccccgcaggtcagcctaccgccgttagccggctgcagatgcagcttcacctgcgaggcctgcagaacagcgccagtgacttgcgcggccagctccagcagttgcgcaagctccagctacagaaccaggagtcggtgcgcgcgctgctgaagcgcacggaggcagagctgagcatgcgcgtgtcggaggcggcgcggcggcaggaggacccgctgcagcggcagcgcaccctggtggaagaggaacggctgcgctatctcaacgacgaggagcttattacccagcagctcaatgacctggagaaatcggtggagaagatccagagagacgtgtcccacaaccaccggctggtgcccggccctgagctggaggagaaggcactggtgctgaagcagctcggggagacgctgacagagctcaaggctcacttcccgggcctgcagagcaagatgcgggtggtgctgcgcgtggaggtggaggcggtgaagttcctgaaggaggagccccagcgcctggatgggctcctcaagcgctgccgcggggtcacggacacgctggcccagatccgaaggcaagtggatgagggtgtgtggccaccccccaacaatctcctgagtcagtcccccaagaaggtgacggcagagactgacttcaacaagagcgtggacttcgaaatgccaccccccagccccccgctgaacctgcatgagctgagcgggccagctgaaggagcctctcttacccccaaggggggcaaccccaccaaaggcctggacactcctggcaagagaagcgtggacaaagctgtgtctgttgaggctgcagagcgagactgggaggagaagcgggcagccctgacccagtacagtgccaaggacatcaaccggctgctggaagagacacaggcagagctgctcaaggccatccctgacctggactgtgccagcaaggcccatccaggcccggcccccactccagatcacaagccccccaaggccccccacggccagaaggcagccccccgaacggagcccagtgggaggaggggctcagatgagttgaccgtgccccgataccgcacagagaagccctccaagtcgcccccaccgccccctccccgccggagcttcccctcctcccatggcctgaccaccacacgtaccggagaggtggtggtcaccagcaagaaggactcggccttcatcaagaaggctgagtccgaggagctggaggtgcagaagccccaggtgaagctgcgccgggctgtgtctgaggtggcccgcccagcctccacaccacccatcatggcctcggccatcaaggacgaggatgacgaggatcgcatcatcgcagagctagagagtggcggaggcagtgtaccacccatgaaggtggtgactccgggggcctctcggctgaaggcggcccagggccaggcgggcagccccgacaaaagcaaacatggcaagcagagggccgagtacatgcggatccaggcccagcagcaggtctaatgagcaggcgcggaggctgtgtggagagtggacatacctcacctgtgggtgtttactgcccttgtggcctggtcagaggctgcagggtggctcctggacccagatgttgtgagagacccttagtgcactcgtttgatttagttaatatttatgagcagctcctgtatgacaggcccattctgggtgtgagggtgggggctgtgatatgtccagatgctctcacttaaagaaggttctagactcagaggcaagacgttagagaaggttctagactcagaggcaagaggttagagatgggtgagtccatctctttttcagatgagggggcagctcagaggaggagaggggcttcccaaaggtgcacagcaaggtggcatcacagccaggatcgggacctaggaatcttggaacccttccctgcactggccctgggacagccctgggcacccaaggccctgcctccctactggctcccaggagaatttctcaaaaagcagccctccagccccccgcagcctctccacagctcccacctgcctcctcatggcccccagacaccctgcgagccccacctccagatctttttcctgccactgccagggatgagttccccttgtcctgtccgggctggaccctcctgggtgcccagcagagcagctgacactgacagagctttcgctggggccaggcatgcgcattatctcatctcacactcaccacactgaggaaggtctattacccccatgtgacgggggcggaaactgaggcttaatccaaggccacacggctagcaagtggggggcaggacacaagtccagactgcctccctccccaccacaaagtgcttcagcctctccagcagccccttccctcagctctaatgatgttgcactgtttcccaccctagtccctccctccccagagcccagctcctccgctgtggtgtcagcctcatgcctttatggcccagcctccaccccatctccggggttgcctgggtctccagtgacatcgagatgggctcttttcacccccctcccccactgctctgcagcatgtggccttgtagaccccccccacacctgcatagggctgtgcagaccctctgttcctcagcatcctctccccagcctccacctggagcctctgggctcctttctgggtgactccctctattttttgagacggagtcttgctctgtctcccaggctggagtccagtggtgtgatctcagctcactgcagcctccgcctcctgggttcaagtgattctcgtgcctcagcctcccgagcagctgagactacaggctaattaccacactggctaatttttgtatttttagtagagacggggtttcaccatgttggccaggctggtctcaaactcctgagctcaggtgatcctcccacctcagcctcccaaagtgctgggattacaggcgtgagccattgcaccctgcctgggcgactctcctttgcctgcctcttcccttcctgtgccccactcctcagcctcttctcctcacaccatgccttcctctcctcaggcaccaggtgcactgcttagtccctgcccccacccaggtctccattctgagctccagtcacccacacacgcttccccgggcatccccaggctcctcgaatgcgtgtgtccagacataatgctcccccgaccacgctgccccagccggtacgaggctgccccagctgctgtctccctcaggaagggtcgcccacccccagccttcccaagcccctccgtgcccctgtctcacttccagtgctccagtagcctttcttataaacatggcttctttcttgtaaagtaataaatgtttacagtggaaa

SEQ ID NO: 186283 - DNA, 7058 bp, Homo sapiens
  Payload ID: 16683
  Gene Symbol: SRCIN1
  Gene Name: SRC kinase signaling inhibitor 1
  Uniprot ID: Q9C0H9
  ENST ID: ENST00000615049
  CDS Start-End: 226-3777
acactcgctctcgcacactcggtgacacgcccgcgcgcgcgctcacccacacgcccggccgccggcgccctcccagctggtccaccccggcggggcccgcgcccccggcccgcccgcctggcaccgcgccccggggctggggccgagcgaggagcccgcgaggcggcgagagggcgagcgccaggcaggccggcccggggcccccgccccccgcgcccccgcccgatggggaacgctccgtcccaagatccggagcggagcagcccccccatgctgtctgcggacgatgcggagtacccgcgggagtaccggaccctggggggcgggggcggcgggggcagcgggggccggcgcttctccaacgtggggctggtgcacacgtccgagcggcggcacacggtgatcgcggcccagagtctggaggcgctcagcgggctccagaaggcggacgccgaccgcaagcgtgatgccttcatggaccacctgaagagcaagtacccacagcacgccctggccctgcgaggccagcaggacaggatgcgagagcagccaaactactggagtttcaagacccgcagctcacgccacactcagggagcccagcccgggctggcagaccaggcggcaaagctgtcctacgcctccgccgagtcgctggagaccatgtcggaggccgagctgcccctgggcttcagcaggatgaaccgcttccgacagagcctgcctctctcccgctcggccagccagaccaagctgcgctccccaggggtgctgttcctgcagttcggggaggagactcggcgcgtgcacatcacgcacgaggtcagcagcctggacacgctgcacgcactcatcgcgcacatgttcccgcagaagctcaccatgggcatgcttaagtcgcccaataccgccatcctcatcaaagacgaggctcgcaacgtcttctacgagctggaggacgtccgggacatccaggaccgcagtattatcaagatctacagaaaggagcccctctacgctgccttccctggctcacatctcaccaacggggacctccggagagagatggtgtacgcatcgcgggagtcctcgcccacgcggcgcctcaacaacctgtcaccagcgccgcacctggcatccggctcgccgccgcccgggctgccgtcggggctgccgtccgggctgcagtccggttcgccgtcgcgttcgcgcctatcgtacgccggggggcgcccgccttcgtacgccggcagcccggtgcaccacgcggccgagaggctgggaggcgccccggccgcccagggcgtcagccccagccccagcgccatcctggagcggcgcgacgtgaagccggacgaggacctggcgagcaaggcgggcggcatggtgctggtgaaaggcgagggcctctatgctgacccctacgggctgctgcacgagggccgtctgagcctggccgcggccgccggcgacccgttcgcctacccgggcgccggcggcctctacaagcgcggctcggtgcgctcgctcagcacctactcggccgccgcgctgcagtccgatctggaggactccctgtacaaggcggcgggcggcggcggcccgctgtacggcgacggctacggcttccgcctgccgccttcgtcaccgcagaagctggccgacgtggcagcaccccccggaggtcccccgccaccgcacagcccctactcggggccgcccagccgcggctcgccagtgcgccagtccttccgcaaggactcgggctcctcgtccgtctttgccgagagtcctggagggaagacccgcagcgcggggagcgcctcgacggccggagctcccccttcggagctcttccctgggcctggggaacgctcgctggttgggttcgggccgccagtgccagccaaggacacggagaccagggagcgcatggaggccatggagaagcagattgccagcctcacaggcctggtgcagagcgccttactgcgaggctctgagcctgagacccccagcgagaagattgaaggctccaatggagcagccaccccctcagcaccctgtgggtcaggcggccggagcagcggggccaccccggtgtccggcccgcccccgccctcggccagcagcacccccgcaggtcagcctaccgccgttagccggctgcagatgcagcttcacctgcgaggcctgcagaacagcgccagtgacttgcgcggccagctccagcagttgcgcaagctccagctacagaaccaggagtcggtgcgcgcgctgctgaagcgcacggaggcagagctgagcatgcgcgtgtcggaggcggcgcggcggcaggaggacccgctgcagcggcagcgcaccctggtggaagaggaacggctgcgctatctcaacgacgaggagcttattacccagcagctcaatgacctggagaaatcggtggagaagatccagagagacgtgtcccacaaccaccggctggtgcccggccctgagctggaggagaaggcactggtgctgaagcagctcggggagacgctgacagagctcaaggctcacttcccgggcctgcagagcaagatgcgggtggtgctgcgcgtggaggtggaggcggtgaagttcctgaaggaggagccccagcgcctggatgggctcctcaagcgctgccgcggggtcacggacacgctggcccagatccgaaggcaagtggatgagggtgtgtggccaccccccaacaatctcctgagtcagtcccccaagaaggtgacggcagagactgacttcaacaagagcgtggacttcgaaatgccaccccccagccccccgctgaacctgcatgagctgagcgggccagctgaaggagcctctcttacccccaaggggggcaaccccaccaaaggcctggacactcctggcaagagaagcgtggacaaagctgtgtctgttgaggctgcagagcgagactgggaggagaagcgggcagccctgacccagtacagtgccaaggacatcaaccggctgctggaagagacacaggcagagctgctcaaggccatccctgacctggactgtgccagcaaggcccatccaggcccggcccccactccagatcacaagccccccaaggccccccacggccagaaggcagccccccgaacggagcccagtgggaggaggggctcagatgagttgaccgtgccccgataccgcacagagaagccctccaagtcgcccccaccgccccctccccgccggagcttcccctcctcccatggcctgaccaccacacgtaccggagaggtggtggtcaccagcaagaaggactcggccttcatcaagaaggctgagtccgaggagctggaggtgcagaagccccaggtgaagctgcgccgggctgtgtctgaggtggcccgcccagcctccacaccacccatcatggcctcggccatcaaggacgaggatgacgaggatcgcatcatcgcagagctagagagtggcggaggcagtgtaccacccatgaaggtggtgactccgggggcctctcggctgaaggcggcccagggccaggcgggcagccccgacaaaagcaaacatggcaagcagagggccgagtacatgcggatccaggcccagcagcaggccactaaaccatctaaagagatgagcgggtcgaatgagacctcgagcccagtctcagaaaagccctcggcttccagaacctctatccctgtattgacttcctttggggcaaggaattcttccatctccttctagaagcccctcaccccgctgccccgcctgtccccctccctcactcctgccatttctcccctctcttccttcatctccaccccaccccaccctactctccagacgccctgaggggtgtgccctgaagaggagggtgcggccctcctcagcgacccctacccatcatctgttggtgtttttggttttgtttttttttttttttttaacaattaacttttaattatctttttttaaacagtaaaactaaaaaccaaacacaccaccttccttgatcccagctggcctctcgctggccgcacctgtcacatctctccttcttctctttcaccactctttcccccagtccatcctgaagctcctgcacccccttcccgccttcccctcacttcccaagaatactccaaacaaactctgaaccacggagacttggagcagtgggagacccctctcccgtttctcgataccttcctggaggaacgcggggacatcggaccaacccatacatcaagccagagagcggggcttagggagactggccttggagatgccccactccctgtctaagctccgacaagactgtgacttcctctgtggctgctctgcctcctcccactcacacccaagtgggcctggagtagagacggacaggctggagacgaggccggagtttgagaggcctcagggtgggtgtgaggccatggagtctgtatccctggggaggcgctggcctcctgggccttgccgtccagtggggagtggagggcagaggccctttggtctgctggctgtggagggtgggttgcacggacagccggatatcggggacactgccttgggagagggcggcccggacgggtatttggtacttttagtttcctgatttagcactttaaatggcattaacttattgaatggggatggggtgggcaagagtgaggggcctagaaaaccaggttttgtggcttgcagttgggggaagggtctggtttgagggaaatgggagggtcgagaggggcttgacggggagcactgaagacacctgggacccgcaggtggggtgacttgaacttcagtcatcctcttggcaatttgagggttttcccaggaaaggatgagacgtagtttttcaatggggctctggtgaccctggtgagatgtctgaaggtccctgaggcctgaccatccagccagcgcccctggcctgtggacgccctgcctgccctgcagaggcggttggcagtgccgcctggcttttggccgggtcctggggaggcagagagaggccaattttggttctcactcctggccccccagagggcacagtgaggagccggtagggagaggataggagaagaggaggaggaggagcggggtccccggccgcaggattcccacttggagcacaaagtgaagtaagcacaggggagggggactagaatcagtcccccatagcaagcacagaaaggaggagctgcgcagaaggcagagccccccagaccctggggcctggctggggaaggtccgcacctggggagagctgggagctgttgaaggtttggggggaggggaaacgggttgtgtttcttcatttctttttttgtttttgcctttgttggttcatccttgttttctagctttggatcatttttgtaccaaggcgagcaagcctttttgaaaaataacaaaagaggaaaaaaaaaatccctcctggaaaaaaaaaaaaaccctggaaaatagaaaaaaaaaaaaggacctcataaatgatgcaattacttttaattgcaggcaactctttacatttaagtgaagtgtcttaacattttatattgttttaaaaatatatttacatattatatatataatatacgtaatataaatatatataaatatttaaaaaagaaaaaaaaaagaaaaccacggcactctccctggccactgttttggcgggggaggggggctggggggcgggcacgtcggcctggcttctgtggtcccagtgaaatggtctggtttgatttggctgtacagagaccccctgacttgggaggggaggggggagtggtgccccctcctccctccactccattactctctgcttgctacttcgcttgcccccagctcccaccctcagccctgtgactggaatgtgtgccccaccgtcattgtcctgagttgaatgtccctttgtgggggaggtggggggggcagtgtccatccacgaaggggcagaaggagggagccacgtgccccgccccacccgctcgggtgaagcccagtgggatttgcatctttctttctctttggttcctgcacatttatgggctgggaggcatccgtgtggaattgcgtgcagcctgtgtgtgtgctggcacaagcccatgcactgtgtgtgcagacgcatggggcctgcacccacaggcatggccgagcacatgtgtgggggaaggcgtgggcacataggtgcatgtaacctgtttgggcattggcacgtgcctacctgcatgttagcgtgagaggagctttgtgtgtgagaacatgtgtaatgtgtgtgcagacatgccgagagccagagacttgtgtgtgggccacgtacatgtggatagagacgcatacatggaggtgcatgtaatctgtgtctccgagtgtgtgtgtgcaggtatgtgtgctggtgcagacccaagtgtgtgggtgtgcctctgtgtgcgtgtgttccatcatccctgcaccactggctccagatcccttcctgagcccccgtccccgctggccctctcacagcctgcagcacatcagtgcccccagctgcatgcgcctcgctgctctgtccatcagtgtgtgcttgaccaagagaaaactaagacgtctcgggggacccctgtacctggtcctctcagcccccgcccactgtgctgtgttactcgcatgggggatttcctgccccttccacaatatgctgtttccccaggagcctcaggcctgaggctctgagtggggtccccagggggccccccggggtgagccccggctccacaccctgccccatccaccctgtagggcccatgttggtgtagcagtgatggcttctgtggatattctgtgacctctgtcggtgtaacttgacaatttctaaatggaaaagggttgctgtgttttctctgtctctcttttttaatgtccttttttcttctcccccgctccctgctctctttccttttcagtttttctagccaagtgtttggggctttaataaaacttgtttctttttcctctcctggatctccttc

SEQ ID NO: 186284 - DNA, 4644 bp, Homo sapiens
  Payload ID: 16683
  Gene Symbol: SRCIN1
  Gene Name: SRC kinase signaling inhibitor 1
  ENST ID: ENST00000621492
  CDS Start-End: 138-3791
ggcggggcccgcgcccccggcccgcccgcctggcaccgcgccccggggctggggccgagcgaggagcccgcgaggcggcgagagggcgagcgccaggcaggccggcccggggcccccgccccccgcgcccccgcccgatggggaacgctccgtcccaagatccggagcggagcagcccccccatgctgtctgcggacgatgcggagtacccgcgggagtaccggaccctggggggcgggggcggcgggggcagcgggggccggcgcttctccaacgtggggctggtgcacacgtccgagcggcggcacacggtgatcgcggcccagagtctggaggcgctcagcgggctccagaaggcggacgccgaccgcaagcgtgatgccttcatggaccacctgaagagcaagtacccacagcacgccctggccctgcgaggccagcaggacaggatgcgagagcaggttggcggctggaccgtggaccccgtatgcctcctcagctccctctgctcccacctccatggcgactccgccccctccggggctggccagccggcccagcagccaaactactggagtttcaagacccgcagctcacgccacactcagggagcccagcccgggctggcagaccaggcggcaaagctgtcctacgcctccgccgagtcgctggagaccatgtcggaggccgagctgcccctgggcttcagcaggatgaaccgcttccgacagagcctgcctctctcccgctcggccagccagaccaagctgcgctccccaggggtgctgttcctgcagttcggggaggagactcggcgcgtgcacatcacgcacgaggtcagcagcctggacacgctgcacgcactcatcgcgcacatgttcccgcagaagctcaccatgggcatgcttaagtcgcccaataccgccatcctcatcaaagacgaggctcgcaacgtcttctacgagctggaggacgtccgggacatccaggaccgcagtattatcaagatctacagaaaggagcccctctacgctgccttccctggctcacatctcaccaacggggacctccggagagagatggtgtacgcatcgcgggagtcctcgcccacgcggcgcctcaacaacctgtcaccagcgccgcacctggcatccggctcgccgccgcccgggctgccgtcggggctgccgtccgggctgcagtccggttcgccgtcgcgttcgcgcctatcgtacgccggggggcgcccgccttcgtacgccggcagcccggtgcaccacgcggccgagaggctgggaggcgccccggccgcccagggcgtcagccccagccccagcgccatcctggagcggcgcgacgtgaagccggacgaggacctggcgagcaaggcgggcggcatggtgctggtgaaaggcgagggcctctatgctgacccctacgggctgctgcacgagggccgtctgagcctggccgcggccgccggcgacccgttcgcctacccgggcgccggcggcctctacaagcgcggctcggtgcgctcgctcagcacctactcggccgccgcgctgcagtccgatctggaggactccctgtacaaggcggcgggcggcggcggcccgctgtacggcgacggctacggcttccgcctgccgccttcgtcaccgcagaagctggccgacgtggcagcaccccccggaggtcccccgccaccgcacagcccctactcggggccgcccagccgcggctcgccagtgcgccagtccttccgcaaggactcgggctcctcgtccgtctttgccgagagtcctggagggaagacccgcagcgcggggagcgcctcgacggccggagctcccccttcggagctcttccctgggcctggggaacgctcgctggttgggttcgggccgccagtgccagccaaggacacggagaccagggagcgcatggaggccatggagaagcagattgccagcctcacaggcctggtgcagagcgccttactgcgaggctctgagcctgagacccccagcgagaagattgaaggctccaatggagcagccaccccctcagcaccctgtgggtcaggcggccggagcagcggggccaccccggtgtccggcccgcccccgccctcggccagcagcacccccgcaggtcagcctaccgccgttagccggctgcagatgcagcttcacctgcgaggcctgcagaacagcgccagtgacttgcgcggccagctccagcagttgcgcaagctccagctacagaaccaggagtcggtgcgcgcgctgctgaagcgcacggaggcagagctgagcatgcgcgtgtcggaggcggcgcggcggcaggaggacccgctgcagcggcagcgcaccctggtggaagaggaacggctgcgctatctcaacgacgaggagcttattacccagcagctcaatgacctggagaaatcggtggagaagatccagagagacgtgtcccacaaccaccggctggtgcccggccctgagctggaggagaaggcactggtgctgaagcagctcggggagacgctgacagagctcaaggctcacttcccgggcctgcagagcaagatgcgggtggtgctgcgcgtggaggtggaggcggtgaagttcctgaaggaggagccccagcgcctggatgggctcctcaagcgctgccgcggggtcacggacacgctggcccagatccgaaggcaagtggatgagggtgtgtggccaccccccaacaatctcctgagtcagtcccccaagaaggtgacggcagagactgacttcaacaagagcgtggacttcgaaatgccaccccccagccccccgctgaacctgcatgagctgagcgggccagctgaaggagcctctcttacccccaaggggggcaaccccaccaaaggcctggacactcctggcaagagaagcgtggacaaagctgtgtctgttgaggctgcagagcgagactgggaggagaagcgggcagccctgacccagtacagtgccaaggacatcaaccggctgctggaagagacacaggcagagctgctcaaggccatccctgacctggactgtgccagcaaggcccatccaggcccggcccccactccagatcacaagccccccaaggccccccacggccagaaggcagccccccgaacggagcccagtgggaggaggggctcagatgagttgaccgtgccccgataccgcacagagaagccctccaagtcgcccccaccgccccctccccgccggagcttcccctcctcccatggcctgaccaccacacgtaccggagaggtggtggtcaccagcaagaaggactcggccttcatcaagaaggctgagtccgaggagctggaggtgcagaagccccaggtgaagctgcgccgggctgtgtctgaggtggcccgcccagcctccacaccacccatcatggcctcggccatcaaggacgaggatgacgaggatcgcatcatcgcagagctagagagtggcggaggcagtgtaccacccatgaaggtggtgactccgggggcctctcggctgaaggcggcccagggccaggcgggcagccccgacaaaagcaaacatggcaagcagagggccgagtacatgcggatccaggcccagcagcaggccactaaaccatctaaagagatgagcgggtcgaatgagacctcgagcccagtctcagaaaagccctcggcttccagaacctctatccctgtattgacttcctttggggcaaggaattcttccatctccttctagaagcccctcaccccgctgccccgcctgtccccctccctcactcctgccatttctcccctctcttccttcatctccaccccaccccaccctactctccagacgccctgaggggtgtgccctgaagaggagggtgcggccctcctcagcgacccctacccatcatctgttggtgtttttggttttgtttttttttttttttttaacaattaacttttaattatctttttttaaacagtaaaactaaaaaccaaacacaccaccttccttgatcccagctggcctctcgctggccgcacctgtcacatctctccttcttctctttcaccactctttcccccagtccatcctgaagctcctgcacccccttcccgccttcccctcacttcccaagaatactccaaacaaactctgaaccacggagacttggagcagtgggagacccctctcccgtttctcgataccttcctggaggaacgcggggacatcggaccaacccatacatcaagccagagagcggggcttagggagactggccttggagatgccccactccctgtctaagctccgacaagactgtgacttcctctgtggctgctctgcctcctcccactcacacccaagtgggcctggagtagagacggacaggctggagacgaggccggagtttgagaggcctcagggtgggtgtgaggccatggagtctgtatccctggggaggcgctggcctcctgggccttgccgtccagtggggagtggagggcagaggccctttggtctgctggctgtggagggtgggttgcacggacagccggatatcggggacactgccttgggagagggcggcccggacggg

SEQ ID NO: 186285 - DNA, 7058 bp, Homo sapiens; identical to SEQ ID NO: 186283
  Payload ID: 16683
  Gene Symbol: SRCIN1
  Gene Name: SRC kinase signaling inhibitor 1
  Uniprot ID: Q9C0H9
  ENST ID: ENST00000617146
  CDS Start-End: 226-3777

SEQ ID NO: 186286 - DNA, 1431 bp, Homo sapiens; identical to SEQ ID NO: 186281
  Payload ID: 16683
  Gene Symbol: SRCIN1
  Gene Name: SRC kinase signaling inhibitor 1
  ENST ID: ENST00000632117
  CDS Start-End: 11-1431

SEQ ID NO: 186287 - DNA, 4644 bp, Homo sapiens; identical to SEQ ID NO: 186284
  Payload ID: 16683
  Gene Symbol: SRCIN1
  Gene Name: SRC kinase signaling inhibitor 1
  ENST ID: ENST00000631564
  CDS Start-End: 138-3791

SEQ ID NO: 186288 - DNA, 1150 bp, Homo sapiens
  Payload ID: 16683
  Gene Symbol: SRCIN1
  Gene Name: SRC kinase signaling inhibitor 1
  ENST ID: ENST00000631684
  CDS Start-End: 1-919
gtccgaggagctggaggtgcagaagccccaggtgaagctgcgccgggctgtgtctgaggtggcccgcccagcctccacaccacccatcatggcctcggccatcaaggacgaggatgacgaggatcgcatcatcgcagagctagaggtgtttgagagaagctcagtgtcttccctcccccccacgccccgccgccagctgatccccaccttgctgtccccccaggacctggggccccccgggggctcagccccaggccctacacggaaggctgccccaggtcccagggccttctgcgtcccaaggatcatcttgacagagtgtgcccccaaccctccctccccgccagaggccagacttgaggaactgggacccaggacagctcccaccccaagacctcagaccctggctgacagcacgaggggctgggatggcccacagtccccaccaggggtagtgggggagacttctgggccgaggagcagcttcatgccccggaaggagggggcagctctgaagagactgggtggaggaggcagcagcctagaggatggaggagccagagtacagtgtcctcagggaccagcccaggatgggactccagagacctctactgctgacacctacccagaggagatcctcaaggactctggacatgatgcccaaacctgcagtagggagcatcagggccaggctgctgccaactcaggccgcaccacgtggggcgccactgcccagcagatggacagcttggaggagacgctccgggagctggaagccaccctgagcaacatgggcacaggccctgccatggggtcccctggcagccccccacccctacccctccgcccccaggtggctgcccgcttttcatcctcctctgctgccttcctcctccatttccagagtcagacagagtagggggcagcagaaatgccaggccagccccctcctcccaccggccttctctcagctcttaccactctcctgggagcctggtgccagagcagggtttgcaggcagagtccgggggaggctgggaagccggcctacccaggggccggccaatccccagccttggcaagaaccagggcctcccgcttctgctctgtatctgtaaaccaacaaataaagttctctccccaccttcca

SEQ ID NO: 186289 - DNA, 4635 bp, Homo sapiens; identical to SEQ ID NO: 186282
  Payload ID: 16683
  Gene Symbol: SRCIN1
  Gene Name: SRC kinase signaling inhibitor 1
  ENST ID: ENST00000632724
  CDS Start-End: 1-2785

SEQ ID NO: 186290 - DNA, 3851 bp, Homo sapiens
  Payload ID: 16684
  Gene Symbol: SRC
  Gene Name: SRC proto-oncogene, non-receptor tyrosine kinase
  Uniprot ID: P12931
  ENST ID: ENST00000358208
  CDS Start-End: 188-1798
atccctgctttgcagatgaggacgctgaggcccagagagggaaagccacttgcctagggacacacagcggggagaggtggagcagggcctctatttcgagacccctgactccacacctggtgtttgtgccaagaccccaggctgcctcccaggtcctctgggacagcccctgccttctaccaggaccatgggtagcaacaagagcaagcccaaggatgccagccagcggcgccgcagcctggagcccgccgagaacgtgcacggcgctggcgggggcgctttccccgcctcgcagacccccagcaagccagcctcggccgacggccaccgcggccccagcgcggccttcgcccccgcggccgccgagcccaagctgttcggaggcttcaactcctcggacaccgtcacctccccgcagagggcgggcccgctggccggtggagtgaccacctttgtggccctctatgactatgagtctaggacggagacagacctgtccttcaagaaaggcgagcggctccagattgtcaacaacacagagggagactggtggctggcccactcgctcagcacaggacagacaggctacatccccagcaactacgtggcgccctccgactccatccaggctgaggagtggtattttggcaagatcaccagacgggagtcagagcggttactgctcaatgcagagaacccgagagggaccttcctcgtgcgagaaagtgagaccacgaaaggtgcctactgcctctcagtgtctgacttcgacaacgccaagggcctcaacgtgaagcactacaagatccgcaagctggacagcggcggcttctacatcacctcccgcacccagttcaacagcctgcagcagctggtggcctactactccaaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatggggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaaggggagtttgctggactttctcaagggggagacaggcaagtacctgcggctgcctcagctggtggacatggctgctcagatcgcctcaggcatggcgtacgtggagcggatgaactacgtccaccgggaccttcgtgcagccaacatcctggtgggagagaacctggtgtgcaaagtggcggactttgggctggctcggctcattgaagacaatgagtacacggcgcggcaaggtgccaaattccccatcaagtggacggctccagaagctgccctctatggccgcttcaccatcaagtcggacgtgtggtccttcgggatcctgctgactgagctcaccacaaagggacgggtgccctaccctgggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgccgagacagaccctctgccgctgcttccaggctgggcagcacaaggccttgcctggcctgatgatggtgggtgggtgggatgagtaccccctcaaaccctgccctccttagacctgagggacccttcgagatcatcacttccttgcccccatttcacccatggggagacagttgagagcggggatgtgacatgcccaaggccacggagcagttcagagtggaggcgggcttggaacccggtgctccctctgtcatcctcaggaaccaacaattcgtcggaggcatcatggaaagactgggacagcccaggaaacaaggggtctgaggatgcattcgagatggcagattcccactgccgctgcccgctcagcccagctgttgggaacagcatggaggcagatgtggggctgagctggggaatcagggtaaaaggtgcaggtgtggagagagaggcttcaatcggcttgtgggtgatgtttgaccttcagagccagccggctatgaaagggagcgagcccctcggctctggaggcaatcaagcagacatagaagagccaagagtccaggaggccctggtcctggcctccttccccgtactttgtcccgtggcatttcaattcctggccctgttctcctccccaagtcggcaccctttaactcatgaggagggaaaagagtgcctaagcgggggtgaaagaggacgtgttacccactgccatgcaccaggactggctgtgtaaccttgggtggcccctgctgtctctctgggctgcagagtctgccccacatgtggccatggcctctgcaactgctcagctctggtccaggccctgtggcaggacacacatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtcccccccgctccgtcccccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtcctttttttttttttaacagtgttttgtagatttcagatgactatgcagaggcctgggggacccctggctctgggccgggcctggggctccgaaattccaaggcccagacttgcggggggtgggggggtatccagaattggttgtaaatactttgcatattgtctgattaaacacaaacagacctcagaatctgatcaacagtt

SEQ ID NO: 186291 - DNA, 4304 bp, Homo sapiens
  Payload ID: 16684
  Gene Symbol: SRC
  Gene Name: SRC proto-oncogene, non-receptor tyrosine kinase
  Uniprot ID: P12931
  ENST ID: ENST00000373558
  CDS Start-End: 5-1633
gaccatgggtagcaacaagagcaagcccaaggatgccagccagcggcgccgcagcctggagcccgccgagaacgtgcacggcgctggcgggggcgctttccccgcctcgcagacccccagcaagccagcctcggccgacggccaccgcggccccagcgcggccttcgcccccgcggccgccgagcccaagctgttcggaggcttcaactcctcggacaccgtcacctccccgcagagggcgggcccgctggccggtggagtgaccacctttgtggccctctatgactatgagtctaggacggagacagacctgtccttcaagaaaggcgagcggctccagattgtcaacaacacgaggaaggtggatgtcagagagggagactggtggctggcccactcgctcagcacaggacagacaggctacatccccagcaactacgtggcgccctccgactccatccaggctgaggagtggtattttggcaagatcaccagacgggagtcagagcggttactgctcaatgcagagaacccgagagggaccttcctcgtgcgagaaagtgagaccacgaaaggtgcctactgcctctcagtgtctgacttcgacaacgccaagggcctcaacgtgaagcactacaagatccgcaagctggacagcggcggcttctacatcacctcccgcacccagttcaacagcctgcagcagctggtggcctactactccaaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatggggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaaggggagtttgctggactttctcaagggggagacaggcaagtacctgcggctgcctcagctggtggacatggctgctcagatcgcctcaggcatggcgtacgtggagcggatgaactacgtccaccgggaccttcgtgcagccaacatcctggtgggagagaacctggtgtgcaaagtggcggactttgggctggctcggctcattgaagacaatgagtacacggcgcggcaaggtgccaaattccccatcaagtggacggctccagaagctgccctctatggccgcttcaccatcaagtcggacgtgtggtccttcgggatcctgctgactgagctcaccacaaagggacgggtgccctaccctgggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgccgagacagaccctctgccgctgcttccaggctgggcagcacaaggccttgcctggcctgatgatggtgggtgggtgggatgagtaccccctcaaaccctgccctccttagacctgagggacccttcgagatcatcacttccttgcccccatttcacccatggggagacagttgagagcggggatgtgacatgcccaaggccacggagcagttcagagtggaggcgggcttggaacccggtgctccctctgtcatcctcaggaaccaacaattcgtcggaggcatcatggaaagactgggacagcccaggaaacaaggggtctgaggatgcattcgagatggcagattcccactgccgctgcccgctcagcccagctgttgggaacagcatggaggcagatgtggggctgagctggggaatcagggtaaaaggtgcaggtgtggagagagaggcttcaatcggcttgtgggtgatgtttgaccttcagagccagccggctatgaaagggagcgagcccctcggctctggaggcaatcaagcagacatagaagagccaagagtccaggaggccctggtcctggcctccttccccgtactttgtcccgtggcatttcaattcctggccctgttctcctccccaagtcggcaccctttaactcatgaggagggaaaagagtgcctaagcgggggtgaaagaggacgtgttacccactgccatgcaccaggactggctgtgtaaccttgggtggcccctgctgtctctctgggctgcagagtctgccccacatgtggccatggcctctgcaactgctcagctctggtccaggccctgtggcaggacacacatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtcccccccgctccgtcccccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtcctttttttttttttaacagtgttttgtagatttcagatgactatgcagaggcctgggggacccctggctctgggccgggcctggggctccgaaattccaaggcccagacttgcggggggtgggggggtatccagaattggttgtaaatactttgcatattgtctgattaaacacaaacagacctcagaatctgatcaacagtttattgaacatctactgtgtgctggaaagcgagatggggcggaatgcgagaacaaactaccccttgaggggtctttgggcagcactagtagctggagggcttcaggccaaggcaggggtgacatcagattggagacagctacggcagaatgtggctgtttgtgaacatctgcacctgtgttagggggtgagcacctgggagaaggacaaggcacatcacaggacttccctgagcatgacaagttcaggactcaaatgtccgtggtggatggtagcagtgacattggggagtgggtggggctgtcaagcctgcctagaggagatcacaaatacacgacgagaataccgttgtgtgtgctcttcgtgtgtttcctaggagtgcagggcaggggtgctgggtcgatccacaaaagtcctgaaaacgctgaagaaaaatccaaagacccttcccctcctccctccttccccaccaccgaagcacacagtcttgaaggttgatttgcaaccgtctatacaaacacatttattttacacaaatatacatcagatcacacacctgtgcaccggagtcaactctggccacgacattgcttaattaaaaacaaatttcaaaaactgga

SEQ ID NO: 186292 - DNA, 4321 bp, Homo sapiens
  Payload ID: 16684
  Gene Symbol: SRC
  Gene Name: SRC proto-oncogene, non-receptor tyrosine kinase
  Uniprot ID: P12931
  ENST ID: ENST00000373567
  CDS Start-End: 40-1650
catcgaggttttgagaggctaactctcccaaaaaggaccatgggtagcaacaagagcaagcccaaggatgccagccagcggcgccgcagcctggagcccgccgagaacgtgcacggcgctggcgggggcgctttccccgcctcgcagacccccagcaagccagcctcggccgacggccaccgcggccccagcgcggccttcgcccccgcggccgccgagcccaagctgttcggaggcttcaactcctcggacaccgtcacctccccgcagagggcgggcccgctggccggtggagtgaccacctttgtggccctctatgactatgagtctaggacggagacagacctgtccttcaagaaaggcgagcggctccagattgtcaacaacacagagggagactggtggctggcccactcgctcagcacaggacagacaggctacatccccagcaactacgtggcgccctccgactccatccaggctgaggagtggtattttggcaagatcaccagacgggagtcagagcggttactgctcaatgcagagaacccgagagggaccttcctcgtgcgagaaagtgagaccacgaaaggtgcctactgcctctcagtgtctgacttcgacaacgccaagggcctcaacgtgaagcactacaagatccgcaagctggacagcggcggcttctacatcacctcccgcacccagttcaacagcctgcagcagctggtggcctactactccaaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatggggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaaggggagtttgctggactttctcaagggggagacaggcaagtacctgcggctgcctcagctggtggacatggctgctcagatcgcctcaggcatggcgtacgtggagcggatgaactacgtccaccgggaccttcgtgcagccaacatcctggtgggagagaacctggtgtgcaaagtggcggactttgggctggctcggctcattgaagacaatgagtacacggcgcggcaaggtgccaaattccccatcaagtggacggctccagaagctgccctctatggccgcttcaccatcaagtcggacgtgtggtccttcgggatcctgctgactgagctcaccacaaagggacgggtgccctaccctgggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgccgagacagaccctctgccgctgcttccaggctgggcagcacaaggccttgcctggcctgatgatggtgggtgggtgggatgagtaccccctcaaaccctgccctccttagacctgagggacccttcgagatcatcacttccttgcccccatttcacccatggggagacagttgagagcggggatgtgacatgcccaaggccacggagcagttcagagtggaggcgggcttggaacccggtgctccctctgtcatcctcaggaaccaacaattcgtcggaggcatcatggaaagactgggacagcccaggaaacaaggggtctgaggatgcattcgagatggcagattcccactgccgctgcccgctcagcccagctgttgggaacagcatggaggcagatgtggggctgagctggggaatcagggtaaaaggtgcaggtgtggagagagaggcttcaatcggcttgtgggtgatgtttgaccttcagagccagccggctatgaaagggagcgagcccctcggctctggaggcaatcaagcagacatagaagagccaagagtccaggaggccctggtcctggcctccttccccgtactttgtcccgtggcatttcaattcctggccctgttctcctccccaagtcggcaccctttaactcatgaggagggaaaagagtgcctaagcgggggtgaaagaggacgtgttacccactgccatgcaccaggactggctgtgtaaccttgggtggcccctgctgtctctctgggctgcagagtctgccccacatgtggccatggcctctgcaactgctcagctctggtccaggccctgtggcaggacacacatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtcccccccgctccgtcccccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtcctttttttttttttaacagtgttttgtagatttcagatgactatgcagaggcctgggggacccctggctctgggccgggcctggggctccgaaattccaaggcccagacttgcggggggtgggggggtatccagaattggttgtaaatactttgcatattgtctgattaaacacaaacagacctcagaatctgatcaacagtttattgaacatctactgtgtgctggaaagcgagatggggcggaatgcgagaacaaactaccccttgaggggtctttgggcagcactagtagctggagggcttcaggccaaggcaggggtgacatcagattggagacagctacggcagaatgtggctgtttgtgaacatctgcacctgtgttagggggtgagcacctgggagaaggacaaggcacatcacaggacttccctgagcatgacaagttcaggactcaaatgtccgtggtggatggtagcagtgacattggggagtgggtggggctgtcaagcctgcctagaggagatcacaaatacacgacgagaataccgttgtgtgtgctcttcgtgtgtttcctaggagtgcagggcaggggtgctgggtcgatccacaaaagtcctgaaaacgctgaagaaaaatccaaagacccttcccctcctccctccttccccaccaccgaagcacacagtcttgaaggttgatttgcaaccgtctatacaaacacatttattttacacaaatatacatcagatcacacacctgtgcaccggagtcaactctggccacgacattgcttaattaaaaacaaatttcaaaaactgga

SEQ ID NO: 186293 - DNA, 4630 bp, Homo sapiens
  Payload ID: 16684
  Gene Symbol: SRC
  Gene Name: SRC proto-oncogene, non-receptor tyrosine kinase
  Uniprot ID: P12931
  ENST ID: ENST00000373578
  CDS Start-End: 349-1959
gccggagcggccaggccgccgtctgcccgtcccgctggacgtcccgcggtccgccctcccgtgcgtccgtctgccggtgagcccgcccgcccgccggcccagaacagagaacagaagctcagagaagtgaagcaacttgcccagctatgagagacagagccaggatttgaaaccagatgaggacgctgaggcccagagagggaaagccacttgcctagggacacacagcggggagaggtggagcagggcctctatttcgagacccctgactccacacctggtgtttgtgccaagaccccaggctgcctcccaggtcctctgggacagcccctgccttctaccaggaccatgggtagcaacaagagcaagcccaaggatgccagccagcggcgccgcagcctggagcccgccgagaacgtgcacggcgctggcgggggcgctttccccgcctcgcagacccccagcaagccagcctcggccgacggccaccgcggccccagcgcggccttcgcccccgcggccgccgagcccaagctgttcggaggcttcaactcctcggacaccgtcacctccccgcagagggcgggcccgctggccggtggagtgaccacctttgtggccctctatgactatgagtctaggacggagacagacctgtccttcaagaaaggcgagcggctccagattgtcaacaacacagagggagactggtggctggcccactcgctcagcacaggacagacaggctacatccccagcaactacgtggcgccctccgactccatccaggctgaggagtggtattttggcaagatcaccagacgggagtcagagcggttactgctcaatgcagagaacccgagagggaccttcctcgtgcgagaaagtgagaccacgaaaggtgcctactgcctctcagtgtctgacttcgacaacgccaagggcctcaacgtgaagcactacaagatccgcaagctggacagcggcggcttctacatcacctcccgcacccagttcaacagcctgcagcagctggtggcctactactccaaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatggggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaaggggagtttgctggactttctcaagggggagacaggcaagtacctgcggctgcctcagctggtggacatggctgctcagatcgcctcaggcatggcgtacgtggagcggatgaactacgtccaccgggaccttcgtgcagccaacatcctggtgggagagaacctggtgtgcaaagtggcggactttgggctggctcggctcattgaagacaatgagtacacggcgcggcaaggtgccaaattccccatcaagtggacggctccagaagctgccctctatggccgcttcaccatcaagtcggacgtgtggtccttcgggatcctgctgactgagctcaccacaaagggacgggtgccctaccctgggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgccgagacagaccctctgccgctgcttccaggctgggcagcacaaggccttgcctggcctgatgatggtgggtgggtgggatgagtaccccctcaaaccctgccctccttagacctgagggacccttcgagatcatcacttccttgcccccatttcacccatggggagacagttgagagcggggatgtgacatgcccaaggccacggagcagttcagagtggaggcgggcttggaacccggtgctccctctgtcatcctcaggaaccaacaattcgtcggaggcatcatggaaagactgggacagcccaggaaacaaggggtctgaggatgcattcgagatggcagattcccactgccgctgcccgctcagcccagctgttgggaacagcatggaggcagatgtggggctgagctggggaatcagggtaaaaggtgcaggtgtggagagagaggcttcaatcggcttgtgggtgatgtttgaccttcagagccagccggctatgaaagggagcgagcccctcggctctggaggcaatcaagcagacatagaagagccaagagtccaggaggccctggtcctggcctccttccccgtactttgtcccgtggcatttcaattcctggccctgttctcctccccaagtcggcaccctttaactcatgaggagggaaaagagtgcctaagcgggggtgaaagaggacgtgttacccactgccatgcaccaggactggctgtgtaaccttgggtggcccctgctgtctctctgggctgcagagtctgccccacatgtggccatggcctctgcaactgctcagctctggtccaggccctgtggcaggacacacatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtcccccccgctccgtcccccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtcctttttttttttttaacagtgttttgtagatttcagatgactatgcagaggcctgggggacccctggctctgggccgggcctggggctccgaaattccaaggcccagacttgcggggggtgggggggtatccagaattggttgtaaatactttgcatattgtctgattaaacacaaacagacctcagaatctgatcaacagtttattgaacatctactgtgtgctggaaagcgagatggggcggaatgcgagaacaaactaccccttgaggggtctttgggcagcactagtagctggagggcttcaggccaaggcaggggtgacatcagattggagacagctacggcagaatgtggctgtttgtgaacatctgcacctgtgttagggggtgagcacctgggagaaggacaaggcacatcacaggacttccctgagcatgacaagttcaggactcaaatgtccgtggtggatggtagcagtgacattggggagtgggtggggctgtcaagcctgcctagaggagatcacaaatacacgacgagaataccgttgtgtgtgctcttcgtgtgtttcctaggagtgcagggcaggggtgctgggtcgatccacaaaagtcctgaaaacgctgaagaaaaatccaaagacccttcccctcctccctccttccccaccaccgaagcacacagtcttgaaggttgatttgcaaccgtctatacaaacacatttattttacacaaatatacatcagatcacacacctgtgcaccggagtcaactctggccacgacattgcttaattaaaaacaaatttcaaaaactgga

SEQ ID NO: 186294 - DNA, 3451 bp, Homo sapiens
  Payload ID: 16685
  Gene Symbol: SLA
  Gene Name: Src-like-adaptor
  Uniprot ID: Q13239
  ENST ID: ENST00000338087
  CDS Start-End: 821-1651
cacacacacactggaaactcctgcatactcctcttactataatctgtcaccaaagactggatattcctgtgctggggctcgtgccagcgcctcgggctgccaggtgctgctttccaactcccacatgggctgccctccccctactgctacccacagggcccccactccacctgctcccagacgaggccaactcctggccaagcttaggggcacagcggaggcgctctgtttctgatttttctcgccttccttggagatgcctgtgcttggaagggaaggcagaacattgcatcttggaacaaatctgcttttgatcatgcaaatgaatgcctggataatgtaggcagactgtcaatttcaccagttagaaagaaagagaaaagggggagaaattccccatgacagcgactgatgaagaatttcaatagaaagctgctacttcagaaaataagatcatttgctgcgaatggagaacatctcaggcagccctgatgctccaccgtccttgcagagagaagcttgctcagagtggttactgaaaacaggaacctgcccttctgcaagccctgtgccttcctcgttcctagcagaggaagtatgcggccagtttagcaactgcagttcttctgtgtagcatgggctgcttctccacaaccgcgagaagcccggctgcctgtttattctggagcagcagcagttgacagacggagaggcagtgactctgcacccagcaatccctctgcagacagctcccacaggagtcatgcccagtgtgtgaaggctctgggcatcaccagcggccccagggaaaaagaaagaaatgggaaacagcatgaaatccacccctgcgcctgccgagaggcccctgcccaacccggagggactggatagcgacttccttgccgtgctaagtgactacccgtctcctgacatcagccccccgatattccgccgaggggagaaactgcgtgtgatttctgatgaagggggctggtggaaagctatttctcttagcactggtcgagagagttacatccctggaatatgtgtggccagagtttaccatggctggctgtttgagggcctgggcagagacaaggccgaggagctgctgcagctgccagacacaaaggtcggctccttcatgatcagagagagtgagaccaagaaagggttttactcactgtcggtgagacacaggcaggtaaagcattaccgcattttccgtctgcccaacaactggtactacatttccccgaggctcaccttccagtgcctggaggacctggtgaaccactattctgaggtggctgatggcctgtgctgtgtgctcaccacgccctgcctgacacaaagcacggctgccccagcagtgagggcctccagctcacctgtcaccttgcgtcagaagactgtggactggaggagagtgtccagactgcaggaggaccccgagggaacagagaacccgcttggggtagacgagtcccttttcagctatggccttcgagagagcattgcctcttacctgtccctgaccagtgaggacaacacctcctttgatcgaaagaagaaaagcatctccctgatgtatggtggcagcaagagaaagagctcattcttctcatcaccaccttactttgaggactagccaagaacagacacaatggttcatgcccaaaaggaacagaagttccaactattgcctgggatcttgcgaaaagcgaggttccctgatccctgggagcctcacgtattttagaagccaagagaagccacatggagactcaaattcgcatcttctctatccacatcatgaccaaaggaacccctccctggtgtctgatcagggctgtggcatcacgaaacattggatcatgacatgtcgggcgatgcttggaagagcccagcatgtatgtatgcacacattgtgtgtgtgggaaggacaaagccactctcacaagaaagggcaccaggactgctctccaaggaactggacctgtccagacagttacactccaaggtcattggagagaacttctgtatgggcaagcctgagagggagaggaaacaaaagctgtgtcctggcagaaggtctgggtttgcagatgggtgccctgaatggaactactttaactaatccatagggacttctggtatgctttcctctctttttaaaggaacttcgtgacactaaacattagcccaaaggacttcttagccttcaattgggagatacctttggtctgctcctgcaccaaagccatatgggtggaagtcagttggcctccctggttctgcagagggccagaagaatgagagagaggaagactgctggcagggaaatcgaggaggcgagactagaactgcaccagcttccctgatgtctgcagccatggctttgcagcgcagacagagcttctctgggatgctgggattcttgcctgtatgaatgcatcaagtattcatttattgcccgaataggcattgcattaagtcctctgtaaggtgtcaggcaagccaaaaaaaaaaaaaagatgcgtaagtcctaacccccaacagaggtgttcacagtgtagacagggaaaaaatgtataaacaaatgtgtaaaaagagaaatcagctcatggcttaggatggaattagagacaggtgagggacactcaggagctcattttccagctgctcttcagagtggaagggctggctggatcgggtaggtaagaatagctggattttttagaaaagaaatggatacagtctaaagaattaactcacccggtactttattctaagaagggtctggcatccatatgaggaaaaatgctcagctccaggaaagatggggagtccaagtggattaatgatgtcatgcataattttaagagacaagggagaaaacacaatgtatagccagagaaggagaagctcccatccaaatcctactaggaagagagtgggctgcagatgaatctgtgactcatgtttccctgtttcaaagggatcctggggaaggaggggaacatgcttgcagtatctctccctgtctgtctgctcacataagcattccgtccatctgagctcatcgtgctactggtatgtgtatgtgcagttacacagttttctgtatcatagattctagtgtgtttatacaaggagacatctgtggtttccccaaccgttccaaaaggctatttcaaaggaaccagccaacgtatgagaaatgaatgtaacactgtggacattgacttcccgcataaggcagggtgaccccctgaactccagatgtctgcacagtatcttatgtgttgttttccgttgtgacgaatgtgattggaacatttggggagcacccagagggatttctcagtgggaagcattacactttgctaaatcatgtatttattcctgattaaaacaaacctaataaatatttaacccttggcacaca

SEQ ID NO: 186295 - DNA, 2102 bp, Homo sapiens
  Payload ID: 16685
  Gene Symbol: SLA
  Gene Name: Src-like-adaptor
  Uniprot ID: Q13239
  ENST ID: ENST00000395352
  CDS Start-End: 350-1231
actgctacccacagggcccccactccacctgctcccagacgaggccaactcctggccaagcttaggggcacagcggaggcgctctgtttctgatttttctcgccttccttggagatgcctgtgcttggaagggaaggcagaacattgcatcttggaacaaatctgcttttgatcatgcaaatgaatgcctggataatgtaggcagactgtcaatttcaccagttagaaagaaagagaaaagggggagaaattccccatgacagcgactgatgaagaatttcaatagaaagctgctacttcagaaaataagatcatttgctgcgaatggagaacatctcaggcagccctgatgctccaccggctctgggcatcaccagcggccccagggaaaaagaaagaaatgggaaacagcatgaaatccacccctgcgcctgccgagaggcccctgcccaacccggagggactggatagcgacttccttgccgtgctaagtgactacccgtctcctgacatcagccccccgatattccgccgaggggagaaactgcgtgtgatttctgatgaagggggctggtggaaagctatttctcttagcactggtcgagagagttacatccctggaatatgtgtggccagagtttaccatggctggctgtttgagggcctgggcagagacaaggccgaggagctgctgcagctgccagacacaaaggtcggctccttcatgatcagagagagtgagaccaagaaagggttttactcactgtcggtgagacacaggcaggtaaagcattaccgcattttccgtctgcccaacaactggtactacatttccccgaggctcaccttccagtgcctggaggacctggtgaaccactattctgaggtggctgatggcctgtgctgtgtgctcaccacgccctgcctgacacaaagcacggctgccccagcagtgagggcctccagctcacctgtcaccttgcgtcagaagactgtggactggaggagagtgtccagactgcaggaggaccccgagggaacagagaacccgcttggggtagacgagtcccttttcagctatggccttcgagagagcattgcctcttacctgtccctgaccagtgaggacaacacctcctttgatcgaaagaagaaaagcatctccctgatgtatggtggcagcaagagaaagagctcattcttctcatcaccaccttactttgaggactagccaagaacagacacaatggttcatgcccaaaaggaacagaagttccaactattgcctgggatcttgcgaaaagcgaggttccctgatccctgggagcctcacgtattttagaagccaagagaagccacatggagactcaaattcgcatcttctctatccacatcatgaccaaaggaacccctccctggtgtctgatcagggctgtggcatcacgaaacattggatcatgacatgtcgggcgatgcttggaagagcccagcatgtatgtatgcacacattgtgtgtgtgggaaggacaaagccactctcacaagaaagggcaccaggactgctctccaaggaactggacctgtccagacagttacactccaaggtcattggagagaacttctgtatgggcaagcctgagagggagaggaaacaaaagctgtgtcctggcagaaggtctgggtttgcagatgggtgccctgaatggaactactttaactaatccatagggacttctggtatgctttcctctctttttaaaggaacttcgtgacactaaacattagcccaaaggacttcttagccttcaattgggagatacctttggtctgctcctgcaccaaagccatatgggtggaagtcagttggcctccctggttctgcagagggccagaagaatgagagagaggaagactgctggcagggaaatcgaggaggcgagactagaactgcaccagcttccctgatgtctgcagccatggctttgcagcgcagacagagcttctctgggatgctgggattcttgcctgtatgaatgcatcaagtattcatttattgcccgaataggcattgcattaagtcctctgtaaggtgtcaggcaagcc

SEQ ID NO: 186296 - DNA, 1914 bp, Homo sapiens
  Payload ID: 16685
  Gene Symbol: SLA
  Gene Name: Src-like-adaptor
  Uniprot ID: Q13239
  ENST ID: ENST00000427060
  CDS Start-End: 79-1029
aaccaatcttcaccaatctcatcttcacatataaacagccgcctttcaagaagcaagctgccagaaaaatgatgcacgatgctctctaaactgggtcattctccacttggagggctcagggcacggttgactttccccgtctgtctcctataccacaggctctgggcatcaccagcggccccagggaaaaagaaagaaatgggaaacagcatgaaatccacccctgcgcctgccgagaggcccctgcccaacccggagggactggatagcgacttccttgccgtgctaagtgactacccgtctcctgacatcagccccccgatattccgccgaggggagaaactgcgtgtgatttctgatgaagggggctggtggaaagctatttctcttagcactggtcgagagagttacatccctggaatatgtgtggccagagtttaccatggctggctgtttgagggcctgggcagagacaaggccgaggagctgctgcagctgccagacacaaaggtcggctccttcatgatcagagagagtgagaccaagaaagggttttactcactgtcggtgagacacaggcaggtaaagcattaccgcattttccgtctgcccaacaactggtactacatttccccgaggctcaccttccagtgcctggaggacctggtgaaccactattctgaggtggctgatggcctgtgctgtgtgctcaccacgccctgcctgacacaaagcacggctgccccagcagtgagggcctccagctcacctgtcaccttgcgtcagaagactgtggactggaggagagtgtccagactgcaggaggaccccgagggaacagagaacccgcttggggtagacgagtcccttttcagctatggccttcgagagagcattgcctcttacctgtccctgaccagtgaggacaacacctcctttgatcgaaagaagaaaagcatctccctgatgtatggtggcagcaagagaaagagctcattcttctcatcaccaccttactttgaggactagccaagaacagacacaatggttcatgcccaaaaggaacagaagttccaactattgcctgggatcttgcgaaaagcgaggttccctgatccctgggagcctcacgtattttagaagccaagagaagccacatggagactcaaattcgcatcttctctatccacatcatgaccaaaggaacccctccctggtgtctgatcagggctgtggcatcacgaaacattggatcatgacatgtcgggcgatgcttggaagagcccagcatgtatgtatgcacacattgtgtgtgtgggaaggacaaagccactctcacaagaaagggcaccaggactgctctccaaggaactggacctgtccagacagttacactccaaggtcattggagagaacttctgtatgggcaagcctgagagggagaggaaacaaaagctgtgtcctggcagaaggtctgggtttgcagatgggtgccctgaatggaactactttaactaatccatagggacttctggtatgctttcctctctttttaaaggaacttcgtgacactaaacattagcccaaaggacttcttagccttcaattgggagatacctttggtctgctcctgcaccaaagccatatgggtggaagtcagttggcctccctggttctgcagagggccagaagaatgagagagaggaagactgctggcagggaaatcgaggaggcgagactagaactgcaccagcttccctgatgtctgcagccatggctttgcagcgcagacagagcttctctgggatgctgggattcttgcctgtatgaatgcatcaagtattcatttattgcccgaataggcattgcattaagtcctctgtaaggtgtcaggcaagccaaaaaaaaaaaaaa

SEQ ID NO: 186297 - DNA, 1003 bp, Homo sapiens
  Payload ID: 16685
  Gene Symbol: SLA
  Gene Name: Src-like-adaptor
  Uniprot ID: Q13239
  ENST ID: ENST00000524345
  CDS Start-End: 340-846
agaaagctgctacttcagaaaataagatcatttgctgcgaatggagaacatctcaggcagccctgatgctccaccggactggatagcgacttccttgccgtgctaagtgactacccgtctcctgacatcagccccccgatattccgccgaggggagaaactgcgtgtgatttctgatgaagggggctggtggaaagctatttctcttagcactggtcgagagagttacatccctggaatatgtgtggccagagtttaccatggctggctgtttgagggcctgggcagagacaaggccgaggagctgctgcagctgccagacacaaaggtcggctccttcatgatcagagagagtgagaccaagaaagggttttactcactgtcggtgagacacaggcaggtaaagcattaccgcattttccgtctgcccaacaactggtactacatttccccgaggctcaccttccagtgcctggaggacctggtgaaccactattctgaggtggctgatggcctgtgctgtgtgctcaccacgccctgcctgacacaaagcacggctgccccagcagtgagggcctccagctcacctgtcaccttgcgtcagaagactgtggactggaggagagtgtccagactgcaggaggaccccgagggaacagagaacccgcttggggtagacgagtcccttttcagctatggccttcgagagagcattgcctcttacctgtccctgaccagtgaggacaacacctcctttgatcgaaagaagaaaagcatctccctgatgtatggtggcagcaagagaaagagctcattcttctcatcaccaccttactttgaggactagccaagaacagacacaatggttcatgcccaaaaggaacagaagttccaactattgcctgggatcttgcgaaaagcgaggttccctgatccctgggagcctcacgtattttagaagccaagagaagccacatggagactcaaattcgcatcttctctat

SEQ ID NO: 186298 - DNA, 582 bp, Homo sapiens
  Payload ID: 16685
  Gene Symbol: SLA
  Gene Name: Src-like-adaptor
  ENST ID: ENST00000523610
  CDS Start-End: 462-582
aactttgctgtcattgggaccccctgggtgggccataggtggcctggggtggtatgtgggggagggtcttcagagggacttgatggatcctgtacccaccctccgtctttggtctgaagaaaatgggtgggtctctgctggtgtccttgcagagagaagcttgctcagagtggttactgaaaacaggaacctgcccttctgcaagccctgtgccttcctcgttcctagcagaggaagtatgcggccagtttagcaactgcagttcttctgtgtagcatgggctgcttctccacaaccgcgagaagcccggctgcctgtttattctggagcagcagcagttgacagacggagaggcagtgactctgcacccagcaatccctctgcagacagctcccacaggagtcatgcccagtgtgtgaaggctctgggcatcaccagcggccccagggaaaaagaaagaaatgggaaacagcatgaaatccacccctgcgcctgccgagaggcccctgcccaacccggagggactggatagcgacttccttgccgtgctaagtgactacccgtctcctgacatcagccccc

SEQ ID NO: 186299 - DNA, 896 bp, Homo sapiens
  Payload ID: 16685
  Gene Symbol: SLA
  Gene Name: Src-like-adaptor
  Uniprot ID: Q13239
  ENST ID: ENST00000517648
  CDS Start-End: 50-799
agaaaataagatcatttgctgcgaatggagaacatctcaggcagccctgatgctccaccggctctgggcatcaccagcggccccagggaaaaagaaagaaatgggaaacagcatgaaatccacccctgcgcctgccgagaggcccctgcccaacccggagggactggatagcgacttccttgccgtgctaagtgactacccgtctcctgacatcagccccccgatattccgccgaggggagaaactgcgtgtgatttctgatgaagggggctggtggaaagctatttctcttagcactggtcgagagagttacatccctggaatatgtgtggccagagtttaccatggctggctgtttgagggcctgggcagagacaaggccgaggagctgctgcagctgccagacacaaaggtcggctccttcatgatcagagagagtgagaccaagaaagaggtggctgatggcctgtgctgtgtgctcaccacgccctgcctgacacaaagcacggctgccccagcagtgagggcctccagctcacctgtcaccttgcgtcagaagactgtggactggaggagagtgtccagactgcaggaggaccccgagggaacagagaacccgcttggggtagacgagtcccttttcagctatggccttcgagagagcattgcctcttacctgtccctgaccagtgaggacaacacctcctttgatcgaaagaagaaaagcatctccctgatgtatggtggcagcaagagaaagagctcattcttctcatcaccaccttactttgaggactagccaagaacagacacaatggttcatgcccaaaaggaacagaagttccaactattgcctgggatcttgcgaaaagcgaggttccctgatccctgggagc

SEQ ID NO: 186300 - DNA, 561 bp, Homo sapiens
  Payload ID: 16685
  Gene Symbol: SLA
  Gene Name: Src-like-adaptor
  ENST ID: ENST00000519747
  CDS Start-End: 477-561
aaaataagatcatttgctgcgaatggagaacatctcaggcagccctgatgctccaccgctaaatcccagtttgtggaatatgccttgctcaataaagttttactaaagaaatgacagggaataaattcagagcttcatctgtactagattctttcttgtccttgcagagagaagcttgctcagagtggttactgaaaacaggaacctgcccttctgcaagccctgtgccttcctcgttcctagcagaggaagtatgcggccagtttagcaactgcagttcttctgtgtagcatgggctgcttctccacaaccgcgagaagcccggctgcctgtttattctggagcagcagcagttgacagacggagaggcagtgactctgcacccagcaatccctctgcagacagctcccacaggagtcatgcccagtgtgtgaaggctctgggcatcaccagcggccccagggaaaaagaaagaaatgggaaacagcatgaaatccacccctgcgcctgccgagaggcccctgcccaacccggagggactggatagcgacttccttgccg

SEQ ID NO: 186301 - DNA, 563 bp, Homo sapiens
  Payload ID: 16685
  Gene Symbol: SLA
  Gene Name: Src-like-adaptor
  ENST ID: ENST00000519558
  CDS Start-End: 521-563
aagatcatttgctgcgaatggagaacatctcaggcagccctgatgctccaccgtccttgcagagagaagcttgctcagagtggttactgaaaacaggaacctgcccttctgcaagccctgtgccttcctcgttcctagcagaggaagtatgcggccagtttagcaactgcagttcttctgtgtagcatgggctgcttctccacaaccgcgagaagcccggctgcctgtttattctggagcagcagcagttgacagacggagaggcagtgactctgcacccagcaatccctctgcagacagctcccacaggagtcatgcccagtgtgtgaagcccggacacagcaccttctgtcacggagactgaactctgactggcaagacagaacgggtgggagtgcaagcaacagcagagaagactgttagcgtagaagaacccaggcctctaggactgactcaaactttctcatctcatgaccctgggctctgggcatcaccagcggccccagggaaaaagaaagaaatgggaaacagcatgaaatccacccctgcgcctgccgagaggc

SEQ ID NO: 186302 - DNA, 826 bp, Homo sapiens
  Payload ID: 16685
  Gene Symbol: SLA
  Gene Name: Src-like-adaptor
  ENST ID: ENST00000519341
  CDS Start-End: 553-826
attccccatgacagcgactgatgaagaatttcaatagaaagctgctacttcagaaaataagatcatttgctgcgaatggagaacatctcaggcagccctgatgctccaccgctggaggaggtcacgtgacattcacaggcatccagtcccagggtacctcctgctgcctggccccactgggtttatttgaatagtctgacttgatcaatccacagagccttctaacaattcaagtccttgcagagagaagcttgctcagagtggttactgaaaacaggaacctgcccttctgcaagccctgtgccttcctcgttcctagcagaggaagtatgcggccagtttagcaactgcagttcttctgtgtagcatgggctgcttctccacaaccgcgagaagcccggctgcctgtttattctggagcagcagcagttgacagacggagaggcagtgactctgcacccagcaatccctctgcagacagctcccacaggagtcatgcccagtgtgtgaaggctctgggcatcaccagcggccccagggaaaaagaaagaaatgggaaacagcatgaaatccacccctgcgcctgccgagaggcccctgcccaacccggagggactggatagcgacttccttgccgtgctaagtgactacccgtctcctgacatcagccccccgatattccgccgaggggagaaactgcgtgtgatttctgatgaagggggctggtggaaagctatttctcttagcactggtcgagagagttacatccctggaatatgtgtggccagagtttaccatggctggctgtttgagggcctgggcagag

SEQ ID NO: 186303 - DNA, 577 bp, Homo sapiens
  Payload ID: 16685
  Gene Symbol: SLA
  Gene Name: Src-like-adaptor
  ENST ID: ENST00000522432
  CDS Start-End: 224-391
atgcggccagtttagcaactgcagttcttctgtgtagcatgggctgcttctccacaaccgcgagaagcccggctgcctgtttattctggagcagcagcagttgacagacggagaggcagtgactctgcacccagcaatccctctgcagacagctcccacaggagtcatgcccagtgtgtgaaggctctgggcatcaccagcggccccagggaaaaagaaagaaatgggaaacagcatgaaatccacccctgcgcctgccgagaggcccctgcccaacccggagggggtgaccacacatggttcccagcagcccctgcagcaccgccctgggcggagttcactggcgcagatggctgccctgtctgccgagcctgacagggaagtggactgagccaggttcctgcgctgcctccaggactggatagcgacttccttgccgtgctaagtgactacccgtctcctgacatcagccccccgatattccgccgaggggagaaactgcgtgtgatttctgatgaagggggctggtggaaagctatttctcttagcactggtcgagagagttacatccctggaa

SEQ ID NO: 186304 - DNA, 586 bp, Homo sapiens
  Payload ID: 16685
  Gene Symbol: SLA
  Gene Name: Src-like-adaptor
  ENST ID: ENST00000521302
  CDS Start-End: 441-586
aagatcatttgctgcgaatggagaacatctcaggcagccctgatgctccaccgtccttgcagagagaagcttgctcagagtggttactgaaaacaggaacctgcccttctgcaagccctgtgccttcctcgttcctagcagaggaagtatgcggccagtttagcaactgcagttcttctgtgtagcatgggctgcttctccacaaccgcgagaagcccggctgcctgtttattctggagcagcagcagttgacagacggagaggcagtgactctgcacccagcaatccctctgcagacagctcccacaggagtcatgcccagtgtgtgaagaacaggaaaccaaggtccaagttcacacaaaggaaataacattggtccaaagaccggagggaaaataaggctctgggcatcaccagcggccccagggaaaaagaaagaaatgggaaacagcatgaaatccacccctgcgcctgccgagaggcccctgcccaacccggagggactggatagcgacttccttgccgtgctaagtgactacccgtctcctgacatcagccccccgatattccgccgaggggagaaact

SEQ ID NO: 186305 - DNA, 594 bp, Homo sapiens
  Payload ID: 16685
  Gene Symbol: SLA
  Gene Name: Src-like-adaptor
  ENST ID: ENST00000522119
  CDS Start-End: 119-594
gtcttcagagggacttgatggatcctgtacccaccctccgtctttggtctgaagaaaatgggtgggtctctgctggtggctctgggcatcaccagcggccccagggaaaaagaaagaaatgggaaacagcatgaaatccacccctgcgcctgccgagaggcccctgcccaacccggagggactggatagcgacttccttgccgtgctaagtgactacccgtctcctgacatcagccccccgatattccgccgaggggagaaactgcgtgtgatttctgatgaagggggctggtggaaagctatttctcttagcactggtcgagagagttacatccctggaatatgtgtggccagagtttaccatggctggctgtttgagggcctgggcagagacaaggccgaggagctgctgcagctgccagacacaaaggtcggctccttcatgatcagagagagtgagaccaagaaagggttttactcactgtcggtgagacacaggcaggtaaagcattaccgcattttccgtctgcccaacaactggtactacatttccccgaggctcaccttccagtgcctggaggacctggtgaacca

SEQ ID NO: 186306 - DNA, 2757 bp, Homo sapiens
  Payload ID: 16686
  Gene Symbol: SLA2
  Gene Name: Src-like-adaptor 2
  Uniprot ID: Q9H6Q3
  ENST ID: ENST00000262866
  CDS Start-End: 424-1209
gtgagaaccacagagtctgcagtcggagctagagctccaaggaccccacgcctgtgtctctgtgacagagctcaaagggccctgggccttccctccctggctcggctgtgcttgggagggttccccagtccagaatccctaaggagcatggggcagctgatccatccctggtgtacaaactgctgactgcagacagatgctgagctacccaaaccaacacctagcctctccctgaagatcctcccaggctgagagagttctgggtgtcctaggaccaaggacactggcagacttccagaagggcccccaaagccctaacctgtccagccagagcatgcgtctcagcagagctgtcttcccaagcctttgatgacaaaccaatttccctcgatgatgtgcttctgagtgctctgctgaggaacaatgggaagtctgcccagcagaagaaaatctctgccaagcccaagcttgagttcctctgtccaaggccagggacctgtgaccatggaagcagagagaagcaaggccacagccgtggccctgggcagtttcccggcaggtggcccggccgagctgtcgctgagactcggggagccattgaccatcgtctctgaggatggagactggtggacggtgctgtctgaagtctcaggcagagagtataacatccccagcgtccacgtggccaaagtctcccatgggtggctgtatgagggcctgagcagggagaaagcagaggaactgctgttgttacctgggaaccctggaggggccttcctcatccgggagagccagaccaggagaggctcttactctctgtcagtccgcctcagccgccctgcatcctgggaccggatcagacactacaggatccactgccttgacaatggctggctgtacatctcaccgcgcctcaccttcccctcactccaggccctggtggaccattactctgagctggcggatgacatctgctgcctactcaaggagccctgtgtcctgcagagggctggcccgctccctggcaaggatatacccctacctgtgactgtgcagaggacaccactcaactggaaagagctggacagctccctcctgttttctgaagctgccacaggggaggagtctcttctcagtgagggtctccgggagtccctcagcttctacatcagcctgaatgacgaggctgtctctttggatgatgcctaggcccaaaggagaggccaaaagggaaaccaaggctgcacacctagaaccccaattcagcctcctgggcaccccagaggcaaggctgtgcactcagggagggagggtgggacacagaggtgcatctagggtcccacctgtacccttgctctttcctctcttagcccttagaagtcacctacttccttccagtgccatgatcccacctgcgacctctagtgcgagtgcagagaaggtgggaccagggccagggttccaaaaagagaataagcctcctggggggtctgacctagttagttcttgagtttggggtttccagtaccatctggatgccctgcctgttgagccccattctacatccccaccattaaccaggccccacccacaaggtagaaacaacccctagagtcaacgagaaagtcattttcagaaaatctacaagtctcgttgagaccaccaccatacctcagaaggtaggactgtggcctagaagggaaaggaaagctgagatgatgtcttaccgtagcagcagatcttggatggtccaggctctatgtgacctccagagcaaagagaaagacttcggacagtctaggtcctcaaatgtcccccattgaggacaacagccccagctctttttcttttttttgagacggagtcttgccctgttgcccatgctggagtgcaatggcacgatctcagctcactgcaacctccatctcctggattcaaacaattctcctgcctcagcctccagaatagctgggattacaggcgtacaccaccatgcctggctaatttttttgtatttttagtagacatggggtttcaccacattggccaggctggtgtcgaactcctgacctcaggtgatccacccaccttggcctcccaaagtgctgggattacaggtgtgagccacggcacccagcctagctctcagatctctatttcattttgtggcttaccattccctagcacactggccttgccatcttgtggccgaataaaaaataacacctcttaagtctagcacactgcagtgaggccaggcacctcagtgctgggcaggggcatcagaaggtgctaagccctctctccacaatgccaagacggagaccacagcctacaccaaatccagcccttgatttccctgctgcctccataaacagaaagaggtctgctggatccgctaagggatcagggagaggaagaaagagggatggggtgggaggcaccccctccagtgctcctactggttcccaagctacaggtggggtgggaaaggctttatcaggtatcatcaacaggttctcaattaaagatttgatttattcaagtatgtgaaaacattctacaatggaaactcttattagatgctgcatgtactgtgctatggaccacgcacatacagccatgctgtttcagaagacttgaaatgccattgatagtttaaaaactctacacccgatggagaatcgaggaagacaatttaatgtttcatctgaatccagaggtgcatcaaattaaatgacagctccacttggcaaa

SEQ ID NO: 186307 - DNA, 2171 bp, Homo sapiens
  Payload ID: 16686
  Gene Symbol: SLA2
  Gene Name: Src-like-adaptor 2
  Uniprot ID: Q9H6Q3
  ENST ID: ENST00000360672
  CDS Start-End: 89-721
tgcgtctcagcagagctgtcttcccaagcctttgatgacaaaccaatttccctcgatgatgtgcttctgagtgctctgctgaggaacaatgggaagtctgcccagcagaagaaaatctctgccaagcccaagcttgagttcctctgtccaaggccagggacctgtgaccatggaagcagagagaagcaaggccacagccgtggccctgggcagtttcccggcaggtggcccggccgagctgtcgctgagactcggggagccattgaccatcgtctctgaggatggagactggtggacggtgctgtctgaagtctcaggcagagagtataacatccccagcgtccacgtggccaaagtctcccatgggtggctgtatgagggcctgagcagggagaaagcagaggaactgctgttgttacctgggaaccctggaggggccttcctcatccgggagagccagaccaggagaggctcttactctctgtcagtccgcctcagccgccctgcatcctgggaccggatcagacactacaggatccactgccttgacaatggctggctgtacatctcaccgcgcctcaccttcccctcactccaggccctggtggaccattactctgagggctggcccgctccctggcaaggatatacccctacctgtgactgtgcagaggacaccactcaactggaaagagctggacagctccctcctgttttctgaagctgccacaggggaggagtctcttctcagtgagggtctccgggagtccctcagcttctacatcagcctgaatgacgaggctgtctctttggatgatgcctaggcccaaaggagaggccaaaagggaaaccaaggctgcacacctagaaccccaattcagcctcctgggcaccccagaggcaaggctgtgcactcagggagggagggtgggacacagaggtgcatctagggtcccacctgtacccttgctctttcctctcttagcccttagaagtcacctacttccttccagtgccatgatcccacctgcgacctctagtgcgagtgcagagaaggtgggaccagggccagggttccaaaaagagaataagcctcctggggggtctgacctagttagttcttgagtttggggtttccagtaccatctggatgccctgcctgttgagccccattctacatccccaccattaaccaggccccacccacaaggtagaaacaacccctagagtcaacgagaaagtcattttcagaaaatctacaagtctcgttgagaccaccaccatacctcagaaggtaggactgtggcctagaagggaaaggaaagctgagatgatgtcttaccgtagcagcagatcttggatggtccaggctctatgtgacctccagagcaaagagaaagacttcggacagtctaggtcctcaaatgtcccccattgaggacaacagccccagctctttttcttttttttgagacggagtcttgccctgttgcccatgctggagtgcaatggcacgatctcagctcactgcaacctccatctcctggattcaaacaattctcctgcctcagcctccagaatagctgggattacaggcgtacaccaccatgcctggctaatttttttgtatttttagtagacatggggtttcaccacattggccaggctggtgtcgaactcctgacctcaggtgatccacccaccttggcctcccaaagtgctgggattacaggtgtgagccacggcacccagcctagctctcagatctctatttcattttgtggcttaccattccctagcacactggccttgccatcttgtggccgaataaaaaataacacctcttaagtctagcacactgcagtgaggccaggcacctcagtgctgggcaggggcatcagaaggtgctaagccctctctccacaatgccaagacggagaccacagcctacaccaaatccagcccttgatttccctgctgcctccataaacagaaagaggtctgctggatccgctaagggatcagggagaggaagaaagagggatggggtgggaggcaccccctccagtgctcctactggttcccaagctacaggtggggtgggaaaggctttatcaggtatcatcaacaggttctcaattaaagatttgatttattcaagtatgtgaaaa

SEQ ID NO: 186308 - DNA, 1516 bp, Homo sapiens
  Payload ID: 16687
  Gene Symbol: SRMS
  Gene Name: src-related kinase lacking C-terminal regulatory tyrosine and N-terminal myristylation sites
  Uniprot ID: Q9H3Y6
  ENST ID: ENST00000217188
  CDS Start-End: 42-1508
ggctcccatggccctcgggcccagcgtggtgaccccgggggatggagccgttcctcaggaggcggctggccttcctgtccttcttctgggacaagatctggccggcgggcggcgagccggaccatggcacccccgggtccctggaccccaacactgacccagtgcccacgctccccgccgagccttgcagccccttccctcagctcttccttgcgctctatgacttcacggcgcggtgtggcggggagctgagtgtccgccgcggggacaggctctgtgccctcgaagaggggggcggctacatcttcgcacgcaggctttcgggccagcccagcgccgggctcgtgcccatcacccacgtggccaaggcttctcctgagacgctctcagaccaaccctggtactttagcggggtcagtcggacccaggcacagcagctgctcctctccccacccaacgaaccaggggccttcctcatccggcccagcgagagcagcctcgggggctactcactgtcagtccgggcccaggccaaggtctgccactaccgggtctccatggcagctgatggcagcctctacctgcagaagggacggctctttcccggcctggaggagctgctcacctactacaaggccaactggaagctgatccagaaccccctgctgcagccctgcatgccccagaaggccccgaggcaggacgtgtgggagcggccacactccgaattcgcccttgggaggaagctgggtgaaggctactttggggaggtgtgggaaggcctgtggctgggctccctgcccgtggcgatcaaggtcatcaagtcagccaacatgaagctcactgacctcgccaaggagatccagacactgaagggcctgcggcacgagcggctcatccggctgcacgcagtgtgctcgggcggggagcctgtgtacatcgtcacggaactcatgcgcaaggggaacctgcaggccttcctgggcacccccgagggccgggccctgcgtctgccgccactcctgggctttgcctgccaggtggctgagggcatgagctacctggaggagcagcgcgttgtgcaccgggacttggccgcccggaacgtgctcgtggacgacggcctggcctgcaaggtggctgacttcggcctggcccggctgctcaaggacgacatctactccccgagcagcagctccaagatcccggtcaagtggacagcgcctgaggcggccaattatcgtgtcttctcccagaagtcagacgtctggtccttcggcgtcctgctgcacgaggttttcacctatggccagtgtccctatgaagggatgaccaaccacgagacgctgcagcagatcatgcgagggtaccggctgccgcgcccggctgcctgcccggcggaggtctacgtgctcatgctggagtgctggaggagcagccccgaggaacggccctccttcgccacgctgcgggagaagctgcacgccatccacagatgccacccctgagtcctcac

SEQ ID NO: 186309 - DNA, 4394 bp, Homo sapiens
  Payload ID: 16688
  Gene Symbol: SCAP
  Gene Name: SREBF chaperone
  Uniprot ID: Q12770
  ENST ID: ENST00000265565
  CDS Start-End: 414-4253
acgctccgcccggcccggcccggcccggccgtccatacttccctccggtgtccaccagagggcgaacgggagacgcgaatgtggttcgactacgcatgcgcacgccgctgggcgcacgtgcggagggcggcggggcgggagggtaaaggtaggaggtgagaggtgaaggggcgggcacccggcggccaggagagagagggagggcgccacgcaccggactgcgggccgagagcgcgcacgccgcgctccgcccctgctgccgcccccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtggtatgtgggtgccccggtggcttatgtccagcagatatttgtgaagtcctcagtgtttccctggcacaagaacctcctggcagtagatgtatttcgttcacctttgtcccgggcattccaactggtggaggagatccggaaccacgtgctgagagacagctctgggatcaggagcttggaggagttgtgtctgcaagtgaccgacctgctgccaggccttaggaagctcaggaacctactccctgagcatggatgcctgctgctgtcccctgggaacttctggcagaatgactgggaacgcttccatgctgatcctgacatcattgggaccatccaccagcacgagcctaaaaccctgcagacttcagccacactcaaagacttgttatttggtgttcctgggaagtacagcggggtgagcctctacaccaggaagaggatggtctcctacaccatcaccctggtcttccagcactaccatgccaagttcctgggcagcctgcgtgcccgcctgatgcttctgcaccccagccccaactgcagccttcgggcggagagcctggtccacgtgcacttcaaggaggagattggtgtcgctgagctcatcccccttgtgaccacctacatcatcttgtttgcctacatctacttctccacgcggaagatcgacatggtcaagtccaagtgggggctggccctggctgccgtggtcacagtgctcagctcgctgctcatgtctgtgggactctgcacactcttcggcctgacgcccaccctcaatggcggcgagattttcccctaccttgtggtggttattgggttagagaatgtgttggtgctcaccaagtctgtggtctcaaccccggtagacctggaggtgaagctgcggatcgcccaaggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtgggacagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacgtctgcgtgtgggacgcgcagaccggggattgcctaacgcgcattccgcgcccaggcaggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaacc

SEQ ID NO: 186310 - DNA, 3430 bp, Homo sapiens
  Payload ID: 16688
  Gene Symbol: SCAP
  Gene Name: SREBF chaperone
  ENST ID: ENST00000320017
  CDS Start-End: 238-735
acccggcggccaggagagagagggagggcgccacgcaccggactgcgggccgagagcgcgcacgccgcgctccgcccctgctgccgcccccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtggcgagattttcccctaccttgtggtggttattgggttagagaatgtgttggtgctcaccaagtctgtggtctcaaccccggtagacctggaggtgaagctgcggatcgcccaaggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtgggacagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacgtctgcgtgtgggacgcgcagaccggggattgcctaacgcgcattccgcgcccagggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaacc

SEQ ID NO: 186311 - DNA, 3749 bp, Homo sapiens
  Payload ID: 16688
  Gene Symbol: SCAP
  Gene Name: SREBF chaperone
  ENST ID: ENST00000428413
  CDS Start-End: 1177-2235
agaggtgaaggggcgggcacccggcggccaggagagagagggagggcgccacgcaccggactgcgggccgagagcgcgcacgccgcgctccgcccctgctgccgcccccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtggtatgtgggtgccccggtggcttatgtccagcagatatttgtgaagtcctcagtgtttccctggcacaagaacctcctggcagtagatgtatttcgttcacctttgtcccgggcattccaactggtggaggagatccggaaccacgtgctgagagacagctctgggatcaggagcttggaggagttgtgtctgcaagtgaccgacctgctgccaggccttaggaagctcaggaacctactccctgagcatggatgcctgctgctgtcccctgggaacttctggcagaatgactgggaacgcttccatgctgatcctgacatcattgggaccatccaccagcacgagcctaaaaccctgcagacttcagccacactcaaagacttgttatttggtgttcctgggaagtacagcggggtgagcctctacaccaggaagaggatggtctcctacaccatcaccctggtcttccagcactaccatgccaagttcctgggcagcctgcgtgcccgcctgatgcttctgcaccccagccccaactgcagccttcgggcggagagcctggtccacgtgcacttcaaggaggagattggtgtcgctgagctcatcccccttgtgaccacctacatcatcttgtttgcctacatctacttctccacgcggaagatcgacatggtcaagtccaagtgggggctggccctggctgccgtggtcacagtgctcagctcgctgctcatgtctgtgggactctgcacactcttcggcctgacgcccaccctcaatggcggcgagattttcccctaccttgtggtggttattgggttagagaatgtgttggtgctcaccaagtctgtggtctcaaccccggtagacctggaggtgaagctgcggatcgcccaaggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtgggacagccaacgcgctacgagcggcagctggctgtgaggccgtccacaccccacaccatcacgttgcagccgtcttccttccgaaacctgcggctccccaagaggctgcgtgttgtctacttcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacgtctgcgtgtgggacgcgcagaccggggattgcctaacgcgcattccgcgcccaggcaggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaaccatatcatcatctgtcaggc

SEQ ID NO: 186312 - DNA, 683 bp, Homo sapiens
  Payload ID: 16688
  Gene Symbol: SCAP
  Gene Name: SREBF chaperone
  ENST ID: ENST00000416847
  CDS Start-End: 274-683
gtgtccctgcaccggccggcccctggagctccgcgtccccaccagacctccgcgggcccctggtgtgacggggggagatgcgcggcgtcgcatcccctggcctagttgctccgggaagctgttgtagaacctgctttggtgctgtttgggttttccggagtgcgggggagagcaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtggtatgtgggtgccccggtggcttatgtccagcagatatttgtgaagtcctcagtgtttccctggcacaagaacctcctggcagtagatgtatttcgttcacctttgtcccgggcattccaactggtggaggagatccggaaccacgtgctgagagacag

SEQ ID NO: 186313 - DNA, 1222 bp, Homo sapiens
  Payload ID: 16688
  Gene Symbol: SCAP
  Gene Name: SREBF chaperone
  ENST ID: ENST00000416208
  CDS Start-End: 238-495
acccggcggccaggagagagagggagggcgccacgcaccggactgcgggccgagagcgcgcacgccgcgctccgcccctgctgccgcccccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtgggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtgggacagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaatt

SEQ ID NO: 186314 - DNA, 550 bp, Homo sapiens
  Payload ID: 16688
  Gene Symbol: SCAP
  Gene Name: SREBF chaperone
  ENST ID: ENST00000448217
  CDS Start-End: 287-550
agagtccggtgggaactgggttttaggaggaggtatctgaagaatgtgtagtgggtcgggggctggtgcggtcagaagggccacctctaatttctgccttgcattggtgactagatctgcactttctggaactcccagagaagtttgctggtgcctttgagggcaggtacagggcctgccttatccaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtgggtgggtactcgt

SEQ ID NO: 186315 - DNA, 3748 bp, Homo sapiens
  Payload ID: 16688
  Gene Symbol: SCAP
  Gene Name: SREBF chaperone
  ENST ID: ENST00000441517
  CDS Start-End: 256-621
agaggtgaaggggcgggcacccggcggccaggagagagagggagggcgccacgcaccggactgcgggccgagagcgcgcacgccgcgctccgcccctgctgccgcccccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtgggttcctgggcagcctgcgtgcccgcctgatgcttctgcaccccagccccaactgcagccttcgggcggagagcctggtccacgtgcacttcaaggaggagattggtgtcgctgagctcatcccccttgtgaccacctacatcatcttgtttgcctacatctacttctccacgcggaagatcgacatggtcaagtccaagtgggggctggccctggctgccgtggtcacagtgctcagctcgctgctcatgtctgtgggactctgcacactcttcggcctgacgcccaccctcaatggcggcgagattttcccctaccttgtggtggttattgggttagagaatgtgttggtgctcaccaagtctgtggtctcaaccccggtagacctggaggtgaagctgcggatcgcccaaggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtgggacagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacgtctgcgtgtgggacgcgcagaccggggattgcctaacgcgcattccgcgcccagggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaacc

SEQ ID NO: 186316 - DNA, 706 bp, Homo sapiens
  Payload ID: 16688
  Gene Symbol: SCAP
  Gene Name: SREBF chaperone
  ENST ID: ENST00000495603
  CDS Start-End: 310-706
agagagagagagagagagagagagagtgtgtgtgtgtgtgtgtgtgtgtgtgtgtgtgtgtgtgtgtgtattttgggattgaggtcactagaccttgcatataggcattctgaaaccattccccagccacataactatcgcctccctccagcagccctagtgtgcagagccaagtactctttgttaactggcttttctcccttcttaccaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtggtatgtgggtgccccggtggcttatgtccagcagatatttgtgaagtcctcagtgtttccctggcacaagaacctcctggcagtagatgtatttcgttcacctttgtcccgggcattccaactggtggaggagatccggaaccacg

SEQ ID NO: 186317 - DNA, 2950 bp, Homo sapiens
  Payload ID: 16688
  Gene Symbol: SCAP
  Gene Name: SREBF chaperone
  ENST ID: ENST00000545718
  CDS Start-End: 100-2817
ggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtgggacagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacgtctgcgtgtgggacgcgcagaccggggattgcctaacgcgcattccgcgcccagggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaactttttt

SEQ ID NO: 186318 - DNA, 6876 bp, Homo sapiens
  Payload ID: 16689
  Gene Symbol: SREK1IP1
  Gene Name: SREK1-interacting protein 1
  Uniprot ID: Q8N9Q2
  ENST ID: ENST00000513458
  CDS Start-End: 169-636
tggttctgccgtcgctagaggcgtacaggcccttcccgaccgtagcgagggtgctgctgcgctgggggaaggaaaacgccgctttgactgtgccttgttctcacagctggcgggaagcaagcgccttttcgaaagccagaggctcgagttacccctcttaccaccgtcatggcagtcccaggttgcaacaaggacagtgtcagagcaggctgtaaaaaatgtggctaccctggtcacctgacttttgaatgccgcaattttctccgagtagaccctaaaagggacatagttttggatgtcagcagtacaagtagtgaagatagcgatgaagagaatgaagaactgaataaattgcaggcattacaggaaaaaagaataaatgaagaagaggaaaagaagaaagaaaaaagcaaagaaaaaatcaaattgaaaaaaaaaaggaaaaggtcttactcatccagttccactgaagaggacacttcaaaacaaaagaaacaaaaatatcagaagaaagaaaagaaaaaagaaaaaaagagtaaatcaaaaaaagggaaacatcacaaaaaggaaaaaaagaagagaaaaaaggaaaagcattcttctacacctaatagttctgaattctccagaaagtaactgagactttggcttaagccgttaaatttaaaaatttgtttttaaaacgtgtttgcccttccttggaatttgctatatattatgctttgcaataaatcacagccttttccatatagacatttttcgtatttgggaccattatccctctggcaatatatttttaatgtgctgtaactgtaaagtattaaatcagtcttgttacttgatagccatgccccaagtatagctatttgtgtatactaaacacatcatttttggtatttgtgtctctgtgtgtttggctagtgttactacttcataagttcattgtaaaatggctttactgccatcaacatgggtcatctacctagcagttaatgagtattgctggatcaggtgtccaccttccaatgatgaagcaaggtaaggggtaatgttttgctcttgacacagagaaatttaatagctttatgtactaaaatataatatcttttaaagatagtgaaattcttcagttttttaaatctctagggattttttttcaatgttgtagaagatgcagctgcttaatggtcttgactaggactttttaaatgaatggtgtctgcaggtagatgatcatgaaaatatctctaacaaagttttactcttctatgaaatgcagaatttctagtacctgcctcctttgtttttgtaataattaaaatacttcttgtataaagagattagttcagcctgttagtaagtctgcagagatgatgctgagttggttgtgatttttagaatagactcctgggttgttttacaaatgtgccatattggcatgtcttacagtgatacctcaaacacagaaatttttatttaggaagatagctaaatctttattagaactgatttttattgtattcagtataaattttatgaagcttgtttctatgagtactgtggaaaattttataaatgtgagcatatatatttattttgtctgacataatttgtagttttaaagcaagtttcacactgaacttaacgttttcataaatgaccagtttgggatgtttctctcttttactttagtggcaaactcaagagtaaaaagtgtcaaaaaaagaattgagaattttattctgtactttttaaaatttaagagccagggagttgcatcatgaaagcctttgtataataatggaaattttatatgggtaagcattttcaaacacatattagtagatacgttttttaaatttctattttcacattgatcagtgttactttgcttaatacttaggtagcccttatgtccactaaagtaaatgcttatgttgtagaagcatcgaacatcaaccaatgtcatggcacagcaccaaagattgcaaatacctcactatggtgcgcttagaaattttcaaattgataacctatagatacggctgcaggtgaattcatgatagtgaaatcagctaagtatacttaacctcacaggctagaaaggtttactgattcttgtttcacctggcacccaatgtggataccctcagtaagactcagggagccttataactcctcttaacatatgcttacccatgcttaaattctagggaagctgtatccacagccctctgcattgcagccatgagagctctcacgctttcaacccttccataacctaatttagtcatttgggcctctcaaaaggaaatgcttttgtttaaataggtcagtcagttactgggagaaaaaatacagagccagtaggtttttagggatttgttttgcctttgctgctagttttttgaaaatattcttcgattatcaagattttaaaaatcggtttttaatataaagcttttttaaaaacgaggctggcacaagtgcagtggtgtttctttactcccactgcttgacttgactagccttgaaaaaataacagtaaaataaaatattaaaaaataattagaaaatgctacaaaggcaatgaccttattccattgagtaagatagttaaaaatgatagtaattgtagtgaaatagttaattacttgtaagttttattactgttaattgtagagattataaattggctcattaggtttctgaatggtgacacaataatgactgagaagagcaaaagtcagtcctcgttaactaatgtagtatgcaaattaaaatattttaatgatcagtaattttccccccagaaatgatgttggcatttctaagtaaatttcccataattttagcatagtttatgaaattgaataaaaatttattttcactgaagtaattttcttctaatatgatattattattgagattggatgcaaatctcatgaatatgttttagaagaaaattaatgaaattccctcccaggcagtatgtaccagaaggaaaactgaatttagcagtaaaacagtcctggtcattctaactacctgtatgatcttgaacaaagtcacttagtttccctgggccttggtgtctttcgtctataaaatattgtaccagattatctctgaaatcacttcaaggtttaatatatataattatcaatattttaaaattcaagcaatattcactttagaaattattataacattctataatagtaaaggttgaatttattaatataataaacacgttcaacttcttcaagcagataattgatatttggttcatattcttacaacctaatgcatgtcattttcaccaaatgcaggcagaatttatatttaggtttgcatctggaactagattatctggcactttatggccattatttttgggttgatggaccttctcaccacacaatttcccccttttttttttttgcatatcatatgttggttgatatttctcagaggtatccctatttcttcatacttaatatacatctccatttacatctttgactctctgaggtcaaaacaacaataaatgagaagtaaaacaactatatgtgtttgtatttacaactgtatctaaaattatataaccctagtttaccttcagagtaaactaggctgaagagttgttaataatgttgataaaaatgccattgaatcctttcttcaacaaatatttattgagtacctaacgtggcaaacgctgtgctaagtactggggatacagagataagtaagacacatttgcctccctgaaggacttcacagtgtagttggtaggagaaacaccagagcatacaccgttatataattagtgcagtaattgacatgaacatgagtttatagaaactcggggttacctaaagtagtctggataaattagaagaggctacctagagaaagtagtgactgaattgcaatttgattaaggataagaatgagggttatggcagttcctgacagagtgggtactgtgaacaaacaccagaggtagaacaagctgtgttatgtgtttgtcaagaattacaagcaatctggtgttgctggtgtatcataggcgaggcaggaagtggtaagaattgagactaccattttaagttcttaggaacaggaggaaggagtcgtgtgttccgtgtttgggagcttgaactgtaatgtgtaagcaatgagacaccattaaagagtttcaaggggggccgggcacagtggctcacgcctgtaatcccagcactttgggaggctgaggcgggcggatcacctgaggtcaggagttcaagaccagcctggccaacttggcgaaaccctgtctctactaaaaatagaaaaattagccggacgtggtgacaggcacctgtattcccagctactctggagtctggggcaggagaatcgctcaaacccaggaggtggaagttgcagtaagctgagatcacaccactgtactccagcctgggcgacagagcgagactctatctcaaaaaaaaaaaaagattttaaggaaggaaatgacttttattagggtttggttttatcaatttcataatccgattaatcccaccatttttaaaagatgaaattgctttcattagaaggctacataaaatataatttgattattttaggctctattattagactcacatttctttctacagtctcattattatttccaaaaattacacagtaacctaaatcatctaaaaacacataaagctactgtattctttattagatccatccccagagttatatgtacatgtacatactttgagatgtgttttgttcttaattgtattttaggttatttttgactgacttaaattctatcactattttaatatttgttaggtccgaataaaccatttagaatatttttcagtgtacaaaatgtgctgtaatttaataaggccccttgcttttaaaatttggcttaacctgtgaagcacaactgcttcagagttacagagaaacataccagttggtccactggatgagccctgtggttctacctcaggtaacctagtgataagctagctcagcagggagtgcttcaaggactccagctgatcctagtgctgagaccaaaacttcctggacattgggtgcccaagaacagtaggtttcttataccagtgtgacaataatcccagttgcgaaggccagtcttctgatctcagtatctcctcccaactcctctaaaaataggtagagtggcagagaattggggtgcctcttctatagcacaacccatgatgcatccagtcatgcctgaccccactatgcctttcccacaaattgggaggagttggggcagtgagcattttgctagctctgtctgtttcttgcttcttgtgccatttatagtccttggccatgagcaacaaaagtagaatggtgccagtgccttaactaaatttttctcaacctagattttcacctgagacaatatggtaatattattaaattactgtaaagatagcaaattttctgggatactttaaaatcaaagttgtatcaaagatcaagaagcacccataaaagctttataaactttcacaaaaaataagtgaaaattctttgtttttatggccgtgtaaaatgtcatttttataatggaaatgtcttaattttcaaacttaacatatactttaagcaattttagtatttaaacctttgcaaaattgtatttttgaatgtgaagttcaactttggcagtaggttgttgcaatagtgatctggcactatggtgccagtatagccacatagggttatttaaattaattaaataaatgaaaaattttattttttcagttgcattagccacatcttaagtgttcagtagccacatgtgactggtggctaccatattagtgcagatatagaaagaacatttccatcatcacagaaacttctcttaattctggtctagaagataaccttagtacttggtagaaattttgacaggctaatgacgaaaagtttgtaaccctgagctttgcatgcccaagaaaaataaggtattcttttttatatatcagaccagagaagctgtattcagcacattttgaaatgctagtttttggctatggccataccaccctaaatgtgccagatcttgtctgaaatgctagtttctgactacaaaaactacaggacatagtagatatgctcagtagagctgcttaaaataattccctttttttttctgttgaattctgttacaaaaccaggtctgtgttataatagaaaacacacttatgaataaaaatctttaaaaattataatttgcagaaattagttttatttctagatttctaggtggtattaatgtgatagcattaggtgggaccagagaactcatttgttttgtagctttcattatacagattatttaggaaatatatcagcaaaggattttttgttatgcttatctcttgaaacaaaatatttattgtacagattatacattgtgatttttttgttactgagtatattgtttgtgcccagaaaaatctaaaaagatgtgggttgacttctaagagatttaagaacaagtcacctctagtttttaagacagttcccttgatatttacctatccagtaccatctcataagaataactgcctgtaagtatcagaaagttgagaaatgctggtaatgtgacataaacttctcactgttcttcactgagataggactgcttatcttgttattgataaattatttaatttctcctgaataattagcataatctcatgtgatacagaaacatcttaattagcaaataaatttatacaaaggaaaaccaataaaaccttaatgtgcgtttaataaagtaactgaatgatcaaaaatgca

SEQ ID NO: 186319 - DNA, 1617 bp, Homo sapiens
  Payload ID: 16689
  Gene Symbol: SREK1IP1
  Gene Name: SREK1-interacting protein 1
  ENST ID: ENST00000622404
  CDS Start-End: 83-379
actgtgccttgttctcacagctggcgggaagcaagcgccttttcgaaagccagaggctcgagttacccctcttaccaccgtcatggcagtcccaggttgcaacaaggacagtgtcagagcaggctgtaaaaaatgtggctaccctggtcacctgacttttgaatgccgcaattttctccgagtagaccctaaaagggacatagttttggatgtcagcagtacaagtagtgaagatagcgatgaagagaatgaagaactgaataaattgcaggcattacaggaaaaaagaataaatgaagaagaggaaaagaagaaaaagcaaagaaaaaatcaaattgaaaaaaaaaaggaaaaggtcttactcatccagttccactgaagaggacacttcaaaacaaaagaaacaaaaatatcagaagaaagaaaagaaaaaagaaaaaaagagtaaatcaaaaaaagggaaacatcacaaaaaggaaaaaaagaagagaaaaaaggaaaagcattcttctacacctaatagttctgaattctccagaaagtaactgagactttggcttaagccgttaaatttaaaaatttgtttttaaaacgtgtttgcccttccttggaatttgctatatattatgctttgcaataaatcacagccttttccatatagacatttttcgtatttgggaccattatccctctggcaatatatttttaatgtgctgtaactgtaaagtattaaatcagtcttgttacttgatagccatgccccaagtatagctatttgtgtatactaaacacatcatttttggtatttgtgtctctgtgtgtttggctagtgttactacttcataagttcattgtaaaatggctttactgccatcaacatgggtcatctacctagcagttaatgagtattgctggatcaggtgtccaccttccaatgatgaagcaaggtaaggggtaatgttttgctcttgacacagagaaatttaatagctttatgtactaaaatataatatcttttaaagatagtgaaattcttcagttttttaaatctctagggattttttttcaatgttgtagaagatgcagctgcttaatggtcttgactaggactttttaaatgaatggtgtctgcaggtagatgatcatgaaaatatctctaacaaagttttactcttctatgaaatgcagaatttctagtacctgcctcctttgtttttgtaataattaaaatacttcttgtataaagagattagttcagcctgttagtaagtctgcagagatgatgctgagttggttgtgatttttagaatagactcctgggttgttttacaaatgtgccatattggcatgtcttacagtgatacctcaaacacagaaatttttatttaggaagatagctaaatctttattagaactgatttttattgtattcagtataaattttatgaagcttgtttctatgagtactgtggaaaattttataaatgtgagcatatatatttattttgtctgacataatttgtagttttaaagcaagtttcacactgaacttaacgttttcataaatgaccagtttgggatgtttctctcttttactttagtggcaaactcaagagt

SEQ ID NO: 186320 - DNA, 4020 bp, Homo sapiens
  Payload ID: 16690
  Gene Symbol: SRRD
  Gene Name: SRR1 domain containing
  Uniprot ID: Q9UH36
  ENST ID: ENST00000215917
  CDS Start-End: 15-1034
gacgtcagagaccaatggctgcggccgcagctgcggcgctggaatcctggcaggcggcggctccgcggaagaggcgctccgcggctcgacggccgcggcggagggaggcggcgccccgggggagagaggcggcgccccgggggagagaggcggcgccccggggccccgaggcggagttcgagtctgacagcggagtcgtgcttcgtcgcatctgggaggctgagaaggacctgtttatctctgatttctggagttcagcactagaaaccatcaatagatgtctcacaaaacatctggaacaactgaaggcccctgtggggactctttcagacatctttggaaacctgcatcttgactcattgccagaggagtcagatgtggccactgattctatcccaagagagatcttggtcacaggaacctgccatttgaagtgtgtgtgttacggcattgggaactttgccacctgcatcgtagctagaaaccagctaacgtttttgctgcttttgttggaaaagtgccagattcccagaagtcactgttgggtatatgaccctctgtttagccaacttgaaattgaagtccttaacacccttggtgtgactgttctcagtgagaacgaggaagggaaacggagtattcgcggggagcctaccatcttttacatgctccattgtgggacggccttgtacaacaatcttttatggagtaactggtcagtagatgccctttctaagatggtcatcattgggaacagtttcaaaggacttgaggagaggttgttggcaaggattctgcagaaaaattatccctacattgcaaagattttaaaaggactggaggagcttgagtttcctcagacttcacaatacatggacatatttaatgatacctctgtccactggttccctgtgcaaaagctagaacagctctccatagatatttgggagtttcgggaagaaccagattatcaggactgtgaggaccttgaaatcatcaggaacaagagagaagatccttctgctactgactgaactcgttgtgaggtactcagtgttggctgaggtagaagctgccaccagagactaaagggaaggctgctatggaggaactacagagaactcctttgccaggaaagaacatcaacttggctgtcctgttttgaggacgataccccacatgaggacttggtataaagattcctgccctacgtggcattgtcccattttacatccttccctcatgacctggcctgatgtggagtagctcctgagtaaagaagttacccttttgaaggtgatctaaaaatactgtttatttacagtacatccctcttaggggcaagtctctgactggttctggacctgccacagttcacttggccatgtcgatcaggctctgcagtgaggtgggcacccacgtcttctcgccctggacaaagaccactccccggtcgatgtagatcacaatgcggccaaaggtgtagagctgcttcccttcgtgtcgcttcccaatgacgggcatgaagacaatgttgtgctcctcagccttggtctcaatgaggtccttaaagttcatgggcacagagctagcggccacgccaatgcccctctgagccatgttctcagcctcccgcctctcctgcatggcctcgtactggaagtccttcctccgctccgtgtgggtgagataggcaatgttctcccgtgctcctggctgcatgtaggcacctaagatacaggaggacagggcggtgaggagaggtgtttccaggtgtatggaagttgacactgtggcttggcccaggtcttgggtgtgccagagtgcttgtgactcactgaagggcagctctgcctcaaagatacaactttggaggaagtttagacgactggccagtatcacataaaaactgttcagaaggttcctggctagtatctagtaaccagattattaatattcaacattttaaaatgaagtatctgcaagggatttcttccttcagagctggaaacattaacagagagtcctcagccactcttctgttcccaccttgctctgtagagtttccatttcccaccaccaaagaggcagcttttagtaccttgaaaacatagggcccatactggctttatttttaacctacccacacagggcccccatcctgaaagaagttcacatatatttagggagctgaaatgagtgtttaaaggataataccaagaccataaatgctaagtgctaattgaggggtatattcagggaacagttttggaaacatgaggccaagggtagctaaggaagagtttttagaaaaaacttgataattacagaagcagagaagtatatttgccttattacttaatctctgttttcacagaataggctatttttctttttttttttttgagaccgagtctcgctcttgtcacctaggctggagtgcagtgcttgcaatctcggctcactacaacctctgcctcccaggtttaagcgattcttctgcctcagcctcctaagtagctggcattacaggcatgtgccaccgcgcccggctaatttttgcatttttagtagagacggggtttcaccatgttggtcaggctggtctcgaactcctgacctcgtgatctacccgcctcggcctcccaaagtgctaggattacaggcgtgagccaccgtgcctggcctaggctattaaataacaagaattaaagactcaggaaatagaaattccagttctaactgccaccctttaactatgtgaccttgaacaggctctcagcctcgctgggcttatctgtaaaacacagactagacgatcccatttcaatgctgcgaatcggctaatgagcaacactggagcacaggactggttgaaataggctcccaaatgtagaaacataaatatactctcacttacttatgatctaggcagaatgacttacctagaacttgggaacagatatagtacacgaacagtgaactgcctgtttttgacaacacagacaccacctattgaaggctatacacaagcatgaactcactctcccttttagcctataaagtagatcttactgtttaacaggtaaaatggggctgattaaggctgagcaatcaccaagtgtcagaccgcgtgccaaactccacactgtaagatgcgtcacctaagcagcatgctcaggcatgaatgagccttaaaaggccacacagcacagtggttaagagggcggggcctggggttagactgacatcatctgaatccagcttaagtcagtctccactcagggaagatgcccctctcagtcatggtagacctgggcagtgggtgccagctgaccatgtaccccagtcagcagggtgagagtctgttgctatgtgcaaaagtgtgacctaaggtttaggctgcctacaggaaccagaaaactctgattctgtgtcatttacatgtgtaaaatctgaaacttggggccaggacatccaaaatgggaatcctcacttaccaacgttggaggacaccgcccggttcatgatatcaagtgcctcattaaatttgtccttgacagatggatgtgccagcacttggtctgagaacatcgacttccaacccaggtaccacttggtgatctcctcataatttgggctgttactgagccaagagcacagcacctgccaaaaagaaaaattacttgcatccatcgtggcaacaaatgaaggcaagatttctgaagtggccatttgttttgttttgatcctggtcctacaggctagtgacactactttacagggatttatagtagctaaacagtctagcacttatgaatatggattttggagtcagcctggtagctaaagtgcccttgcatgtaaactctctgagcctcagcttccatgtctacacaacagggataccatatcccctaccccatagggttgctgagaggagctgagataaagcaaataaagtgcttggaacagcttctgatacatggcaaatgtccaataaatggtgcccactatgaa

SEQ ID NO: 186321 - DNA, 1278 bp, Homo sapiens
  Payload ID: 16690
  Gene Symbol: SRRD
  Gene Name: SRR1 domain containing
  ENST ID: ENST00000613968
  CDS Start-End: 12-1019
gtcagagaccaatggctgcggccgcagctgcggcgctggaatcctggcaggcggcggctccgcggaagaggcgcggctcgacggccgcggcgaggcggccccgggggagagaggcggcgccccgggggagagaggcggcgccccggggccccgaggcggagttcgagtctgacagcggagtcgtgcttcgtcgcatctgggaggctgagaaggacctgtttatctctgatttctggagttcagcactagaaaccatcaatagatgtctcacaaaacatctggaacaactgaaggcccctgtggggactctttcagacatctttggaaacctgcatcttgactcattgccagaggagtcagatgtggccactgattctatcccaagagagatcttggtcacaggaacctgccatttgaagtgtgtgtgttacggcattgggaactttgccacctgcatcgtagctagaaaccagctaacgtttttgctgcttttgttggaaaagtgccagattcccagaagtcactgttgggtatatgaccctctgtttagccaacttgaaattgaagtccttaacacccttggtgtgactgttctcagtgagaacgaggaagggaaacggagtattcgcggggagcctaccatcttttacatgctccattgtgggacggccttgtacaacaatcttttatggagtaactggtcagtagatgccctttctaagatggtcatcattgggaacagtttcaaaggacttgaggagaggttgttggcaaggattctgcagaaaaattatccctacattgcaaagattttaaaaggactggaggagcttgagtttcctcagacttcacaatacatggacatatttaatgatacctctgtccactggttccctgtgcaaaagctagaacagctctccatagatatttgggagtttcgggaagaaccagattatcaggactgtgaggaccttgaaatcatcaggaacaagagagaagatccttctgctactgactgaactcgttgtgaggtactcagtgttggctgaggtagaagctgccaccagagactaaagggaaggctgctatggaggaactacagagaactcctttgccaggaaagaacatcaacttggctgtcctgttttgaggacgataccccacatgaggacttggtataaagattcctgccctacgtggcattgtcccattttacatccttccctcatgacctggcctgatgtggagtagctcctgagtaaagaagttacccttttg

SEQ ID NO: 186322 - DNA, 4306 bp, Homo sapiens
  Payload ID: 16691
  Gene Symbol: SCAF1
  Gene Name: SR-related CTD-associated factor 1
  Uniprot ID: Q9H7N4
  ENST ID: ENST00000360565
  CDS Start-End: 125-4063
tgaaatcccggcaagctcggcggcgctttagctccgcctctctcctcctttgctcacgaaccccgccccagcccgccccgccccgcgccggggccggagccgcagcccgagcggcggggtgaccatggaggaagaagatgagtctcgagggaagacagaggagtcgggggaggatcggggcgatggtccgccagacagagaccccacgctttctccttctgcctttatcctgcgagccatccagcaggctgtgggaagctccctgcagggggacctgcccaatgataaagatggctctcggtgtcatggccttcgatggcggcgctgccggagtccacggtcagagccccgttcccaggaatcagggggcactgacacggctactgtgttggacatggccacggacagcttcctcgcagggctggtgagtgtcctggatcccccggatacctgggttcccagccgcctggacctgcggcctggcgaaagtgaggacatgctggagctggtggctgaggtccgaatcggggacagagatcccatccctctgcctgtgcccagcctgctgccccgtctcagggcctggaggacgggcaaaacggtttctccacagtcgaactcctctaggcccacctgtgcccgtcacctcaccttgggcacgggagacgggggccctgccccaccccctgccccctcctctgcatcctcctccccttccccttctccctcatcttcctccccttcccctcccccacccccaccgccccctgcacccccagccccacctgccccccgattcgatatctatgaccccttccaccccaccgacgaggcctactctccaccgcctgctccggagcaaaagtacgacccttttgagcccaccggctccaaccccagctcatcagcggggaccccctcacctgaggaggaagaggaggaggaagaggaagaagaagaggaagaggaagacgaggaggaggaggaaggcctgtcccagagcatcagccgcatctcggagaccctggcgggcatctacgatgacaacagcctgagccaggacttcccaggtgacgagagcccccgcccggacgcgcagcccacacagccgactcccgcccctggaacgccgccccaggtggactccacccgggctgatggagccatgcgccggcgggtcttcgtggtggggaccgaggcagaggcttgtcgggaaggcaaggtctcggtggaggtggtgaccgctggtggagccgccctcccgccgcccctgctgccgcccggcgactcggagatcgaggaaggggagatcgtccagccggaggaggagcccaggctggcgctgtccctcttccgccccggcggccgggccgcccggcctacaccggccgcctcggccacccccacggcccagccccttcctcagcctcccgctccgcgggcccccgagggggacgacttcttgtccctgcatgcggagtcggacggcgagggcgccctgcaggtggacctaggggagccggctcccgcgccgcccgccgccgactcgcgctggggcggcctggacctgcgccgcaagatcctgacccaacggcgggagcgctaccgccagcgctcgccctccccggcgcccgcgcccgccccggccgccgctgctggtccgcccacgcgcaagaagtccaggcgggaacgcaagcgcagcggcgaggccaaggaggccgcctcgtcctcgtcgggcacccagccagcgccgcccgccccggcctcgccctgggactccaagaagcaccgctcgcgggaccgcaagcccggctcccacgcctcgtcgtccgcccgccgccgctcccgctcccgctcccgctcccgctccacccgccgccgctcgcgcagcaccgaccgccgccgcgggggcagccgcaggtcgcggtcccgggagaagcggcgacggcggcggcgctccgcctccccgcccccggccacttcctcatcgtcgtcctcgaggcgcgagcggcaccgcgggaaacaccgggacggtggcggcagcaagaagaagaagaagcggtcgcggtcccggggtgagaagcggtctggggatggcagcgagaaggccccggcgcccgccccgccgccctctggctccacctcgtgtggtgaccgcgacagccgccgccggggggccgtgccaccctccatccaggacctcacggaccacgacctcttcgccatcaagcggaccatcacggtgggccggcttgacaagtccgacccccgaggaccctctcctgctccggcctcctcacctaagcgggaggtcctgtacgactccgagggactgagcggcgaggagcggggcggcaagagcagccagaaggatcggcgccgctcgggggccgcctcctcctcctcctcttcccgggagaaggggtctcgtcggaaggcgctggacgggggtgaccgggatcgggacagggacagagatagggacagggacaggtcatccaagaaggcccggccccccaaggagtcggcgccttcctcagggcccccgccaaagccaccagtcagcagcggctcaggctcttcatcctcgtcgtcctcctgttcttcccggaaggtgaagctgcagtccaaggtggcggtgctgatccgcgagggtgtcagcagcaccaccccggccaaggatgccgcgtcagccggcctgggctccattggcgtcaaattcagccgtgaccgcgagagtcgctcccccttcctcaaacctgacgagcgggcccccactgagatggccaaagcagctccgggcagcaccaagcccaaaaagaccaaggtcaaggccaaggcaggggccaagaaaaccaaggggaccaagggaaagaccaagccatccaagaccaggaaaaaggtccgcagtggaggtggcagcgggggcagtggtggccaggtgtcgctgaagaagtccaaggcggatagctgcagccaggcggcaggcaccaagggggcggaggagacttcctggtccggggaggagcgggcagccaaggttcctagcaccccgccccccaaggcagccccaccaccccctgccctcactccggactcgcagaccgtggacagcagctgcaagacacctgaggtctccttcctgcccgaggaggccactgaggaggctggggtccgaggtggggcggaggaggaggaggaggaagaagaagaggaggaggaagaggaagaggaggaggagcagcagcctgctaccaccacggccaccagcactgctgcagccgccccaagcactgcccccagcgcggggtccacagccggtgactcgggggcggaggacgggccagcttcccgtgtctcccagctgcccacgttgcccccgcccatgccctggaatctgccagctggtgtggactgcaccaccagcggcgtcctggccttgactgcacttctcttcaagatggaagaagccaacctggcgagccgagcgaaggcccaggagctgatccaggccaccaaccagatcctcagccacagaaagccaccctcaagtctggggatgaccccagctcctgtgcccacctctttgggtctgccccctggcccctccagctacctgcttcctggcagcctccctctggggggctgcggttcgaccccccccacccccaccgggctggctgccacgtctgacaagagagagggcagcagcagctctgagggccgtggggacacagataagtatctgaagaagctgcacacgcaggagcgggcggtggaggaggtgaagctggccatcaagccatactatcagaagaaggacatcaccaaggaggagtacaaggacatcctgaggaaggccgtccacaagatctgccacagcaaaagtggggaaatcaacccagtgaaggtgagcaacctggtgcgggcctacgtccagcgctaccgctacttccgcaagcacggtcgcaagccaggggaccccccagggcccccacggccgcccaaggagccagggcccccagacaagggtggcccgggcctgcccctgccccctctctgagagccctggccagctcttcgcccctcacctctttgaaactctggacgtatttatggctccacctccccacctccctcccccgtcagtgggatgactgggggagggttgctgcagggaagaggagagccccctgccctgccctgccccgtgtccacctcccttgcccccaagcctgtccccagtgcccctcccttctgtttgtgcccctctccccaatttcattaaagatttcatgaaacatta

SEQ ID NO: 186323 - DNA, 463 bp, Homo sapiens
  Payload ID: 16691
  Gene Symbol: SCAF1
  Gene Name: SR-related CTD-associated factor 1
  ENST ID: ENST00000595242
  CDS Start-End: 105-463
ggagatagtgtggggcccttgaggtcttcatgtctatcctctacttccatcctttctcccgggacctccactccaaactctcccccctggacccccaggtgaccatggaggaagaagatgagtctcgagggaagacagaggagtcgggggaggatcggggcgatggtccgccagacagagaccccacgctttctccttctgcctttatcctgcgagccatccagcaggctgtgggaagctccctgcagggggacctgcccaatgataaagatggctctcggtgtcatggccttcgatggcggcgctgccggagtccacggtcagagccccgttcccaggaatcagggggcactgacacggctactgtgagtgttggacatggccacggacagcttcctcgcagggctggtgagtgtcctggatcccccggatacctgggttcccagccgcctggacctgcggc

SEQ ID NO: 186324 - DNA, 491 bp, Homo sapiens
  Payload ID: 16691
  Gene Symbol: SCAF1
  Gene Name: SR-related CTD-associated factor 1
  ENST ID: ENST00000601038
  CDS Start-End: 198-491
ctggggtgtctgtgctgggtccagcgcccacccaagcacagggtggagtgggaggaggtggaggagaggaggggtgccagaggggatgctgagggagatagtgtggggcccttgaggtcttcatgtctatcctctacttccatcctttctcccgggacctccactccaaactctcccccctggacccccaggtgaccatggaggaagaagatgagtctcgagggaagacagaggagtcgggggaggatcggggcgatggtccgccagacagagaccccacgctttctccttctgcctttatcctgcgagccatccagcaggctgtgggaagctccctgcagggggacctgcccaatgataaagatggctctcggtgtcatggccttcgatggcggcgctgccggagtccacggtcagagccccgttcccaggaatcagggggcactgacacggctactgtgttggacatggccacggacagcttcctcgca

SEQ ID NO: 186325 - DNA, 662 bp, Homo sapiens
  Payload ID: 16691
  Gene Symbol: SCAF1
  Gene Name: SR-related CTD-associated factor 1
  ENST ID: ENST00000598359
  CDS Start-End: 54-662
gtctgcaagacctgaagagtatcttcagagccatctagaggcctggggtgaccatggaggaagaagatgagtctcgagggaagacagaggagtcgggggaggatcggggcgatggtccgccagacagagaccccacgctttctccttctgcctttatcctgcgagccatccagcaggctgtgggaagctccctgcagggggacctgcccaatgataaagatggctctcggtgtcatggccttcgatggcggcgctgccggagtccacggtcagagccccgttcccaggaatcagggggcactgacacggctactgtgttggacatggccacggacagcttcctcgcagggctggtgagtgtcctggatcccccggatacctgggttcccagccgcctggacctgcggcctggcgaaagtgaggacatgctggagctggtggctgaggtccgaatcggggacagagatcccatccctctgcctgtgcccagcctgctgccccgtctcagggcctggaggacgggcaaaacggtttctccacagtcgaactcctctaggcccacctgtgcccgtcacctcaccttgggcacgggagacgggggccctgccccaccccctgccccctcctctgcatcctcctccccttccccttctccctcatct

SEQ ID NO: 186326 - DNA, 2084 bp, Homo sapiens
  Payload ID: 16692
  Gene Symbol: SCAF11
  Gene Name: SR-related CTD-associated factor 11
  ENST ID: ENST00000266589
  CDS Start-End: 1732-2084
tggcttaagccgcgcggagcagcgcaacctgggtcgctccctgcttcgccgccgcctccggaccgagccagcggagtcagtgtcctagagaccctgtaacaccacaaagcggacgaaggagtccatgttggggaacttggcagcggagtgactgggacctgggaacctactgtggggccgcggccggaccgagcgcctcgacctcggtctgagtattgaaattagaccaaacagccttgtcactgatatgaagaaagtttgcctgatctgggtagaaggtcaaaccagtcgtaacattctcttaactcaaagcctaatccagagcgcgtctctaacgctcttcaagccagtgaagtctgagagggataaggaagctgcagaagaaaagtttgaagctagcagaggttggttcatgaagtttaaggaaagaagccatctccataacataaaagtgcaaggcgaagcagcaagtggtgatgcggaagctgcatcaggttatccagaagacctagctaacatcattgatgaaagtggctatactaaacaaaagatttttaatgcagatgagccagccttctattgaaagtagatgccatccaggactttcataagtagagaggagaagtcaatgcctggcttcaaagcttccaaggacaggctgactgtcttgttaggggctaatgcagctggtgactataaatttataaaccagtgctcactgaccgttctgaaaattccaggactcttaagaattatactgaatctactctgtgctctataaatggaacaacaaagcttggatgacagcacatccgtttacagcatggtttactgaatattttgagctcactgttgagaccaaatgctcagataaaaagattcctttcaacatagtacttacttattgacagtgcacgtagccatccaagaactctgatggaaatacacggagataaatgttgccatgcctgctaacacaacatccatttttcaacccagtgatcaagaagtaattttgactgttaagtcttattctgttagaaatacatttcataaggctacagctgcttcagacagtgatttcttggatggatatgggcaaagtaatggaaaggattcaccattctagatgccataaagaacattcgtaattcatagaaggaggttaaaatatgaacaggattgtgaagaagttgattccaaccctcatggatgacttttagggattcaaaacttgtgtggaggaagtaactattacaggtgtggtataaacagcaggagaactattatagaattagaagtggagcctgaagacatgactgaattgctgcaattttatgataaattttgaatgaagagttgtttcttagggatgaacaaagaatgtggtttcttgagatggaatgtgctcttgctgaagatgtgaacattgttaaaatagtatataaacttagttgataacacagtggcagagtttgagaggattaactccaattttgaaagacattctgctgtggataaaatgctgtcaaatagcatcttgtacacagagaaattttttgtgaaaggagtgtcagtgtggcatacttgaatgttatctcattttaaggaattgccacagccaaccctgcccttcagcaactaccatcctgtgattagtcagcaaccatcaacatcaaagcaagaccctccaccatcaaaaagattatgacttgctgaagccttgctgagatgattgttagcatttttagcaataaggaaacccttttccaaagagaaatgaagaagaaaactgtatgtaccctaaatatgggagataagaagtatgaagacatggaaggtgaagaaaacggagataatactatttccactggtctgttgtacagtgaggctgacagatgcccaatatgtcttaattgtctattagaaaaggaagttggttttccagaaagctgtaatcatgtcttctgtatgacttgtattcttaaatgggcagagacactggcttcatgtcctattgaccgtaaaccttttcaggcagtgtttaaattcagtgcattggaaggttatgttaaggttcaagt

SEQ ID NO: 186327 - DNA, 7543 bp, Homo sapiens
  Payload ID: 16692
  Gene Symbol: SCAF11
  Gene Name: SR-related CTD-associated factor 11
  Uniprot ID: Q99590
  ENST ID: ENST00000369367
  CDS Start-End: 235-4626
tggcttaagccgcgcggagcagcgcaacctgggtcgctccctgcttcgccgccgcctccggaccgagccagcggagtcagtgtcctagagaccctgtaacaccacaaagcggacgaaggagtccatgttggggaacttggcagcggagtgactgggacctgggaacctactgtggggccgcggccggaccgagcgcctcgacctcggtctgaggaaacccttttccaaagagaaatgaagaagaaaactgtatgtaccctaaatatgggagataagaagtatgaagacatggaaggtgaagaaaacggagataatactatttccactggtctgttgtacagtgaggctgacagatgcccaatatgtcttaattgtctattagaaaaggaagttggttttccagaaagctgtaatcatgtcttctgtatgacttgtattcttaaatgggcagagacactggcttcatgtcctattgaccgtaaaccttttcaggcagtgtttaaattcagtgcattggaaggttatgttaaggttcaagtaaaaaaacagctgagagaaacaaaagacaagaaaaatgaaaactcatttgagaaacaggtctcctgtcatgaaaattctaaaagctgtataagaagaaaagccatcgtaagagaagatctattaagtgcaaaagtttgtgacttgaagtggatacatagaaactctttatacagtgaaacaggaggaaagaaaaatgcagcaataaagataaataagcctcagagatcaaattggagtacaaatcagtgcttcagaaattttttctccaatatgttttcttctgttagccactctggagaatcttcctttacctatagagcttattgtacagaatttatagaagccagtgaaatcagtgcattgattaggcagaagagacatgaactggaattgtcatggtttcctgatacattacctggaattggaagaattggttttataccctggaatgttgaaacagaagtccttcctctcatttcttctgtgttgccaagaactatttttccaacaagtaccatatctttcgaacattttggtacttcttgcaagggatatgcattagcacatactcaagaaggggaagaaaagaagcaaacttctggtacatcaaataccagaggatcaagacgaaaacctgcaatgacaactcctacaaggaggtctacacgtaacacaagagctgaaacagccagtcagtctcagagatccccaatatcagacaattctgggtgtgatgccccaggtaacagtaatccatctttaagtgttccctcttcagctgagtcagaaaagcaaacaagacaggctccaaaacggaagtctgtaagaagaggaagaaaaccacctttactgaaaaagaaacttcggagctctgtagctgcccctgaaaaatcatcttccaatgattcagtagatgaagaaacagcagaatctgacacatcacctgtgttagaaaaagagcaccaaccagatgtagacagtagtaacatttgtactgtgcagactcatgtagaaaaccagtctgctaattgcttgaaaagttgcaatgagcaaatagaagaaagtgagaagcatactgcaaattatgatacagaggaaagagtaggatcttcatcttctgagtcttgtgctcaagatcttcctgtgctagttggtgaggaaggggaagttaaaaaactcgagaatacaggtatagaggctaatgttttgtgtttggaaagtgagatttctgaaaatattcttgaaaaaggaggtgatccattggaaaagcaagaccagatatctggactttcacaatcagaggtaaagacagatgtatgtacagttcatcttccaaatgattttcctacatgtttaacatctgaaagcaaagtgtaccaacctgtatcttgtcccctaagtgacttatctgagaatgtagagtcagtggttaatgaagaaaaaataacagagagttccctagtagaaattactgaacataaagattttacactaaaaacagaggagcttatagagagccccaagttagaatcttctgagggtgaaattatacagacagtggacagacaatctgttaagagcccagaggttcaattgcttgggcatgttgaaactgaagatgtagaaataattgcaacatgtgatacttttgggaatgaagatttcaataatattcaagactctgaaaataacttactaaaaaataatcttctgaacaccaaattggaaaaatctttagaagaaaagaatgaatcgctgaccgaacatcctagatctacagagttgcctaaaacacacattgaacagattcagaagcattttagtgaggacaacaatgaaatgatacctatggagtgtgattcattttgcagtgaccaaaatgaatctgaagttgaaccatctgtaaatgctgatcttaaacaaatgaatgaaaattctgtgacacactgttctgaaaataatatgccgtcttctgatcttgcggatgaaaaggttgaaactgtttctcaaccatctgaaagcccaaaagataccatagataaaaccaaaaagcctcgtactcgaagatctagatttcattctccatctacaacttggtcacccaacaaagacactccacaagaaaagaagcggccccagtctccatctcccagaagagaaactgggaaagaaagcaggaagtctcaatcaccatctcctaagaatgagtcagccagaggccggaaaaaatcccgttctcagtccccaaaaaaggatattgcaagagaaaggaggcaatctcagtctcggtctccaaaaagggatactactagggaaagcagaagatctgaatcactgtccccaagaagagaaacttctagagagaacaaaagatctcagccaagagtgaaagattcttccccaggagaaaaatccaggtcccagagcagagaacgagaaagtgatagagatgggcagaggagagagagagaaaggagaaccagaaagtggtctaggtccagatctcattctaggtccccctcaagatgtagaacaaaaagtaagagttcatcatttggtagaattgacagagatagttactctccccggtggaagggaagatgggcaaatgatggttggagatgtccacgaggaaatgatcggtacagaaagaatgacccagagaaacagaatgaaaatacaagaaaagaaaaaaatgacatccatctagatgctgatgatccaaattctgctgacaaacatagaaatgactgtcccaattggataacagaaaaaataaactctgggcctgatccaagaaccagaaatccagaaaagttgaaagagtctcattgggaagaaaatagaaatgaaaattcaggaaattcttggaataaaaactttggttctggttgggtatctaaccgtggtagaggcagaggcaaccgtggcagaggcacttacagaagtagttttgcctataaagatcagaatgaaaatcggtggcaaaatcgaaaacccctctcagggaattcaaacagttcagggagtgaatctttcaagtttgtggaacagcaatcctataagcgaaaaagtgaacaggagttctcatttgatacaccagcagatagatctggatggacatctgcatccagctgggccgtgagaaagactttgccagcagatgtacaaaactactactcacgacgaggcagaaattcttcaggtccacagtctggatggatgaaacaagaggaggaaacatctggacaggattctagcctaaaagaccaaacaaaccagcaagttgatggttctcagctacctataaatatgatgcaaccgcaaatgaatgtaatgcagcaacaaatgaatgcacaacaccagcctatgaatatcttcccatatccagtgggtgttcatgctcctttgatgaacatccaacgcaatccatttaacattcatcctcagctacccttgcatctccacacaggagtgcccctcatgcaggtagccactcctaccagtgtatctcagggactaccaccaccaccaccccctcccccaccatcccaacaagtcaactacattgcttcacaaccagatggaaagcaattgcagggtattcctagttcttctcatgtaagtaataacatgagtacaccagttttgcctgctccgacagcagccccaggaaatacgggaatggttcagggaccaagttctggtaatacttcgtcatcaagtcacagcaaagcctctaatgctgctgtaaaattggcagaaagcaaagtaagtgttgcagtggaagccagcgcagatagctcgaagacagacaagaaattgcaaattcaagaaaaagcagcacaagaggtaaaattggccatcaagccattttaccaaaataaagatatcaccaaggaagaatataaagaaattgtacggaaagcagtagataaagtttgtcatagtaagagtggagaagtaaattctactaaagtggcaaatctggttaaagcctatgtagacaaatacaaatattcacggaaggggagccaaaagaaaactctggaagaacctgtgtctactgaaaaaaacataggctgaaatggggaacgctgtcaaggacattatcaggatatctgcaaagtgcaatttcaacatgtaccattaactgaaaatcatacataactgtgattgaaatttggttttgataaaattatttttttaacataggatatgatgttttgttctaaataaatataggtctgcactgcaacttctgtatccttccttcccctccaccctcccccacaaaattcaagggaaagtaaagggtttaaaggaatgtgcatctttactaggactgtgttatagtgtggatactggaaaatgtatagctttttgattagggcaatggagtgcataaattagaaacttctaagtgcactggttttcaaagagatatatataatgcatttattctgtcaggttaaaatgtaaagtatgatctttatgattttttccctctaattatagaaagttaaataatgtattaccatgaaaaatgtttctaatattaaatagaacatatcagttgcaaagttcctaatgtgtatttttaaagcacatatctgaataaattgcctagatagaaaaaaaattatcacgagtaaaatttagtgttcaaaacattgagacactcttcacctattgtatgaccaaataaaggttatgctgcttgtttttcttttgtgcctttgtttacccctaattgagataagcagtttgacttactagattacaactttggcagttcaaagtctttgttgaagactttgaggaaaaagatttggaaaaattgttgactttcggccgggcatgatggctcacgcctgtaatcccagcactttgggaggccgaggtggcggatcacctgaggtcaggagttcgagaccagcctggccaacatggtgaaatcccgtctctactaaaaatacaaaaattagccaggcgtggtggtgggcgcctgtaatcccagctatgcgagaggctgaggcaggagaatcagttgaacccgggaggcggggattgcagtgagccgagaccatgccattgcactccagcctgggcaacaggagcaaatctccgtctcaaaaaaaagaaaaaaaaaagtgttgactttgtagaaattatgttctttcatagtatcttcttctacccgttgcagacgataaattatttgtgccaattcgagaattgctgttaggctgttatcctcccttccttggggctaagaattacaagactcatggcactggcgtaaagttgttgtttatctaatcactgatgaaatattttcacacttgaaaatccccaaatgctttacaatgaatgaagtgttaatttggtgaccaggtggtagccattagccatgttgcaaaattctagacagtaaaacctgtgttttagaaacagaggggaaatttaaataatggagtcctggttagcctttcagggattagggatttgggtttttttttttttctctttttaatactagaatatctcagtttttataaaaggtaagtttaaaatgtttattgtgccattattttaactggcatcttgaaagaacagtaggttttctccatgataaactgattccagtaagaattttcagtacataccaagtacctggaaagttcttcagataagttaatagatccaaggagatacatgcctcagtgagataaactgacctttttactagctaaactatttagccagagcaatactctgtagaactgtgcttttctaaagtaaagattatctgtttctcaattttatgtgcataatacttttcctggtgctagctttgataggcaaaatattttgaaatgttggtcccataatgattgtgctagttcataagctttgttgttatgagtgtaatcataaaaatatttccaagcagtttttgacctttattctacatttctgggcatttgtaatatggtattctactggtatatatttttaaagtttgcgtttagattatggtaaagaaatttcaagcatatttcttctaataaagtattaagacagtgtttcagaatatcaaggcacacctccttagttgttttagattagaactctagaaacaattttgtgaacattgaaagtattttgagttaagcctaagctgattaatcacacaatacatacttttcctgcattttctttcagtgacatttgagaattgggtgacattttaaaatgtgttttataccatttagcttttgcaaacaagttctaaagttttggagaaaaagtgatgtggtcaagagttgaagtctcatatatctttagtagcactcccatgaattatttccgtgacagtaacaagtgtgtgttccatgtctgatttggggcactggttagactgcattaatagctacttgattagaattcgaacttttaaaattttgaaatgtttaagaatgtattagaaaatgcatgctttatgttgaaaaaatacattgctttaatattcctcattcttgagttaagaaatttatgttaattttgcatgggcacaaacttaatcagaaacattttgtggagttacatttcctcttattatttatcaaggttcagtattgatctttgaaaccttggtcccgttaacttactagtcacattgaccaatgttttatagaaatgcctagaattttgagactaatagtagttatccattaacattccaaaagttttgtgctttttaaaatttgttttggtaattatcacatttttttctcttaccttcctttaaatggccacagtgtgtactgctggaatgttccatccaaaagatgtagcttcagaagcacagtgattgccccagggtccatgagatattgtttgtattatgaagttggagtgctgtctactgaaattatactcttaaataaatatgtatgtagtgtgtaatattttctaataaattcttttgataaactaa

SEQ ID NO: 186328 - DNA, 1336 bp, Homo sapiens
  Payload ID: 16692
  Gene Symbol: SCAF11
  Gene Name: SR-related CTD-associated factor 11
  ENST ID: ENST00000395453
  CDS Start-End: 250-483
aagggggagtagcggtggcttaagccgcgcggagcagcgcaacctgggtcgctccctgcttcgccgccgcctccggaccgagccagcggagtcagtgtcctagagaccctgtaacaccacaaagcggacgaaggagtccatgttggggaacttggcagcggagtgactgggacctgggaacctactgtggggccgcggccggaccgagcgcctcgacctcggtctgaggaaacccttttccaaagagaaatgaagaagaaaactgtatgtaccctaaatatgggagataagaagtatgaagacatggaaggtgaagaaaacggagataatactatttccactggtctgttgtacagtgaggctgacagatgcccaatatgtcttaattgtctattagaaaaggaagttggttttccagaaagctgtaatcatgtcttctgtatgacttgtattcttaaatgggcagagggacttttcacataggttatttgatttcttctttatatcagccttgtggaataaccagagcagatacgatagtgtccttccattttacagatgaggaaacttggattttatgttctatgacttggtcaagatctcatagtttaagaggcagaagtgaatttagaactgattttctaattcctgtttttaatttagtgtggactaatttcagagtctgaattagagatattaccgtcatagacagtgaataagaaacaagacattcgtgacttttaatgtattatgttgactcaatttgggccaaatactttgaagtaaatattaatttaatataagccttattgttatgaaatgttaagtaaaaaattattgttcatattatgctatattttctaagttaatatttgtcagtctgtaaaaattagtaaagaagataatatcttaaaaatattttaacattagctgcattccaattgttaatgttcttaaatatgttggaattaattgcatattacataattggggttttcaaagcgctatgttttgcttaaattttcattaatagtgtggaaaggagaatgtaactgtatagtgactctggctgagttctcaaaagaaggaagagaagatttgttatacaaattgaattaataatagtatacatataaactattttaatttagtaaaacctaaactggtctttaacaagaagtgacaggataggtgaaaatgtattttggggaaaagtattttgagttttgctgaattaatatggttggtaaatctctctctgtgtaggatcactgtttaatgaaataatgcatattttttttctgccacccaaataaagatttttatctgtgttgaa

SEQ ID NO: 186329 - DNA, 1931 bp, Homo sapiens
  Payload ID: 16692
  Gene Symbol: SCAF11
  Gene Name: SR-related CTD-associated factor 11
  ENST ID: ENST00000395454
  CDS Start-End: 254-487
ggggaagggggagtagcggtggcttaagccgcgcggagcagcgcaacctgggtcgctccctgcttcgccgccgcctccggaccgagccagcggagtcagtgtcctagagaccctgtaacaccacaaagcggacgaaggagtccatgttggggaacttggcagcggagtgactgggacctgggaacctactgtggggccgcggccggaccgagcgcctcgacctcggtctgaggaaacccttttccaaagagaaatgaagaagaaaactgtatgtaccctaaatatgggagataagaagtatgaagacatggaaggtgaagaaaacggagataatactatttccactggtctgttgtacagtgaggctgacagatgcccaatatgtcttaattgtctattagaaaaggaagttggttttccagaaagctgtaatcatgtcttctgtatgacttgtattcttaaatgggcagagaggagctatctataagcagcctatgtgattgaggatagagcagcaggaggaagcgagaaattagaaatcgaggatcctgaattcccaaataaggaaggtttcttgttcttacatttaaatgtgggtttgtctgagctgagaatttataatgcttcagaatagtagggtgtgttttactgaaatcattaggaagattatttttttctatcaaaattgccttcttaactgatacaacaaccttagtacagagcattcacagtaaaacatatgctctgtttaatacacattacactgtaaagcagtgagcaaattccattaattttgtagctgtatcataaagccaatgatgttattagactacttggttatgaaactgaattagatactttaaaaattattgaaatgaaagtcagtaattcaaacaagtgagtcattgaaggatattttgttgtatataaggaatcaaaatggtaaataattgaaggatatttttattgtatttaaggcaacaaaatttgagataattttcttcaaaattaaaataacttaaaaatagagtaagtattagttaaaatttctttacattagtttaaaatgtgaacttttaaaacctcacaacttggaaatttaattgtaaattttactctgaaaactaaaaacatctttgagacctttctggatagatatctgctggatataagagtgaggcatccttgggagttccttaaaattaggccagtctgggccgggtgtggtggctcacgcttgtaatcccaacactttgggaggccggggtgggccaatcgctttgagctcaggagttcgagaccagcctgggcaacatggcaaaacccgatctctacaaaaaattagctgggcatggtggtgcgtgcctgtagtcccaactacttgggaaactgaggtgaggccatcgcttgaacctaggaggttgaggttgcagtgagccgtgatgccgctgcactacagcctgggcaagagggtgagaccctgtttaaaaaaaaaattatgatggctgagtctgtgtcaaagaaaattaacttattttttggtgttaactaaattatctttaggtaattacattttatatagattgtgatgatatatggcagtagttttcctattactactacttttttttcttgtttttcctttgtgtttttgtaataccagtggagccttttcttaaaatgaaactaggcaaacctaagacaattatgcttaaggaaaaaaaagggggggaatcttactcagaactgttttttgaaacggatcaaatggaatggctcagagcaggtgtgatggctcctcctgtaatcccaacactttgggaggctgaggtaggaggatcgtttgagcacaggagttcaagatgaagcctgagcaacatagtgagaccctgtctctatgaaaaaagttaaaaaaaaaaaaaaaaaaaaaa

SEQ ID NO: 186330 - DNA, 3271 bp, Homo sapiens
  Payload ID: 16692
  Gene Symbol: SCAF11
  Gene Name: SR-related CTD-associated factor 11
  ENST ID: ENST00000547018
  CDS Start-End: 467-3271
gaaagtgccagaaaagcgacgtcctcagggcgggagcaggggacgccgcaacgtagtctgcgagaatgcaggaaggcggcagtgaagcggtcggtcggcggggccgcggcaaagtggggaggaaactcatcccgggcaggcgtcagggtggctggagagcgcagcacgcgcgaacagaacgggggcaggcgacaggaaaacgtgtgagcgcgcggctgaaagcgactgggacctgggaaacccttttccaaagagaaatgaagaagaaaactgtatgtaccctaaatatgggagataagaagtatgaagacatggaaggtgaagaaaacggagataatactatttccactggtctgttgtacagtgaggctgacagatgcccaatatgtcttaattgtctattagaaaaggaagttggttttccagaaagctgtaatcatgtcttctgtatgacttgtattcttaaatgggcagaggtaaatataatttgttaatcacttttcagacactggcttcatgtcctattgaccgtaaaccttttcaggcagtgtttaaattcagtgcattggaaggttatgttaaggttcaagtaaaaaaacagctgagagaaacaaaagacaagaaaaatgaaaactcatttgagaaacaggtctcctgtcatgaaaattctaaaagctgtataagaagaaaagccatcgtaagagaagatctattaagtgcaaaagtttgtgacttgaagtggatacatagaaactctttatacagtgaaacaggaggaaagaaaaatgcagcaataaagataaataagcctcagagatcaaattggagtacaaatcagtgcttcagaaattttttctccaatatgttttcttctgttagccactctggagaatcttcctttacctatagagcttattgtacagaatttatagaagccagtgaaatcagtgcattgattaggcagaagagacatgaactggaattgtcatggtttcctgatacattacctggaattggaagaattggttttataccctggaatgttgaaacagaagtccttcctctcatttcttctgtgttgccaagaactatttttccaacaagtaccatatctttcgaacattttggtacttcttgcaagggatatgcattagcacatactcaagaaggggaagaaaagaagcaaacttctggtacatcaaataccagaggatcaagacgaaaacctgcaatgacaactcctacaaggaggtctacacgtaacacaagagctgaaacagccagtcagtctcagagatccccaatatcagacaattctgggtgtgatgccccaggtaacagtaatccatctttaagtgttccctcttcagctgagtcagaaaagcaaacaagacaggctccaaaacggaagtctgtaagaagaggaagaaaaccacctttactgaaaaagaaacttcggagctctgtagctgcccctgaaaaatcatcttccaatgattcagtagatgaagaaacagcagaatctgacacatcacctgtgttagaaaaagagcaccaaccagatgtagacagtagtaacatttgtactgtgcagactcatgtagaaaaccagtctgctaattgcttgaaaagttgcaatgagcaaatagaagaaagtgagaagcatactgcaaattatgatacagaggaaagagtaggatcttcatcttctgagtcttgtgctcaagatcttcctgtgctagttggtgaggaaggggaagttaaaaaactcgagaatacaggtatagaggctaatgttttgtgtttggaaagtgagatttctgaaaatattcttgaaaaaggaggtgatccattggaaaagcaagaccagatatctggactttcacaatcagaggtaaagacagatgtatgtacagttcatcttccaaatgattttcctacatgtttaacatctgaaagcaaagtgtaccaacctgtatcttgtcccctaagtgacttatctgagaatgtagagtcagtggttaatgaagaaaaaataacagagagttccctagtagaaattactgaacataaagattttacactaaaaacagaggagcttatagagagccccaagttagaatcttctgagggtgaaattatacagacagtggacagacaatctgttaagagcccagaggttcaattgcttgggcatgttgaaactgaagatgtagaaataattgcaacatgtgatacttttgggaatgaagatttcaataatattcaagactctgaaaataacttactaaaaaataatcttctgaacaccaaattggaaaaatctttagaagaaaagaatgaatcgctgaccgaacatcctagatctacagagttgcctaaaacacacattgaacagattcagaagcattttagtgaggacaacaatgaaatgatacctatggagtgtgattcattttgcagtgaccaaaatgaatctgaagttgaaccatctgtaaatgctgatcttaaacaaatgaatgaaaattctgtgacacactgttctgaaaataatatgccgtcttctgatcttgcggatgaaaaggttgaaactgtttctcaaccatctgaaagcccaaaagataccatagataaaaccaaaaagcctcgtactcgaagatctagatttcattctccatctacaacttggtcacccaacaaagacactccacaagaaaagaagcggccccagtctccatctcccagaagagaaactgggaaagaaagcaggaagtctcaatcaccatctcctaagaatgagtcagccagaggccggaaaaaatcccgttctcagtccccaaaaaaggatattgcaagagaaaggaggcaatctcagtctcggtctccaaaaagggatactactagggaaagcagaagatctgaatcactgtccccaagaagagaaacttctagagagaacaaaagatctcagccaagagtgaaagattcttccccaggagaaaaatccaggtcccagagcagagaacgagaaagtgatagagatgggcagaggagagagagagaaaggagaaccagaaagtggtctaggtccagatctcattctaggtccccctcaagatgtagaacaaaaagtaagagttcatcatttggtagaattgacagagatagttactctccccggtggaagggaagatgggcaaatgatggttggagatgtccacgaggaaatgatcggtacagaaagaatgacccagagaaacagaatgaaaat

SEQ ID NO: 186331 - DNA, 3934 bp, Homo sapiens
  Payload ID: 16692
  Gene Symbol: SCAF11
  Gene Name: SR-related CTD-associated factor 11
  ENST ID: ENST00000549162
  CDS Start-End: 119-3934
tacaggaaactctttatacagtgaaacaggaggaaagaaaaatgcagcaataaagataaataagcctcagagatcaaattggagtacaaatcagtgcttcagaaattttttctccaatatgttttcttctgttagccactctggagaatcttcctttacctatagagcttattgtacagaatttatagaagccagtgaaatcagtgcattgattaggcagaagagacatgaactggaattgtcatggtttcctgatacattacctggaattggaagaattggttttataccctggaatgttgaaacagaagtccttcctctcatttcttctgtgttgccaagaactatttttccaacaagtaccatatctttcgaacattttggtacttcttgcaagggatatgcattagcacatactcaagaaggggaagaaaagaagcaaacttctggtacatcaaataccagaggatcaagacgaaaacctgcaatgacaactcctacaaggaggtctacacgtaacacaagagctgaaacagccagtcagtctcagagatccccaatatcagacaattctgggtgtgatgccccaggtaacagtaatccatctttaagtgttccctcttcagctgagtcagaaaagcaaacaagacaggctccaaaacggaagtctgtaagaagaggaagaaaaccacctttactgaaaaagaaacttcggagctctgtagctgcccctgaaaaatcatcttccaatgattcagtagatgaagaaacagcagaatctgacacatcacctgtgttagaaaaagagcaccaaccagatgtagacagtagtaacatttgtactgtgcagactcatgtagaaaaccagtctgctaattgcttgaaaagttgcaatgagcaaatagaagaaagtgagaagcatactgcaaattatgatacagaggaaagagtaggatcttcatcttctgagtcttgtgctcaagatcttcctgtgctagttggtgaggaaggggaagttaaaaaactcgagaatacaggtatagaggctaatgttttgtgtttggaaagtgagatttctgaaaatattcttgaaaaaggaggtgatccattggaaaagcaagaccagatatctggactttcacaatcagaggtaaagacagatgtatgtacagttcatcttccaaatgattttcctacatgtttaacatctgaaagcaaagtgtaccaacctgtatcttgtcccctaagtgacttatctgagaatgtagagtcagtggttaatgaagaaaaaataacagagagttccctagtagaaattactgaacataaagattttacactaaaaacagaggagcttatagagagccccaagttagaatcttctgagggtgaaattatacagacagtggacagacaatctgttaagagcccagaggttcaattgcttgggcatgttgaaactgaagatgtagaaataattgcaacatgtgatacttttgggaatgaagatttcaataatattcaagactctgaaaataacttactaaaaaataatcttctgaacaccaaattggaaaaatctttagaagaaaagaatgaatcgctgaccgaacatcctagatctacagagttgcctaaaacacacattgaacagattcagaagcattttagtgaggacaacaatgaaatgatacctatggagtgtgattcattttgcagtgaccaaaatgaatctgaagttgaaccatctgtaaatgctgatcttaaacaaatgaatgaaaattctgtgacacactgttctgaaaataatatgccgtcttctgatcttgcggatgaaaaggttgaaactgtttctcaaccatctgaaagcccaaaagataccatagataaaaccaaaaagcctcgtactcgaagatctagatttcattctccatctacaacttggtcacccaacaaagacactccacaagaaaagaagcggccccagtctccatctcccagaagagaaactgggaaagaaagcaggaagtctcaatcaccatctcctaagaatgagtcagccagaggccggaaaaaatcccgttctcagtccccaaaaaaggatattgcaagagaaaggaggcaatctcagtctcggtctccaaaaagggatactactagggaaagcagaagatctgaatcactgtccccaagaagagaaacttctagagagaacaaaagatctcagccaagagtgaaagattcttccccaggagaaaaatccaggtcccagagcagagaacgagaaagtgatagagatgggcagaggagagagagagaaaggagaaccagaaagtggtctaggtccagatctcattctaggtccccctcaagatgtagaacaaaaagtaagagttcatcatttggtagaattgacagagatagttactctccccggtggaagggaagatgggcaaatgatggttggagatgtccacgaggaaatgatcggtacagaaagaatgacccagagaaacagaatgaaaatacaagaaaagaaaaaaatgacatccatctagatgctgatgatccaaattctgctgacaaacatagaaatgactgtcccaattggataacagaaaaaataaactctgggcctgatccaagaaccagaaatccagaaaagttgaaagagtctcattgggaagaaaatagaaatgaaaattcaggaaattcttggaataaaaactttggttctggttgggtatctaaccgtggtagaggcagaggcaaccgtggcagaggcacttacagaagtagttttgcctataaagatcagaatgaaaatcggtggcaaaatcgaaaacccctctcagggaattcaaacagttcagggagtgaatctttcaagtttgtggaacagcaatcctataagcgaaaaagtgaacaggagttctcatttgatacaccagcagatagatctggatggacatctgcatccagctgggccgtgagaaagactttgccagcagatgtacaaaactactactcacgacgaggcagaaattcttcaggtccacagtctggatggatgaaacaagaggaggaaacatctggacaggattctagcctaaaagaccaaacaaaccagcaagttgatggttctcagctacctataaatatgatgcaaccgcaaatgaatgtaatgcagcaacaaatgaatgcacaacaccagcctatgaatatcttcccatatccagtgggtgttcatgctcctttgatgaacatccaacgcaatccatttaacattcatcctcagctacccttgcatctccacacaggagtgcccctcatgcaggtagccactcctaccagtgtatctcagggactaccaccaccaccaccccctcccccaccatcccaacaagtcaactacattgcttcacaaccagatggaaagcaattgcagggtattcctagttcttctcatgtaagtaataacatgagtacaccagttttgcctgctccgacagcagccccaggaaatacgggaatggttcagggaccaagttctggtaatacttcgtcatcaagtcacagcaaagcctctaatgctgctgtaaaattggcagaaagcaaagtaagtgttgcagtggaagccagcgcagatagctcgaagacagacaagaaattgcaaattcaagaaaaagcagcacaagaggtaaaattggccatcaagccattttaccaaaataaagatatcaccaaggaagaatataaagaaattgtacggaaagcagtagataaagtttgtcatagtaagagtggagaagtaaattctactaaagtggcaaatctggttaaagcctatgtagacaaatacaaatattcacggaaggggagccaaaagaaaactctggaagaacctgtgtctactgaaaaaaacataggctga

SEQ ID NO: 186332 - DNA, 5296 bp, Homo sapiens
  Payload ID: 16692
  Gene Symbol: SCAF11
  Gene Name: SR-related CTD-associated factor 11
  Uniprot ID: Q99590
  ENST ID: ENST00000465950
  CDS Start-End: 1211-4657
gaataacagttaagttttggggagtaaaaactgtttcaatttttgactgtgttgggggttggtgctcctaatccctgtgttgttaaagggtcgactatattgtatttttgaaaattgctagagagtggacgtaaagtgttctcactaaacaaattataactatgtgaggtagtgcatatattaagtagctagatttggtcattccacaatgtatatgtacttcaaaacatcatgttgtacatgagaaacacagttttatctgttagtcagttttaaaaataaaaaatattccaactagaaactctgttgtagtttttgaaattacaacttggaggctttgaggaactgattagaagtctcctttctgtttcaggctttcatatccaaaccatagatctttagaagtaacatctgttaattaattattaataaatagtttgagtctttattaattcatggataacttgaccattttctctctccttttgcttagataatcccagatcatggccgggcacagtagctcacgcctgtattcccagcagtttgggaggccgaggcaggcagatcacttgaactcaggagtttgagaccagcttgggcaacatggcaaaaccctgtctctattaaaaatacaaaaattagctgggcatggtagtgcatgcctgtagtcccagctacctgggaggctgaggtgggaggatcgcttgagcctgggaggttgaggcttctgtgcgcgatgattgctccagtgatcacgccattgcactccagcctgggtgacagagtgagaccctgtctccaaaaaaaaaaaaaattaagcaagtagcagttacaagaccaaaagttattttcctttttttttttctctataaaattgcccatttggaccaaatctagttataacttatttcagtgtcattaagaaagttgatgaataagtcatattactcagatgttagtagctatgcatttattaatagttttatttataagtatttagtttcactctgttgcagactattttatgctaaaattagctaaagccaaattactatttcttaaaacatattttttactttttttttttttttaaatattattaggtacttcttgcaagggatatgcattagcacatactcaagaaggggaagaaaagaagcaaacttctggtacatcaaataccagaggatcaagacgaaaacctgcaatgacaactcctacaaggaggtctacacgtaacacaagagctgaaacagccagtcagtctcagagatccccaatatcagacaattctgggtgtgatgccccaggtaacagtaatccatctttaagtgttccctcttcagctgagtcagaaaagcaaacaagacaggctccaaaacggaagtctgtaagaagaggaagaaaaccacctttactgaaaaagaaacttcggagctctgtagctgcccctgaaaaatcatcttccaatgattcagtagatgaagaaacagcagaatctgacacatcacctgtgttagaaaaagagcaccaaccagatgtagacagtagtaacatttgtactgtgcagactcatgtagaaaaccagtctgctaattgcttgaaaagttgcaatgagcaaatagaagaaagtgagaagcatactgcaaattatgatacagaggaaagagtaggatcttcatcttctgagtcttgtgctcaagatcttcctgtgctagttggtgaggaaggggaagttaaaaaactcgagaatacaggtatagaggctaatgttttgtgtttggaaagtgagatttctgaaaatattcttgaaaaaggaggtgatccattggaaaagcaagaccagatatctggactttcacaatcagaggtaaagacagatgtatgtacagttcatcttccaaatgattttcctacatgtttaacatctgaaagcaaagtgtaccaacctgtatcttgtcccctaagtgacttatctgagaatgtagagtcagtggttaatgaagaaaaaataacagagagttccctagtagaaattactgaacataaagattttacactaaaaacagaggagcttatagagagccccaagttagaatcttctgagggtgaaattatacagacagtggacagacaatctgttaagagcccagaggttcaattgcttgggcatgttgaaactgaagatgtagaaataattgcaacatgtgatacttttgggaatgaagatttcaataatattcaagactctgaaaataacttactaaaaaataatcttctgaacaccaaattggaaaaatctttagaagaaaagaatgaatcgctgaccgaacatcctagatctacagagttgcctaaaacacacattgaacagattcagaagcattttagtgaggacaacaatgaaatgatacctatggagtgtgattcattttgcagtgaccaaaatgaatctgaagttgaaccatctgtaaatgctgatcttaaacaaatgaatgaaaattctgtgacacactgttctgaaaataatatgccgtcttctgatcttgcggatgaaaaggttgaaactgtttctcaaccatctgaaagcccaaaagataccatagataaaaccaaaaagcctcgtactcgaagatctagatttcattctccatctacaacttggtcacccaacaaagacactccacaagaaaagaagcggccccagtctccatctcccagaagagaaactgggaaagaaagcaggaagtctcaatcaccatctcctaagaatgagtcagccagaggccggaaaaaatcccgttctcagtccccaaaaaaggatattgcaagagaaaggaggcaatctcagtctcggtctccaaaaagggatactactagggaaagcagaagatctgaatcactgtccccaagaagagaaacttctagagagaacaaaagatctcagccaagagtgaaagattcttccccaggagaaaaatccaggtcccagagcagagaacgagaaagtgatagagatgggcagaggagagagagagaaaggagaaccagaaagtggtctaggtccagatctcattctaggtccccctcaagatgtagaacaaaaagtaagagttcatcatttggtagaattgacagagatagttactctccccggtggaagggaagatgggcaaatgatggttggagatgtccacgaggaaatgatcggtacagaaagaatgacccagagaaacagaatgaaaatacaagaaaagaaaaaaatgacatccatctagatgctgatgatccaaattctgctgacaaacatagaaatgactgtcccaattggataacagaaaaaataaactctgggcctgatccaagaaccagaaatccagaaaagttgaaagagtctcattgggaagaaaatagaaatgaaaattcaggaaattcttggaataaaaactttggttctggttgggtatctaaccgtggtagaggcagaggcaaccgtggcagaggcacttacagaagtagttttgcctataaagatcagaatgaaaatcggtggcaaaatcgaaaacccctctcagggaattcaaacagttcagggagtgaatctttcaagtttgtggaacagcaatcctataagcgaaaaagtgaacaggagttctcatttgatacaccagcagatagatctggatggacatctgcatccagctgggccgtgagaaagactttgccagcagatgtacaaaactactactcacgacgaggcagaaattcttcaggtccacagtctggatggatgaaacaagaggaggaaacatctggacaggattctagcctaaaagaccaaacaaaccagcaagttgatggttctcagctacctataaatatgatgcaaccgcaaatgaatgtaatgcagcaacaaatgaatgcacaacaccagcctatgaatatcttcccatatccagtgggtgttcatgctcctttgatgaacatccaacgcaatccatttaacattcatcctcagctacccttgcatctccacacaggagtgcccctcatgcaggtagccactcctaccagtgtatctcagggactaccaccaccaccaccccctcccccaccatcccaacaagtcaactacattgcttcacaaccagatggaaagcaattgcagggtattcctagttcttctcatgtaagtaataacatgagtacaccagttttgcctgctccgacagcagccccaggaaatacgggaatggttcagggaccaagttctggtaatacttcgtcatcaagtcacagcaaagcctctaatgctgctgtaaaattggcagaaagcaaagtaagtgttgcagtggaagccagcgcagatagctcgaagacagacaagaaattgcaaattcaagaaaaagcagcacaagaggtaaaattggccatcaagccattttaccaaaataaagatatcaccaaggaagaatataaagaaattgtacggaaagcagtagataaagtttgtcatagtaagagtggagaagtaaattctactaaagtggcaaatctggttaaagcctatgtagacaaatacaaatattcacggaaggggagccaaaagaaaactctggaagaacctgtgtctactgaaaaaaacataggctgaaatggggaacgctgtcaaggacattatcaggatatctgcaaagtgcaatttcaacatgtaccattaactgaaaatcatacataactgtgattgaaatttggttttgataaaattatttttttaacataggatatgatgttttgttctaaataaatataggtctgcactgcaacttctgtatccttccttcccctccaccctcccccacaaaattcaagggaaagtaaagggtttaaaggaatgtgcatctttactaggactgtgttatagtgtggatactggaaaatgtatagctttttgattagggcaatggagtgcataaattagaaacttctaagtgcactggttttcaaagagatatatataatgcatttattctgtcaggttaaaatgtaaagtatgatctttatgattttttccctctaattatagaaagttaaataatgtattaccatgaaaaatgtttctaatattaaatagaacatatcagttgcaaagttcctaatgtgtatttttaaagcacatatctgaataaattgcctagatagaaaaaaaattatcacgagtaaaatttagtgttcaaaacattgagacactcttcacctattgtatgaccaaataaaggttatgctgcttgtt

SEQ ID NO: 186333 - DNA, 507 bp, Homo sapiens
  Payload ID: 16692
  Gene Symbol: SCAF11
  Gene Name: SR-related CTD-associated factor 11
  ENST ID: ENST00000550893
  CDS Start-End: 1-457
tcccccaccatcccaacaagtcaactacattgcttcacaaccagatggaaagcaattgcagggtattcctagttcttctcatgtaagtaataacatgagtacaccagttttgcctgctccgacagcagccccaggaaatacgggaatggttcagggaccaagttctggtaatacttcgtcatcaagtcacagcaaagcctctaatgctgctgtaaaattggcagaaagcaaagtaagtgttgcagtggaagccagcgcagatagctcgaagacagacaagaaattgcaaattcaagaaaaagcagcacaagaggtaaaattggccatcaagccattttaccaaaataaagatatcaccaaggaagaatataaagaaattgtacggaaagcagtagataaagtaagttatggctttagtggagtatgtgcacgttgttttgaaccacctctgttttaataaatgaatgctgaagtttaattaaaataataaaagctagctcctactaa

SEQ ID NO: 186334 - DNA, 324 bp, Homo sapiens
  Payload ID: 16692
  Gene Symbol: SCAF11
  Gene Name: SR-related CTD-associated factor 11
  ENST ID: ENST00000551391
  CDS Start-End: 1-215
taaaaaaacagctgagagaaacaaaagacaagaaaaatgaaaactcatttgagaaacaggtctcctgtcatgaaaattctaaaagctgtataagaagaaaagccatcgtaagagaagatctattaagtgcaaaagtttgtgacttgaagtggatacatagtaagttactttttgcttgtggattctacctttttttttgttgttttttaatttaatggttgtgtcagagttctcatcagtaacacttcaggctggaaaatagtcctcagaactctgtacattgtgttaaatcctacataaattttgttttcatggagcaattta

SEQ ID NO: 186335 - DNA, 4193 bp, Homo sapiens
  Payload ID: 16693
  Gene Symbol: SCAF4
  Gene Name: SR-related CTD-associated factor 4
  Uniprot ID: O95104
  ENST ID: ENST00000286835
  CDS Start-End: 384-3827
cgctggagagagggagagagaggcccgcccgctcgccggccgggccagtgtgagccagtgcgtgagggcgcggggggccgtgtcagcgagacgcagagcgcagccgccaccaccaaacggacatgttgaagaccagcgctgccgccgcctccttttcctcatcctgcgaacgggactgagagggggcccgccacctctccgcctctgcctcggccgcccgcctcgccgcttcgggcgcagcctcttcctgcccgggcctcggactccgccgctcgtcgcctccccccggccaccaggcccggctggtttcccagccccgctccgccgcggcgcgaggtctatgtgaccggcgggcccggagcagccgccgccgcagcgcgaacatggacgccgtcaacgccttcaaccaggagctcttttcgcttatggatatgaaacctcccatctctagagccaagatgattctcatcactaaagctgctattaaagctattaagctttataagcatgtagttcaaatagtagaaaagttcatcaaaaagtgtaaaccagaatacaaggttccgggattatatgtaattgactcaattgtgcgacagtctcgtcatcagtttggaactgataaagatgtttttgggccaagattctctaaaaacataactgccacattccaatatttatatctttgtccatctgaagataagagtaaaatagttcgtgtgctgaacctttggcaaaaaaatggagtgttcaaaattgaaattattcaacctcttttggacatggcagcgggaaccagtaatgcagccccagtagcagaaaatgttaccaataatgaaggctcacctccacctccagtaaaagtttcttctgaacctcccacacaagccactccaaactccgtcccagctgtaccacagttgcccagctctgatgcttttgctgctgtggctcagctgtttcagacaactcaaggccaacagcttcagcagatccttcagacttttcaacagcctccaaaaccacagtctcctgcccttgacaatgctgtgatggctcaggttcaggctatcacagctcagttaaagacaactcctacacaaccatctgaacaaaaagctgctttccccccacctgaacagaaaactgcatttgacaagaagttgcttgatagatttgactatgatgatgagccagaagctgtggaagaatcaaagaaagaggataccactgccgtcaccacgacagcacctgctgccgcagtaccccctgcacccaccgccaccgtgcctgctgctgctgcacccgctgctgcctctcctcctcctccacaggcaccatttggctttcctggagatggcatgcagcagccagcatacacacagcatcaaaatatggatcagtttcagccacgaatgatgggaatacaacaggatccaatgcaccatcaggttccacttcctcctaatggacaaatgccaggatttggacttcttcctacacctccatttcctcccatggctcagcctgtgattcctccaactccaccagtgcagcagcctttccaagcttcttttcaggcacaaaatgaaccacttacacagaagccgcatcagcaggaaatggaagtagaacaaccttgtattcaagaggttaagcgacatatgtctgataacagaaagtcaagatctaggtcagcatccaggtcaccaaaaaggaggcgatctagatctggttctagatctcgaaggtctcggcatcgacgttctcgatctcggtccagggatagacgccgacattctccccgatctcgatctcaagaaagacgggatcgagaaaaagagagagaacgtcgacaaaaaggcctccctcaagtgaaaccggaaactgcaagtgtttgcagtactaccctctgggtggggcagctggacaaaagaactactcagcaggatgttgccagtctcttggaagagtttggtccaattgaatcaattaatatgattcctcccaggggttgtgcctatattgttatggttcataggcaagatgcctatcgtgccctgcagaaactgagccgaggaaactataaagtgaaccagaaatccataaagattgcctgggccttaaacaaaggaataaaggcagattataagcagtattgggatgtagaacttggtgttacttatattccatgggacaaagtcaagcctgaggaactggagagtttttgtgaaggaggaatgttggacagtgacacacttaacccagattggaaaggaattcctaagaagcctgaaaatgaagttgctcaaaatggaggtgctgaaacctcacacacagaaccagtatcacccatacctaaaccattacctgtgcctgtccctcctattcctgttcctgcacctataacagtgccacctccacaggtcccaccacatcaaccgggtccacctgtagttggtgctctccagccgcctgctttcacgcctcctctgggaataccgcctccaggctttggtcctggtgttcctcctccccctcctcctccaccatttttgcgcccaggattcaacccaatgcatttaccaccaggttttctgcctcctggacccccacctcctataactccaccagtatccattcctcctcctcacactccaccaataagcatcccaaactctactatcgctggtataaatgaagacactacaaaagacttatctattggaaatcccattccaacagtggtgtctggggctagaggaaacgccgagtctggtgacagcgtgaaaatgtatggctctgccgtgccacctgctgcacccacgaatctgcccacccctcctgtaacccagcctgtttcacttcttggcactcaaggagttgcccctggtcctgtaattggacttcaggcaccatctactggtcttcttggcgcccggcccggtctcatcccactccagcgccctccaggaatgcccccacctcacttacagcggttccctttgatgccgccccgtcccatgccaccgcacatgatgcacagaggcccaccgccaggaccagggggctttgcgatgcctccacctcatggaatgaaaggtcccttcccaccgcatggcccctttgttaggcctggtggaatgccagggctcgggggcccagggccaggcccagggggtcctgaagacagagacggaaggcaacagccgccgcagcagccacagcagcagccacagccgcaggcgccccagcaaccacagcagcagcagcagcagcagccaccaccatcacaacagcctccaccaacacagcagcagccacagcagtttagaaatgataacaggcagcagttcaattcaggtagagaccaagaaaggtttggaagaagatcttttggaaatagggtggaaaatgaccgggaacggtatgggaaccgtaatgatgatagagataatagtaaccgtgacaggagagagtggggaaggaggagccctgaccgggacaggcacagagacttggaagagagaaatagacgctctagtgggcatcgagacagagagagagattctagagatagagagtctcgtagagagaaggaagaagcccgaggaaaggaaaagcctgaggtgacagacagggcaggtggtaacaaaaccgttgaacctcccattagccaagtgggaaatgtagacactgcttcagaacttgagaagggggtgtctgaggctgcagtcctaaagccttctgaagagttacctgctgaggctacctcatccgttgaacccgaaaaggattctggctcagcagcagaggctcctcgttagagactggaatttgtgaaaatgtgacagtgacacttcctggagtgtagagcttgaggtgtacagatgctgtattatatccgctcccgctgtactgcagccccgcgccagctggtggggaactgtaagcaatttgattgcttcccttctatttaaaaatagccacaaaataacaaaaaatactgaaaatatgaataaatattaccctttttgctgtaactttttaaaagttttgactttaaaaagtttacaaatcgtaattagaagtgctctctatttttttttttttttttaatttaagacaaggtaacggtgaaagctcctcaaaacaatagggatgtttttaataaactctattttcgtaacaaa

SEQ ID NO: 186336 - DNA, 4127 bp, Homo sapiens
  Payload ID: 16693
  Gene Symbol: SCAF4
  Gene Name: SR-related CTD-associated factor 4
  Uniprot ID: O95104
  ENST ID: ENST00000399804
  CDS Start-End: 384-3761
cgctggagagagggagagagaggcccgcccgctcgccggccgggccagtgtgagccagtgcgtgagggcgcggggggccgtgtcagcgagacgcagagcgcagccgccaccaccaaacggacatgttgaagaccagcgctgccgccgcctccttttcctcatcctgcgaacgggactgagagggggcccgccacctctccgcctctgcctcggccgcccgcctcgccgcttcgggcgcagcctcttcctgcccgggcctcggactccgccgctcgtcgcctccccccggccaccaggcccggctggtttcccagccccgctccgccgcggcgcgaggtctatgtgaccggcgggcccggagcagccgccgccgcagcgcgaacatggacgccgtcaacgccttcaaccaggagctcttttcgcttatggatatgaaacctcccatctctagagccaagatgattctcatcactaaagctgctattaaagctattaagctttataagcatgtagttcaaatagtagaaaagttcatcaaaaagtgtaaaccagaatacaaggttccgggattatatgtaattgactcaattgtgcgacagtctcgtcatcagtttggaactgataaagatgtttttgggccaagattctctaaaaacataactgccacattccaatatttatatctttgtccatctgaagataagagtaaaatagttcgtgtgctgaacctttggcaaaaaaatggagtgttcaaaattgaaattattcaacctcttttggacatggcagcgggaaccagtaatgcagccccagtagcagaaaatgttaccaataatgaaggctcacctccacctccagtaaaagtttcttctgaacctcccacacaagccactccaaactccgtcccagctgtaccacagttgcccagctctgatgcttttgctgctgtggctcagctgtttcagacaactcaaggccaacagcttcagcagatccttcagacttttcaacagcctccaaaaccacagtctcctgcccttgacaatgctgtgatggctcaggttcaggctatcacagctcagttaaagacaactcctacacaaccatctgaacaaaaagctgctttccccccacctgaacagaaaactgcatttgacaagaagttgcttgatagatttgactatgatgatgagccagaagctgtggaagaatcaaagaaagaggataccactgccgtcaccacgacagcacctgctgccgcagtaccccctgcacccaccgccaccgtgcctgctgctgctgcacccgctgctgcctctcctcctcctccacaggcaccatttggctttcctggagatggcatgcagcagccagcatacacacagcatcaaaatatggatcagtttcagccacgaatgatgggaatacaacaggatccaatgcaccatcaggttccacttcctcctaatggacaaatgccaggatttggacttcttcctacacctccatttcctcccatggctcagcctgtgattcctccaactccaccagtgcagcagcctttccaagcttcttttcaggcacaaaatgaaccacttacacagaagccgcatcagcaggaaatggaagtagaacaaccttgtattcaagaggttaagcgacatatgtctgataacagaaagtcaagatctaggtcagcatccaggtcaccaaaaaggaggcgatctagatctggttctagatctcgaaggtctcggcatcgacgttctcgatctcggtccagggatagacgccgacattctccccgatctcgatctcaagaaagacgggatcgagaaaaagagagagaacgtcgacaaaaaggcctccctcaagtgaaaccggaaactgcaagtgtttgcagtactaccctctgggtggggcagctggacaaaagaactactcagcaggatgttgccagtctcttggaagagtttggtccaattgaatcaattaatatgattcctcccaggggttgtgcctatattgttatggttcataggcaagatgcctatcgtgccctgcagaaactgagccgaggaaactataaagtgaaccagaaatccataaagattgcctgggccttaaacaaaggaataaaggcagattataagcagtattgggatgtagaacttggtgttacttatattccatgggacaaagtcaagcctgaggaactggagagtttttgtgaaggaggaatgttggacagtgacacacttaacccagattggaaaggaattcctaagaagcctgaaaatgaagttgctcaaaatggaggtgctgaaacctcacacacagaaccagtatcacccatacctaaaccattacctgtgcctgtccctcctattcctgttcctgcacctataacagtgccacctccacaggtcccaccacatcaaccgggtccacctgtagttggtgctctccagccgcctgctttcacgcctcctctgggaataccgcctccaggctttggtcctggtgttcctcctccccctcctcctccaccatttttgcgcccaggattcaacccaatgcatttaccaccaggttttctgcctcctggacccccacctcctataactccaccagtatccattcctcctcctcacactccaccaataagcatcccaaacttggtgtctggggctagaggaaacgccgagtctggtgacagcgtgaaaatgtatggctctgccgtgccacctgctgcacccacgaatctgcccacccctcctgtaacccagcctgtttcacttcttggcactcaaggagttgcccctggtcctgtaattggacttcaggcaccatctactggtcttcttggcgcccggcccggtctcatcccactccagcgccctccaggaatgcccccacctcacttacagcggttccctttgatgccgccccgtcccatgccaccgcacatgatgcacagaggcccaccgccaggaccagggggctttgcgatgcctccacctcatggaatgaaaggtcccttcccaccgcatggcccctttgttaggcctggtggaatgccagggctcgggggcccagggccaggcccagggggtcctgaagacagagacggaaggcaacagccgccgcagcagccacagcagcagccacagccgcaggcgccccagcaaccacagcagcagcagcagcagcagccaccaccatcacaacagcctccaccaacacagcagcagccacagcagtttagaaatgataacaggcagcagttcaattcaggtagagaccaagaaaggtttggaagaagatcttttggaaatagggtggaaaatgaccgggaacggtatgggaaccgtaatgatgatagagataatagtaaccgtgacaggagagagtggggaaggaggagccctgaccgggacaggcacagagacttggaagagagaaatagacgctctagtgggcatcgagacagagagagagattctagagatagagagtctcgtagagagaaggaagaagcccgaggaaaggaaaagcctgaggtgacagacagggcaggtggtaacaaaaccgttgaacctcccattagccaagtgggaaatgtagacactgcttcagaacttgagaagggggtgtctgaggctgcagtcctaaagccttctgaagagttacctgctgaggctacctcatccgttgaacccgaaaaggattctggctcagcagcagaggctcctcgttagagactggaatttgtgaaaatgtgacagtgacacttcctggagtgtagagcttgaggtgtacagatgctgtattatatccgctcccgctgtactgcagccccgcgccagctggtggggaactgtaagcaatttgattgcttcccttctatttaaaaatagccacaaaataacaaaaaatactgaaaatatgaataaatattaccctttttgctgtaactttttaaaagttttgactttaaaaagtttacaaatcgtaattagaagtgctctctatttttttttttttttttaatttaagacaaggtaacggtgaaagctcctcaaaacaatagggatgtttttaataaactctattttcgtaacaaa

SEQ ID NO: 186337 - DNA, 3846 bp, Homo sapiens
  Payload ID: 16693
  Gene Symbol: SCAF4
  Gene Name: SR-related CTD-associated factor 4
  Uniprot ID: O95104
  ENST ID: ENST00000434667
  CDS Start-End: 277-3675
caccaccaaacggacatgttgaagaccagcgctgccgccgcctccttttcctcatcctgcgaacgggactgagagggggcccgccacctctccgcctctgcctcggccgcccgcctcgccgcttcgggcgcagcctcttcctgcccgggcctcggactccgccgctcgtcgcctccccccggccaccaggcccggctggtttcccagccccgctccgccgcggcgcgaggtctatgtgaccggcgggcccggagcagccgccgccgcagcgcgaacatggacgccgtcaacgccttcaaccaggagctcttttcgcttatggatatgaaacctcccatctctagagccaagatgattctcatcactaaagctgctattaaagctattaagtgtaaaccagaatacaaggttccgggattatatgtaattgactcaattgtgcgacagtctcgtcatcagtttggaactgataaagatgtttttgggccaagattctctaaaaacataactgccacattccaatatttatatctttgtccatctgaagataagagtaaaatagttcgtgtgctgaacctttggcaaaaaaatggagtgttcaaaattgaaattattcaacctcttttggacatggcagcgggaaccagtaatgcagccccagtagcagaaaatgttaccaataatgaaggctcacctccacctccagtaaaagtttcttctgaacctcccacacaagccactccaaactccgtcccagctgtaccacagttgcccagctctgatgcttttgctgctgtggctcagctgtttcagacaactcaaggccaacagcttcagcagatccttcagacttttcaacagcctccaaaaccacagtctcctgcccttgacaatgctgtgatggctcaggttcaggctatcacagctcagttaaagacaactcctacacaaccatctgaacaaaaagctgctttccccccacctgaacagaaaactgcatttgacaagaagttgcttgatagatttgactatgatgatgagccagaagctgtggaagaatcaaagaaagaggataccactgccgtcaccacgacagcacctgctgccgcagtaccccctgcacccaccgccaccgtgcctgctgctgctgcacccgctgctgcctctcctcctcctccacaggcaccatttggctttcctggagatggcatgcagcagccagcatacacacagcatcaaaatatggatcagtttcagccacgaatgatgggaatacaacaggatccaatgcaccatcaggttccacttcctcctaatggacaaatgccaggatttggacttcttcctacacctccatttcctcccatggctcagcctgtgattcctccaactccaccagtgcagcagcctttccaagcttcttttcaggcacaaaatgaaccacttacacagaagccgcatcagcaggaaatggaagtagaacaaccttgtattcaagaggttaagcgacatatgtctgataacagaaagtcaagatctaggtcagcatccaggtcaccaaaaaggaggcgatctagatctggttctagatctcgaaggtctcggcatcgacgttctcgatctcggtccagggatagacgccgacattctccccgatctcgatctcaagaaagacgggatcgagaaaaagagagagaacgtcgacaaaaaggcctccctcaagtgaaaccggaaactgcaagtgtttgcagtactaccctctgggtggggcagctggacaaaagaactactcagcaggatgttgccagtctcttggaagagtttggtccaattgaatcaattaatatgattcctcccaggggttgtgcctatattgttatggttcataggcaagatgcctatcgtgccctgcagaaactgagccgaggaaactataaagtgaaccagaaatccataaagattgcctgggccttaaacaaaggaataaaggcagattataagcagtattgggatgtagaacttggtgttacttatattccatgggacaaagtcaagcctgaggaactggagagtttttgtgaaggaggaatgttggacagtgacacacttaacccagattggaaaggaattcctaagaagcctgaaaatgaagttgctcaaaatggaggtgctgaaacctcacacacagaaccagtatcacccatacctaaaccattacctgtgcctgtccctcctattcctgttcctgcacctataacagtgccacctccacaggtcccaccacatcaaccgggtccacctgtagttggtgctctccagccgcctgctttcacgcctcctctgggaataccgcctccaggctttggtcctggtgttcctcctccccctcctcctccaccatttttgcgcccaggattcaacccaatgcatttaccaccaggttttctgcctcctggacccccacctcctataactccaccagtatccattcctcctcctcacactccaccaataagcatcccaaactctactatcgctggtataaatgaagacactacaaaagacttatctattggaaatcccattccaacagtggtgtctggggctagaggaaacgccgagtctggtgacagcgtgaaaatgtatggctctgccgtgccacctgctgcacccacgaatctgcccacccctcctgtaacccagcctgtttcacttcttggcactcaaggagttgcccctggtcctgtaattggacttcaggcaccatctactggtcttcttggcgcccggcccggtctcatcccactccagcgccctccaggaatgcccccacctcacttacagcggttccctttgatgccgccccgtcccatgccaccgcacatgatgcacagaggcccaccgccaggaccagggggctttgcgatgcctccacctcatggaatgaaaggtcccttcccaccgcatggcccctttgttaggcctggtggaatgccagggctcgggggcccagggccaggcccagggggtcctgaagacagagacggaaggcaacagccgccgcagcagccacagcagcagccacagccgcaggcgccccagcaaccacagcagcagcagcagcagcagccaccaccatcacaacagcctccaccaacacagcagcagccacagcagtttagaaatgataacaggcagcagttcaattcaggtagagaccaagaaaggtttggaagaagatcttttggaaatagggtggaaaatgaccgggaacggtatgggaaccgtaatgatgatagagataatagtaaccgtgacaggagagagtggggaaggaggagccctgaccgggacaggcacagagacttggaagagagaaatagacgctctagtgggcatcgagacagagagagagattctagagatagagagtctcgtagagagaaggaagaagcccgaggaaaggaaaagcctgaggtgacagacagggcaggtggtaacaaaaccgttgaacctcccattagccaagtgggaaatgtagacactgcttcagaacttgagaagggggtgtctgaggctgcagtcctaaagccttctgaagagttacctgctgaggctacctcatccgttgaacccgaaaaggattctggctcagcagcagaggctcctcgttagagactggaatttgtgaaaatgtgacagtgacacttcctggagtgtagagcttgaggtgtacagatgctgtattatatccgctcccgctgtactgcagccccgcgccagctggtggggaactgtaagcaatttgattgcttcccttctatttaaaaatagccacaaaataac

SEQ ID NO: 186338 - DNA, 5057 bp, Homo sapiens
  Payload ID: 16694
  Gene Symbol: SCAF8
  Gene Name: SR-related CTD-associated factor 8
  Uniprot ID: Q9UPN6
  ENST ID: ENST00000367178
  CDS Start-End: 577-4392
cggccgccggggctcgcacggtccagtcgccagggggcgcgctagccggcgccgcggatccccgaactgcgcggcccgactcgagtccgccatattggatgccgcagccgctgctgccagcgcttcctcctctgtcttcgccgagcggggctggttcctgcggcccgagcggcggggaggtgaaacaggagcccgtcggaggaaggggcagaagggagtggagagtgtaggggaaggggctagagggagggggaccgaaacggagcggggcagagaagagaaggcgccgcggcccagcccctcccccgcccgccgccgacccgccccggcagcgcctctgttccctagaacggcgctccccccgccctagcggccatgccggtgccgctctgccgctgagggagcccttccccgccagcgcgtgcccttccactccgccccgaggtcgcagcggcccgctctcccgccagcgccccctcctcgcggccacgcagcagcccgcgtctcgctctccccacccagtgcagtggccgccgcctcttccgccgccgggctcggggcctccgcagcgacaacatggaggccgtgaagaccttcaatagcgagttgtattccctgaatgactataaaccacccatttcgaaagcgaaaatgacccaaattactaaggcagccatcaaagctattaagttctataaacatgtggtacagagtgttgagaagtttattcagaaatgtaaaccagaatacaaagtacctggactttatgttattgactccattgtgcgacaatcccgacatcagtttggtcaagaaaaggatgtgtttgcacccagatttagtaataacatcattagcactttccagaatttatatcgttgccctggggatgacaagagtaaaatagtgagagtactaaacttatggcagaagaataatgtatttaagagtgagattattcagccccttttggatatggcagccgggattccgcctccagttgtcacacctgttttggccagcactaccactgctatgagcaatactccaggaactcctgtgacacctgttactccggccaatgtggtccaaggcttacctgatccgtgggtatctcagataacaaatacagatacacttgcggctgtagctcagatcttgcaaagtcctcaaggccagcagcttcaacaattaatacaaaccttacagatacaacaacagaagccccagccttccattctgcaggccctagatgctggtcttgttgttcagttgcaagctcttacggcacaacttacagctgcagctgcagctgccaacactcttactcccttagaacagggagtctcctttaacaagaagttgatggataggtttgattttggggaagactctgagcatagtgaagaacccaaaaaggaaattccagcttcacaactttctcacgtttcagaatctgtgaacaattccatttttcatcagatagcagaacaactacaacagcaaaacctagaacatctcagacagcagctcttggagcagcaacagcctcaaaaggccactcctcaggatagtcaggaaggaacctttgggtcagagcattcagcgtcaccatcacaagggagtagtcagcagcattttcttgaacctgaagtcaatttggatgattccatagatattcagcaacaggatatggatatagatgaagggcaagatggagtggaagaggaggtctttgaacaagaagctaagaaagtggcggttcgctcaagatcaagaacacattcacgatctcgttcaagatcaccaagaaaacgaaggtctaggtcacggtctggctctagaaagcgtaaacacagaaagcgatcacgctcccgctcaagagaaagaaagaggaaatcatcacggtcgtattcaagtgaaaggagagccagagaaagggagaaagaacgacagaaaaagggattacctccaattagatctaaaacactaagtgtatgtagtactactctctgggttgggcaagtggacaagaaggcaacacagcaagacttaaccaacctgtttgaagagtttggacagattgaatccattaatatgattcctccccggggctgtgcttatgtctgcatggttcatcgacaagatgcatttcgagctcttcagaaactcagttctggatcatataaaattgggtccaaggtcattaagatcgcttgggctttaaacaaaggtgtaaaaacagaatacaaacaattctgggatgtggatcttggagttacatatataccatgggaaaaagttaaagtggatgacttggaaggttttgcagaaggaggcatgattgatcaggagactgtaaatactgagtgggaaactgtgaaaagctcagaacctgttaaagagacggtccagacaactcagagcccaactccagttgaaaaggagacagtggtcacaacccaggcagaggttttccctcctcctgttgctatgttgcagattccagtggcgccagccgtgcctacagttagtttagtcccaccagcatttcctgtgtcgatgccggttcctcctcctggattcagtccaatccctccacctccttttttaagagcaagttttaacccttcacaaccaccacctggtttcatgccgcctccagttcccccacctgttgtgccaccccctacgattccaccagtagtaccaacatctttagtgcagccgtcattatccatgacaccggaaactgtgaaagatgttggatttggtagccttgttataccaggcggttctgttgccagcaatcttgctacttccgctctgccagctggaaatgtttttaatgctccaactaaacaggcagagcctgaagaaaaagtacctcatcttatagaccaccagatttcttctggtgaaaacaccagatcagtgattccaaatgatatttcaagtaatgctgcaattttaggaggacagccgccaaatgtgacaagcaattctggaattctgggagtccaaagaccaaatgtatcaagtaattctgaaattcttggggtccggccatctaatgtttccagtagttctgggattattgcagcccaaccaccaaatattctaaataactctggaatattgggaatacagccacccagtgtgtcaaatagttctggacttttgggagtgctacccccaaatatacctaacaattctggacttgtaggagtacagccaccaaatgttccaaatactcctggacttctgggaacacagccaccagctggacctcaaaacttaccccctttaagtatccctaatcaaaggatgcccacaatgccaatgttagacattcgtccgggactaataccacaggcacctgggccaagattccctttaatacagcctggaattccaccccaacggggaatcccacccccatcggtacttgattcagctcttcatccaccaccccgtggaccttttcctccaggagatatttttagtcaaccagaaagaccttttttagctcctggaagacaaagcgtagacaatgttactaacccagaaaaaaggataccacttgggaatgataacattcaacaggaaggagatagagattaccggtttcctcctatagaaaccagggaaagcattagtagacctccccctgtggatgttagagatgtggttgggcggcctatagatccaagagaaggtcctggacggcctccactagatggtagggatcattttggaagacctcctgtagatataagagagaatcttgtgaggccaggtatagatcatcttggtcgaagagaccactttggctttaatccagagaagccctgggggcatagaggagattttgatgagagagagcatcgggttctaccggtctatggtggtccaaaaggcttacatgaagaaagaggtagatttcggtctggaaactatcgatttgatcctagaagtggtccttggaaccgaggatttggacaagaagttcacagagattttgatgaccgcagaagaccctgggagaggcaaagggatagggatgacagagattttgatttctgcagagaaatgaatggaaatcgtcttggacgagacagaattcaaaacacttgggttccccctcctcatgctcgggtttttgattattttgaaggggccacttctcaacgaaaaggtgataatgtgcctcaggttaatggtgaaaatacagagagacatgctcagccaccacctataccagtacagaatgatcctgaactttatgaaaaactgacatcttcaaatgaaataaacaaggagaagagtgacacagttgctgatatagaaagtgaaccagtggtagaaagcacagaaactgaggggacataatcatcactcagtaggtaaaagataccttttgtaaagttgtcatctctctgtaatagataatggctgactggaccatagttgttcacttttgtctgccagaattaagttaatctgatgttcatgttcacctttctcttaaaataattgtacaactgacttgtatagacattgttcttaatatgaacatggtaggtaaactttttttttatttttttctgataaaatacaaatgttggccccagattcttttaacgtcaaggaaatgaataacagcttgtcagagacttcctatggaagaaagaattttttagatactatcattaggttggatatggtaatagatatatttcagaatagcaagtggtggtatatcttatccatatctttaggctgctgcagaattttaaggttatagataaagctgtgatattttatgcaaagactggctctaggtatttgaggagcacaatacagagattttaaaaagtgattttgtaaaatctacactacggtctctgtttctccaaagtaagtgtttgtgatttgttcctcatactgcagtgagtaaaaaagaaacaagaaaacaacaacataaatattaaagtacgtttcaatgttgggtgaattttgtttttagatgccaataaaacttatttgtttgataa

SEQ ID NO: 186339 - DNA, 4908 bp, Homo sapiens
  Payload ID: 16694
  Gene Symbol: SCAF8
  Gene Name: SR-related CTD-associated factor 8
  Uniprot ID: Q9UPN6
  ENST ID: ENST00000367186
  CDS Start-End: 46-4059
gcggatccccgaactgcgcggcccgactcgagtccgccatattggatgccgcagccgctgctgccagcgcttcctcctctgtcttcgccgagcggggctggttcctgcggcccgagcggcggggagtgcagtggccgccgcctcttccgccgccgggctcggggcctccgcagcgacaacatggaggccgtgaagaccttcaatagcgaggattgtgcctctactcctgcttgtacagactgcttttccagcagcatggacacaagaagcatattgtattccctgaatgactataaaccacccatttcgaaagcgaaaatgacccaaattactaaggcagccatcaaagctattaagttctataaacatgtggtacagagtgttgagaagtttattcagaaatgtaaaccagaatacaaagtacctggactttatgttattgactccattgtgcgacaatcccgacatcagtttggtcaagaaaaggatgtgtttgcacccagatttagtaataacatcattagcactttccagaatttatatcgttgccctggggatgacaagagtaaaatagtgagagtactaaacttatggcagaagaataatgtatttaagagtgagattattcagccccttttggatatggcagccgggattccgcctccagttgtcacacctgttttggccagcactaccactgctatgagcaatactccaggaactcctgtgacacctgttactccggccaatgtggtccaaggcttacctgatccgtgggtatctcagataacaaatacagatacacttgcggctgtagctcagatcttgcaaagtcctcaaggccagcagcttcaacaattaatacaaaccttacagatacaacaacagaagccccagccttccattctgcaggccctagatgctggtcttgttgttcagttgcaagctcttacggcacaacttacagctgcagctgcagctgccaacactcttactcccttagaacagggagtctcctttaacaagaagttgatggataggtttgattttggggaagactctgagcatagtgaagaacccaaaaaggaaattccagcttcacaactttctcacgtttcagaatctgtgaacaattccatttttcatcagatagcagaacaactacaacagcaaaacctagaacatctcagacagcagctcttggagcagcaacagcctcaaaaggccactcctcaggatagtcaggaaggaacctttgggtcagagcattcagcgtcaccatcacaagggagtagtcagcagcattttcttgaacctgaagtcaatttggatgattccatagatattcagcaacaggatatggatatagatgaagggcaagatggagtggaagaggaggtctttgaacaagaagctaagaaagtggcggttcgctcaagatcaagaacacattcacgatctcgttcaagatcaccaagaaaacgaaggtctaggtcacggtctggctctagaaagcgtaaacacagaaagcgatcacgctcccgctcaagagaaagaaagaggaaatcatcacggtcgtattcaagtgaaaggagagccagagaaagggagaaagaacgacagaaaaagggattacctccaattagatctaaaacactaagtgtatgtagtactactctctgggttgggcaagtggacaagaaggcaacacagcaagacttaaccaacctgtttgaagagtttggacagattgaatccattaatatgattcctccccggggctgtgcttatgtctgcatggttcatcgacaagatgcatttcgagctcttcagaaactcagttctggatcatataaaattgggtccaaggtcattaagatcgcttgggctttaaacaaaggtgtaaaaacagaatacaaacaattctgggatgtggatcttggagttacatatataccatgggaaaaagttaaagtggatgacttggaaggttttgcagaaggaggcatgattgatcaggagactgtaaatactgagtgggaaactgtgaaaagctcagaacctgttaaagagacggtccagacaactcagagcccaactccagttgaaaaggagacagtggtcacaacccaggcagaggttttccctcctcctgttgctatgttgcagattccagtggcgccagccgtgcctacagttagtttagtcccaccagcatttcctgtgtcgatgccggttcctcctcctggattcagtccaatccctccacctccttttttaagagcaagttttaacccttcacaaccaccacctggtttcatgccgcctccagttcccccacctgttgtgccaccccctacgattccaccagtagtaccaacatctttagtgcagccgtcattatccatgacaccggaaactgtgaaagatgttggatttggtagccttgttataccaggcggttctgttgccagcaatcttgctacttccgctctgccagctggaaatgtttttaatgctccaactaaacaggcagagcctgaagaaaaagtacctcatcttatagaccaccagatttcttctggtgaaaacaccagatcagtgattccaaatgatatttcaagtaatgctgcaattttaggaggacagccgccaaatgtgacaagcaattctggaattctgggagtccaaagaccaaatgtatcaagtaattctgaaattcttggggtccggccatctaatgtttccagtagttctgggattattgcagcccaaccaccaaatattctaaataactctggaatattgggaatacagccacccagtgtgtcaaatagttctggacttttgggagtgctacccccaaatatacctaacaattctggacttgtaggagtacagccaccaaatgttccaaatactcctggacttctgggaacacagccaccagctggacctcaaaacttaccccctttaagtatccctaatcaaaggatgcccacaatgccaatgttagacattcgtccgggactaataccacaggcacctgggccaagattccctttaatacagcctggaattccaccccaacggggaatcccacccccatcggtacttgattcagctcttcatccaccaccccgtggaccttttcctccaggagatatttttagtcaaccagaaagaccttttttagctcctggaagacaaagcgtagacaatgttactaacccagaaaaaaggataccacttgggaatgataacattcaacaggaaggagatagagattaccggtttcctcctatagaaaccagggaaagcattagtagacctccccctgtggatgttagagatgtggttgggcggcctatagatccaagagaaggtcctggacggcctccactagatggtagggatcattttggaagacctcctgtagatataagagagaatcttgtgaggccaggtatagatcatcttggtcgaagagaccactttggctttaatccagagaagccctgggggcatagaggagattttgatgagagagagcatcgggttctaccggtctatggtggtccaaaaggcttacatgaagaaagaggtagatttcggtctggaaactatcgatttgatcctagaagtggtccttggaaccgaggatttggacaagaagttcacagagattttgatgaccgcagaagaccctgggagaggcaaagggatagggatgacagagattttgatttctgcagagaaatgaatggaaatcgtcttggacgagacagaattcaaaacacttgggttccccctcctcatgctcgggtttttgattattttgaaggggccacttctcaacgaaaaggtgataatgtgcctcaggttaatggtgaaaatacagagagacatgctcagccaccacctataccagtacagaatgatcctgaactttatgaaaaactgacatcttcaaatgaaataaacaaggagaagagtgacacagttgctgatatagaaagtgaaccagtggtagaaagcacagaaactgaggggacataatcatcactcagtaggtaaaagataccttttgtaaagttgtcatctctctgtaatagataatggctgactggaccatagttgttcacttttgtctgccagaattaagttaatctgatgttcatgttcacctttctcttaaaataattgtacaactgacttgtatagacattgttcttaatatgaacatggtaggtaaactttttttttatttttttctgataaaatacaaatgttggccccagattcttttaacgtcaaggaaatgaataacagcttgtcagagacttcctatggaagaaagaattttttagatactatcattaggttggatatggtaatagatatatttcagaatagcaagtggtggtatatcttatccatatctttaggctgctgcagaattttaaggttatagataaagctgtgatattttatgcaaagactggctctaggtatttgaggagcacaatacagagattttaaaaagtgattttgtaaaatctacactacggtctctgtttctccaaagtaagtgtttgtgatttgttcctcatactgcagtgagtaaaaaagaaacaagaaaacaacaacataaatattaaagtacgtttcaatgttgggtgaattttgtttttagatgccaataaaacttatttgtttgataacagtgttctaggaattgtatttttttaacctataaattcttaaaaccttgaattattattagcatgtgcttattttttgcaaaagctttctatcataacaacaatgaactatgtggtggaaaaagcatgtactttgatataaaaatcatgcagcctcctcagtatgtgtataatatctgtgtat

SEQ ID NO: 186340 - DNA, 4944 bp, Homo sapiens
  Payload ID: 16694
  Gene Symbol: SCAF8
  Gene Name: SR-related CTD-associated factor 8
  ENST ID: ENST00000417268
  CDS Start-End: 46-4095
gcggatccccgaactgcgcggcccgactcgagtccgccatattggatgccgcagccgctgctgccagcgcttcctcctctgtcttcgccgagcggggctggttcctgcggcccgagcggcggggaggtgaaacaggagcccgtcggaggaaggggcagaagggagtggagagtcgccccctcctcgcggccacgcagcagcccgcgtctcgctctccccacccagtgcagtggccgccgcctcttccgccgccgggctcggggcctccgcagcgacaacatggaggccgtgaagaccttcaatagcgagttgtattccctgaatgactataaaccacccatttcgaaagcgaaaatgacccaaattactaaggcagccatcaaagctattaagttctataaacatgtggtacagagtgttgagaagtttattcagaaatgtaaaccagaatacaaagtacctggactttatgttattgactccattgtgcgacaatcccgacatcagtttggtcaagaaaaggatgtgtttgcacccagatttagtaataacatcattagcactttccagaatttatatcgttgccctggggatgacaagagtaaaatagtgagagtactaaacttatggcagaagaataatgtatttaagagtgagattattcagccccttttggatatggcagccgggattccgcctccagttgtcacacctgttttggccagcactaccactgctatgagcaatactccaggaactcctgtgacacctgttactccggccaatgtggtccaaggcttacctgatccgtgggtatctcagataacaaatacagatacacttgcggctgtagctcagatcttgcaaagtcctcaaggccagcagcttcaacaattaatacaaaccttacagatacaacaacagaagccccagccttccattctgcaggccctagatgctggtcttgttgttcagttgcaagctcttacggcacaacttacagctgcagctgcagctgccaacactcttactcccttagaacagggagtctcctttaacaagaagttgatggataggtttgattttggggaagactctgagcatagtgaagaacccaaaaaggaaattccagcttcacaactttctcacgtttcagaatctgtgaacaattccatttttcatcagatagcagaacaactacaacagcaaaacctagaacatctcagacagcagctcttggagcagcaacagcctcaaaaggccactcctcaggatagtcaggaaggaacctttgggtcagagcattcagcgtcaccatcacaagggagtagtcagcagcattttcttgaacctgaagtcaatttggatgattccatagatattcagcaacaggatatggatatagatgaagggcaagatggagtggaagaggaggtctttgaacaagaagctaagaaagtggcggttcgctcaagatcaagaacacattcacgatctcgttcaagatcaccaagaaaacgaaggtctaggtcacggtctggctctagaaagcgtaaacacagaaagcgatcacgctcccgctcaagagaaagaaagaggaaatcatcacggtcgtattcaagtgaaaggagagccagagaaagggagaaagaacgacagaaaaagggattacctccaattagatctaaaacactaagtgtatgtagtactactctctgggttgggcaagtggacaagaaggcaacacagcaagacttaaccaacctgtttgaagagtttggacagattgaatccattaatatgattcctccccggggctgtgcttatgtctgcatggttcatcgacaagatgcatttcgagctcttcagaaactcagttctggatcatataaaattgggtccaaggtcattaagatcgcttgggctttaaacaaaggtgtaaaaacagaatacaaacaattctgggatgtggatcttggagttacatatataccatgggaaaaagttaaagtggatgacttggaaggttttgcagaaggaggcatgattgatcaggagactgtaaatactgagtgggaaactgtgaaaagctcagaacctgttaaagagacggtccagacaactcagagcccaactccagttgaaaaggagacagtggtcacaacccaggcagaggttttccctcctcctgttgctatgttgcagattccagtggcgccagccgtgcctacagttagtttagtcccaccagcatttcctgtgtcgatgccggttcctcctcctggattcagtccaatccctccacctccttttttaagagcaagttttaacccttcacaaccaccacctggtttcatgccgcctccagttcccccacctgttgtgccaccccctacgattccaccagtagtaccaacatctttagtgcagccgtcattatccatgacaccggaaactgtgaaagatgttggatttggtagccttgttataccaggcggttctgttgccagcaatcttgctacttccgctctgccagctggaaatgtttttaatgctccaactaaacaggcagagcctgaagaaaaagtacctcatcttatagaccaccagatttcttctggtgaaaacaccagatcagtgattccaaatgatatttcaagtaatgctgcaattttaggaggacagccgccaaatgtgacaagcaattctggaattctgggagtccaaagaccaaatgtatcaagtaattctgaaattcttggggtccggccatctaatgtttccagtagttctgggattattgcagcccaaccaccaaatattctaaataactctggaatattgggaatacagccacccagtgtgtcaaatagttctggacttttgggagtgctacccccaaatatacctaacaattctggacttgtaggagtacagccaccaaatgttccaaatactcctggacttctgggaacacagccaccagctggacctcaaaacttaccccctttaagtatccctaatcaaaggatgcccacaatgccaatgttagacattcgtccgggactaataccacaggcacctgggccaagattccctttaatacagcctggaattccaccccaacggggaatcccacccccatcggtacttgattcagctcttcatccaccaccccgtggaccttttcctccaggagatatttttagtcaaccagaaagaccttttttagctcctggaagacaaagcgtagacaatgttactaacccagaaaaaaggataccacttgggaatgataacattcaacaggaaggagatagagattaccggtttcctcctatagaaaccagggaaagcattagtagacctccccctgtggatgttagagatgtggttgggcggcctatagatccaagagaaggtcctggacggcctccactagatggtagggatcattttggaagacctcctgtagatataagagagaatcttgtgaggccaggtatagatcatcttggtcgaagagaccactttggctttaatccagagaagccctgggggcatagaggagattttgatgagagagagcatcgggttctaccggtctatggtggtccaaaaggcttacatgaagaaagaggtagatttcggtctggaaactatcgatttgatcctagaagtggtccttggaaccgaggatttggacaagaagttcacagagattttgatgaccgcagaagaccctgggagaggcaaagggatagggatgacagagattttgatttctgcagagaaatgaatggaaatcgtcttggacgagacagaattcaaaacacttgggttccccctcctcatgctcgggtttttgattattttgaaggggccacttctcaacgaaaaggtgataatgtgcctcaggttaatggtgaaaatacagagagacatgctcagccaccacctataccagtacagaatgatcctgaactttatgaaaaactgacatcttcaaatgaaataaacaaggagaagagtgacacagttgctgatatagaaagtgaaccagtggtagaaagcacagaaactgaggggacataatcatcactcagtaggtaaaagataccttttgtaaagttgtcatctctctgtaatagataatggctgactggaccatagttgttcacttttgtctgccagaattaagttaatctgatgttcatgttcacctttctcttaaaataattgtacaactgacttgtatagacattgttcttaatatgaacatggtaggtaaactttttttttatttttttctgataaaatacaaatgttggccccagattcttttaacgtcaaggaaatgaataacagcttgtcagagacttcctatggaagaaagaattttttagatactatcattaggttggatatggtaatagatatatttcagaatagcaagtggtggtatatcttatccatatctttaggctgctgcagaattttaaggttatagataaagctgtgatattttatgcaaagactggctctaggtatttgaggagcacaatacagagattttaaaaagtgattttgtaaaatctacactacggtctctgtttctccaaagtaagtgtttgtgatttgttcctcatactgcagtgagtaaaaaagaaacaagaaaacaacaacataaatattaaagtacgtttcaatgttgggtgaattttgtttttagatgccaataaaacttatttgtttgataacagtgttctaggaattgtatttttttaacctataaattcttaaaaccttgaattattattagcatgtgcttattttttgcaaaagctttctatcataacaacaatgaactatgtggtggaaaaagcatgtactttgatataaaaatcatgcagcctcctcagtatgtgtataatatctgtgtat

SEQ ID NO: 186341 - DNA, 4286 bp, Homo sapiens
  Payload ID: 16695
  Gene Symbol: SRPK1
  Gene Name: SRSF protein kinase 1
  ENST ID: ENST00000361690
  CDS Start-End: 1-2016
aaaggtgagcggtggagcggcctccgccacgaggggcaatggtcgccggggcgaggcccggtgcttgcgctccaggcccgaaagaaaaggaccaaggccaagaaggacaaagcccaaaggaaatctgaaactcagcaccgaggctctgctccccactctgagagtgatctaccagagcaggaagaggagattctgggatctgatgatgatgagcaagaagatcctaatgattattgtaaaggaggttatcatcttgtgaaaattggagatctattcaatgggagataccatgtgatccgaaagttaggctggggacacttttcaacagtatggttatcatgggatattcaggggaagaaatttgtggcaatgaaagtagttaaaagtgctgaacattacactgaaacagcactagatgaaatccggttgctgaagtcagttcgcaattcagaccctaatgatccaaatagagaaatggttgttcaactactagatgactttaaaatatcaggagttaatggaacacatatctgcatggtatttgaagttttggggcatcatctgctcaagtggatcatcaaatccaattatcaggggcttccactgccttgtgtcaaaaaaattattcagcaagtgttacagggtcttgattatttacataccaagtgccgtatcatccacactgacattaaaccagagaacatcttattgtcagtgaatgagcagtacattcggaggctggctgcagaagcaacagaatggcagcgatctggagctcctccgccttccggatctgcagtcagtactgctccccagcctaaaccagctgacaaaatgtcaaagaataagaagaagaaattgaagaagaagcagaagcgccaggcagaattactagagaagcgaatgcaggaaattgaggaaatggagaaagagtcgggccctgggcaaaaaagaccaaacaagcaagaagaatcagagagtcctgttgaaagacccttgaaagagaacccacctaataaaatgacccaagaaaaacttgaagagtcaagtaccattggccaggatcaaacgcttatggaacgtgatacagagggtggtgcagcagaaattaattgcaatggagtgattgaagtcattaattatactcagaacagtaataatgaaacattgagacataaagaggatctacataatgctaatgactgtgatgtccaaaatttgaatcaggaatctagtttcctaagctcccaaaatggagacagcagcacatctcaagaaacagactcttgtacacctataacatctgaggtgtcagacaccatggtgtgccagtcttcctcaactgtaggtcagtcattcagtgaacaacacattagccaacttcaagaaagcattcgggcagagataccctgtgaagatgaacaagagcaagaacataacggaccactggacaacaaaggaaaatccacggctggaaattttcttgttaatccccttgagccaaaaaatgcagaaaagctcaaggtgaagattgctgaccttggaaatgcttgttgggtgcacaaacatttcactgaagatattcaaacaaggcaatatcgttccttggaagttctaatcggatctggctataatacccctgctgacatttggagcacggcatgcatggcctttgaactggccacaggtgactatttgtttgaacctcattcaggggaagagtacactcgagatgaagatcacattgcattgatcatagaacttctggggaaggtgcctcgcaagctcattgtggcaggaaaatattccaaggaatttttcaccaaaaaaggtgacctgaaacatatcacgaagctgaaaccttggggcctttttgaggttctagtggagaagtatgagtggtcgcaggaagaggcagctggcttcacagatttcttactgcccatgttggagctgatccctgagaagagagccactgccgccgagtgtctccggcacccttggcttaactcctaagcccctgcccagcaccacagcagagatcacacactgaccctccgcccttccccttcaagcattttcctcttcccttttcagggtgaagctcttccttcaagagtttctagatcttgttttttttttaatccaacatgttcatttgggtttgcttacttgaccctgtggagatccccacagccattgggcatcctaggtgaatttggccttggttgggctctgccaaagactaatggactaaaatgtgaaacagcctcttgccctgtacctttccttcccattaggacatcctttaaattataagcatcctttttgaaaagagctatgaaggtgtatgagcccatccttttattcattgactctaagagtcaaattttctagtgcatatcctattgccagcataaggatgaggagggggaaagggtcttaattctatgtacagcagagacattaaacttgctgtgtccgggctgcatcatcttcctggactgtttctgttgttctctgtgttcacattttttcctgcaacttttaagctactgtcttttttaaatagctatatgaacaccaaatttgggtaccattttatcactgttcaaagcactgtcaaattcctttcatcctttaatagttaagatctttgaatcttcagtctgatttttaatgtaagcaaaaacagaaccattgaatagtaatttcttgagaacctcaggtgttctataaacagtcctttcctgtatgtcttctattaccctaagaccagagttattttggttggttgttttgttttattttttgtttttgtatccatggctggcactttactcattgcacttgagtttattgccccataactaaaggatcaggatgatggtagaacggagatctgggtttcagagctttcccatttaagaaaaatagatcttgagattctgattcttttccaaacagtcccctgctttcatgtacagctttttctttaccttacccaaaattctggccttgaagcagttttcctctatggctttgcctttctgattttctcagaggctcgagtctttaatataaccccaaatgaaagaaccaaggggaggggtgggatggcacttttttttgttggtcttgttttgttttgttttttggttggttggttcgttattttttaagattagccattctctgctgctatttccctacataatgtcaatttttaaccataattttgacatgattgagatgtacttgaggcttttttgttttaattgagaaaagactttgcaattttttttttaggatgagcctctcctagacttgacctagaatattacatattcctccagtaagtaatactgaagagcaaaagagaggcaggattggggtcacagccgcttcttcagcatggaccaagtgggccttggggattgcagcgttctcgaagtggctgtaggactcgaatttacagaaagccacagaggtgcaacttgaggctctgctagcaagccaccagtgaggctattgggtaaccacctttctatacaggagattggaatctactttgtcatttatccaccacagtgacaaaggaaaagtggtgccgttatgcaatccatttaactcataaacatattactctgagtaactggccagccattcatcggatccttcattgggtactcctgaaatcagacatgttcctgtagaaagaattttaagttaggctttctatgcacctatcaagaatcaagagaatagattgtatcaaacaacggcagggaaatccttcagcaattctaatccactttgggttttcagctgtttttacatctaaagcaatagactagaactgaattatcttctacatagtaaaatcacaattgtggaattacaggaattctggtgatattaaggtgaaataacaaaacacaaaaggccctattttaacagttgatgtgacagtaagttttaatagaacctgtaacttcattttggaaatgcttctccaccaaataagggctttttcccctatttaaggagccagatggattgaaagatgtggaaataggcagctgtagatcttgatcttccaggtaccccatgtacctttattgagcttaattataatactgtcaaattgccacgatctcactaaaggatttctatttgctgtcagttaaaaataaagccctaaatacatttttattctttctactgagggcattgtctgttttctttgtaaatgccgtacaataaacaaattatttaataaccta

SEQ ID NO: 186342 - DNA, 4759 bp, Homo sapiens
  Payload ID: 16695
  Gene Symbol: SRPK1
  Gene Name: SRSF protein kinase 1
  ENST ID: ENST00000373822
  CDS Start-End: 10-2490
ggtctcaccatggagcggaaaggtgagcggtggagcggcctccgccacgaggggcaatggtcgccggggcgaggcccgggtcagcgccgggagcttcgcttaactgccgcggttcggttcccggacgtgcggcgcccctccactgaggtggcgccgccccacaccccctgcctctgggctgcgggtccgcgcccctcagtccgggcgtcctctggcgccggccgtagccgccccttgttccccgccaggccggctcgcgccttggggccactccagggcccggcccttggcgggcgacgcagacccccacccgcccgccccctgacccggcctgagacccctccggcgcatcccgcccgggcgctgctctgcgccccgtgggccgccagccccacgccggccgcctcgccgagcccgcagccgcccccgaggcaggccccgcagccgggcctggcgcccctgctgggtctccaccctcaccttggtcgcctcctttcctccacattcgcccttcatccatccctctctcctgcagtgcttgcgctccaggcccgaaagaaaaggaccaaggccaagaaggacaaagcccaaaggaaatctgaaactcagcaccgaggctctgctccccactctgagagtgatctaccagagcaggaagaggagattctgggatctgatgatgatgagcaagaagatcctaatgattattgtaaaggaggttatcatcttgtgaaaattggagatctattcaatgggagataccatgtgatccgaaagttaggctggggacacttttcaacagtatggttatcatgggatattcaggggaagaaatttgtggcaatgaaagtagttaaaagtgctgaacattacactgaaacagcactagatgaaatccggttgctgaagtcagttcgcaattcagaccctaatgatccaaatagagaaatggttgttcaactactagatgactttaaaatatcaggagttaatggaacacatatctgcatggtatttgaagttttggggcatcatctgctcaagtggatcatcaaatccaattatcaggggcttccactgccttgtgtcaaaaaaattattcagcaagtgttacagggtcttgattatttacataccaagtgccgtatcatccacactgacattaaaccagagaacatcttattgtcagtgaatgagcagtacattcggaggctggctgcagaagcaacagaatggcagcgatctggagctcctccgccttccggatctgcagtcagtactgctccccagcctaaaccagctgacaaaatgtcaaagaataagaagaagaaattgaagaagaagcagaagcgccaggcagaattactagagaagcgaatgcaggaaattgaggaaatggagaaagagtcgggccctgggcaaaaaagaccaaacaagcaagaagaatcagagagtcctgttgaaagacccttgaaagagaacccacctaataaaatgacccaagaaaaacttgaagagtcaagtaccattggccaggatcaaacgcttatggaacgtgatacagagggtggtgcagcagaaattaattgcaatggagtgattgaagtcattaattatactcagaacagtaataatgaaacattgagacataaagaggatctacataatgctaatgactgtgatgtccaaaatttgaatcaggaatctagtttcctaagctcccaaaatggagacagcagcacatctcaagaaacagactcttgtacacctataacatctgaggtgtcagacaccatggtgtgccagtcttcctcaactgtaggtcagtcattcagtgaacaacacattagccaacttcaagaaagcattcgggcagagataccctgtgaagatgaacaagagcaagaacataacggaccactggacaacaaaggaaaatccacggctggaaattttcttgttaatccccttgagccaaaaaatgcagaaaagctcaaggtgaagattgctgaccttggaaatgcttgttgggtgcacaaacatttcactgaagatattcaaacaaggcaatatcgttccttggaagttctaatcggatctggctataatacccctgctgacatttggagcacggcatgcatggcctttgaactggccacaggtgactatttgtttgaacctcattcaggggaagagtacactcgagatgaagatcacattgcattgatcatagaacttctggggaaggtgcctcgcaagctcattgtggcaggaaaatattccaaggaatttttcaccaaaaaaggtgacctgaaacatatcacgaagctgaaaccttggggcctttttgaggttctagtggagaagtatgagtggtcgcaggaagaggcagctggcttcacagatttcttactgcccatgttggagctgatccctgagaagagagccactgccgccgagtgtctccggcacccttggcttaactcctaagcccctgcccagcaccacagcagagatcacacactgaccctccgcccttccccttcaagcattttcctcttcccttttcagggtgaagctcttccttcaagagtttctagatcttgttttttttttaatccaacatgttcatttgggtttgcttacttgaccctgtggagatccccacagccattgggcatcctaggtgaatttggccttggttgggctctgccaaagactaatggactaaaatgtgaaacagcctcttgccctgtacctttccttcccattaggacatcctttaaattataagcatcctttttgaaaagagctatgaaggtgtatgagcccatccttttattcattgactctaagagtcaaattttctagtgcatatcctattgccagcataaggatgaggagggggaaagggtcttaattctatgtacagcagagacattaaacttgctgtgtccgggctgcatcatcttcctggactgtttctgttgttctctgtgttcacattttttcctgcaacttttaagctactgtcttttttaaatagctatatgaacaccaaatttgggtaccattttatcactgttcaaagcactgtcaaattcctttcatcctttaatagttaagatctttgaatcttcagtctgatttttaatgtaagcaaaaacagaaccattgaatagtaatttcttgagaacctcaggtgttctataaacagtcctttcctgtatgtcttctattaccctaagaccagagttattttggttggttgttttgttttattttttgtttttgtatccatggctggcactttactcattgcacttgagtttattgccccataactaaaggatcaggatgatggtagaacggagatctgggtttcagagctttcccatttaagaaaaatagatcttgagattctgattcttttccaaacagtcccctgctttcatgtacagctttttctttaccttacccaaaattctggccttgaagcagttttcctctatggctttgcctttctgattttctcagaggctcgagtctttaatataaccccaaatgaaagaaccaaggggaggggtgggatggcacttttttttgttggtcttgttttgttttgttttttggttggttggttcgttattttttaagattagccattctctgctgctatttccctacataatgtcaatttttaaccataattttgacatgattgagatgtacttgaggcttttttgttttaattgagaaaagactttgcaattttttttttaggatgagcctctcctagacttgacctagaatattacatattcctccagtaagtaatactgaagagcaaaagagaggcaggattggggtcacagccgcttcttcagcatggaccaagtgggccttggggattgcagcgttctcgaagtggctgtaggactcgaatttacagaaagccacagaggtgcaacttgaggctctgctagcaagccaccagtgaggctattgggtaaccacctttctatacaggagattggaatctactttgtcatttatccaccacagtgacaaaggaaaagtggtgccgttatgcaatccatttaactcataaacatattactctgagtaactggccagccattcatcggatccttcattgggtactcctgaaatcagacatgttcctgtagaaagaattttaagttaggctttctatgcacctatcaagaatcaagagaatagattgtatcaaacaacggcagggaaatccttcagcaattctaatccactttgggttttcagctgtttttacatctaaagcaatagactagaactgaattatcttctacatagtaaaatcacaattgtggaattacaggaattctggtgatattaaggtgaaataacaaaacacaaaaggccctattttaacagttgatgtgacagtaagttttaatagaacctgtaacttcattttggaaatgcttctccaccaaataagggctttttcccctatttaaggagccagatggattgaaagatgtggaaataggcagctgtagatcttgatcttccaggtaccccatgtacctttattgagcttaattataatactgtcaaattgccacgatctcactaaaggatttctatttgctgtcagttaaaaataaagccctaaatacatttttattctttctactgagggcattgtctgttttctttgtaaatgccgtacaataaacaaattatttaataacct

SEQ ID NO: 186343 - DNA, 4592 bp, Homo sapiens
  Payload ID: 16695
  Gene Symbol: SRPK1
  Gene Name: SRSF protein kinase 1
  Uniprot ID: Q96SB4
  ENST ID: ENST00000373825
  CDS Start-End: 287-2254
aaatagaacaaaactaaccttgccaggtttccaagcttggatctctaacactccttcaacgttcaccccggcgttcctccccgctgcgccccctccctctccttgccgccccctcctcgggagcaggtggtaggctccgcgcccaacgcgcaagcgcgcggcatcgtggggcgggggtggggcgggactgagggcggagtgtgagcgggctcggttttgggccgcggcgggagcgggagtcgccgccactcgagtgcgcaggcgcctggcgattaccggtctcaccatggagcggaaagtgcttgcgctccaggcccgaaagaaaaggaccaaggccaagaaggacaaagcccaaaggaaatctgaaactcagcaccgaggctctgctccccactctgagagtgatctaccagagcaggaagaggagattctgggatctgatgatgatgagcaagaagatcctaatgattattgtaaaggaggttatcatcttgtgaaaattggagatctattcaatgggagataccatgtgatccgaaagttaggctggggacacttttcaacagtatggttatcatgggatattcaggggaagaaatttgtggcaatgaaagtagttaaaagtgctgaacattacactgaaacagcactagatgaaatccggttgctgaagtcagttcgcaattcagaccctaatgatccaaatagagaaatggttgttcaactactagatgactttaaaatatcaggagttaatggaacacatatctgcatggtatttgaagttttggggcatcatctgctcaagtggatcatcaaatccaattatcaggggcttccactgccttgtgtcaaaaaaattattcagcaagtgttacagggtcttgattatttacataccaagtgccgtatcatccacactgacattaaaccagagaacatcttattgtcagtgaatgagcagtacattcggaggctggctgcagaagcaacagaatggcagcgatctggagctcctccgccttccggatctgcagtcagtactgctccccagcctaaaccagctgacaaaatgtcaaagaataagaagaagaaattgaagaagaagcagaagcgccaggcagaattactagagaagcgaatgcaggaaattgaggaaatggagaaagagtcgggccctgggcaaaaaagaccaaacaagcaagaagaatcagagagtcctgttgaaagacccttgaaagagaacccacctaataaaatgacccaagaaaaacttgaagagtcaagtaccattggccaggatcaaacgcttatggaacgtgatacagagggtggtgcagcagaaattaattgcaatggagtgattgaagtcattaattatactcagaacagtaataatgaaacattgagacataaagaggatctacataatgctaatgactgtgatgtccaaaatttgaatcaggaatctagtttcctaagctcccaaaatggagacagcagcacatctcaagaaacagactcttgtacacctataacatctgaggtgtcagacaccatggtgtgccagtcttcctcaactgtaggtcagtcattcagtgaacaacacattagccaacttcaagaaagcattcgggcagagataccctgtgaagatgaacaagagcaagaacataacggaccactggacaacaaaggaaaatccacggctggaaattttcttgttaatccccttgagccaaaaaatgcagaaaagctcaaggtgaagattgctgaccttggaaatgcttgttgggtgcacaaacatttcactgaagatattcaaacaaggcaatatcgttccttggaagttctaatcggatctggctataatacccctgctgacatttggagcacggcatgcatggcctttgaactggccacaggtgactatttgtttgaacctcattcaggggaagagtacactcgagatgaagatcacattgcattgatcatagaacttctggggaaggtgcctcgcaagctcattgtggcaggaaaatattccaaggaatttttcaccaaaaaaggtgacctgaaacatatcacgaagctgaaaccttggggcctttttgaggttctagtggagaagtatgagtggtcgcaggaagaggcagctggcttcacagatttcttactgcccatgttggagctgatccctgagaagagagccactgccgccgagtgtctccggcacccttggcttaactcctaagcccctgcccagcaccacagcagagatcacacactgaccctccgcccttccccttcaagcattttcctcttcccttttcagggtgaagctcttccttcaagagtttctagatcttgttttttttttaatccaacatgttcatttgggtttgcttacttgaccctgtggagatccccacagccattgggcatcctaggtgaatttggccttggttgggctctgccaaagactaatggactaaaatgtgaaacagcctcttgccctgtacctttccttcccattaggacatcctttaaattataagcatcctttttgaaaagagctatgaaggtgtatgagcccatccttttattcattgactctaagagtcaaattttctagtgcatatcctattgccagcataaggatgaggagggggaaagggtcttaattctatgtacagcagagacattaaacttgctgtgtccgggctgcatcatcttcctggactgtttctgttgttctctgtgttcacattttttcctgcaacttttaagctactgtcttttttaaatagctatatgaacaccaaatttgggtaccattttatcactgttcaaagcactgtcaaattcctttcatcctttaatagttaagatctttgaatcttcagtctgatttttaatgtaagcaaaaacagaaccattgaatagtaatttcttgagaacctcaggtgttctataaacagtcctttcctgtatgtcttctattaccctaagaccagagttattttggttggttgttttgttttattttttgtttttgtatccatggctggcactttactcattgcacttgagtttattgccccataactaaaggatcaggatgatggtagaacggagatctgggtttcagagctttcccatttaagaaaaatagatcttgagattctgattcttttccaaacagtcccctgctttcatgtacagctttttctttaccttacccaaaattctggccttgaagcagttttcctctatggctttgcctttctgattttctcagaggctcgagtctttaatataaccccaaatgaaagaaccaaggggaggggtgggatggcacttttttttgttggtcttgttttgttttgttttttggttggttggttcgttattttttaagattagccattctctgctgctatttccctacataatgtcaatttttaaccataattttgacatgattgagatgtacttgaggcttttttgttttaattgagaaaagactttgcaattttttttttaggatgagcctctcctagacttgacctagaatattacatattcctccagtaagtaatactgaagagcaaaagagaggcaggattggggtcacagccgcttcttcagcatggaccaagtgggccttggggattgcagcgttctcgaagtggctgtaggactcgaatttacagaaagccacagaggtgcaacttgaggctctgctagcaagccaccagtgaggctattgggtaaccacctttctatacaggagattggaatctactttgtcatttatccaccacagtgacaaaggaaaagtggtgccgttatgcaatccatttaactcataaacatattactctgagtaactggccagccattcatcggatccttcattgggtactcctgaaatcagacatgttcctgtagaaagaattttaagttaggctttctatgcacctatcaagaatcaagagaatagattgtatcaaacaacggcagggaaatccttcagcaattctaatccactttgggttttcagctgtttttacatctaaagcaatagactagaactgaattatcttctacatagtaaaatcacaattgtggaattacaggaattctggtgatattaaggtgaaataacaaaacacaaaaggccctattttaacagttgatgtgacagtaagttttaatagaacctgtaacttcattttggaaatgcttctccaccaaataagggctttttcccctatttaaggagccagatggattgaaagatgtggaaataggcagctgtagatcttgatcttccaggtaccccatgtacctttattgagcttaattataatactgtcaaattgccacgatctcactaaaggatttctatttgctgtcagttaaaaataaagccctaaatacatttttattctttctactgagggcattgtctgttttctttgtaaatgccgtacaataaacaaattatttaataacctacatgtttccaaaaatctctgttcatttgttgtccaaattgctctgccctgagtaaaaggaggaaaaga

SEQ ID NO: 186344 - DNA, 4357 bp, Homo sapiens
  Payload ID: 16695
  Gene Symbol: SRPK1
  Gene Name: SRSF protein kinase 1
  Uniprot ID: Q96SB4
  ENST ID: ENST00000423325
  CDS Start-End: 168-2087
ggagtgtgagcgggctcggttttgggccgcggcgggagcgggagtcgccgccactcgagtgcgcaggcgcctggcgattaccggtctcaccatggagcggaaagtgcttgcgctccaggcccgaaagaaaaggaccaaggccaagaaggacaaagcccaaaggaagaatgggcatttttgtatcatttcttagatctgaaactcagcaccgaggctctgctccccactctgagagtgatctaccagagcaggaagaggagattctgggatctgatgatgatgagcaagaagatcctaatgattattgtaaaggaggttatcatcttgtgaaaattggagatctattcaatgggagataccatgtgatccgaaagttaggctggggacacttttcaacagtatggttatcatgggatattcaggggaagaaatttgtggcaatgaaagtagttaaaagtgctgaacattacactgaaacagcactagatgaaatccggttgctgaagtcagttcgcaattcagaccctaatgatccaaatagagaaatggttgttcaactactagatgactttaaaatatcaggagttaatggaacacatatctgcatggtatttgaagttttggggcatcatctgctcaagtggatcatcaaatccaattatcaggggcttccactgccttgtgtcaaaaaaattattcagcaagtgttacagggtcttgattatttacataccaagtgccgtatcatccacactgacattaaaccagagaacatcttattgtcagtgaatgagcagtacattcggaggctggctgcagaagcaacagaatggcagcgatctggagctcctccgccttccggatctgcagtcagtactgctccccagcctaaaccagctgacaaaatgtcaaagaataagaagaagaaattgaagaagaagcagaagcgccaggcagaattactagagaagcgaatgcaggaaattgaggaaatggagaaagagtcgggccctgggcaaaaaagaccaaacaagcaagaagaatcagagagtcctgttgaaagacccttgaaagagaacccacctaataaaatgacccaagaaaaacttgaagagtcaagtaccattggccaggatcaaacgcttatggaacgtgatacagagggtggtgcagcagaaattaattgcaatggagtgattgaagtcattaattatactcagaacagtaataatgaaacattgagacataaagaggatctacataatgctaatgactgtgatgtccaaaatttgaatcaggaatctagtttcctaagctcccaaaatggagacagcagcacatctcaagaaacagactcttgtacacctataacatctgaggtgtcagacaccatggtgtgccagtcttcctcaactgtaggtcagtcattcagtgaacaacacattagccaacttcaagaaagcattcgggcagagataccctgtgaagatgaacaagagcaagaacataacggaccactggacaacaaaggaaaatccacggctggaaattttcttgttaatccccttgagccaaaaaatgcagaaaagctcaaggtgaagattgctgaccttggaaatgcttgttgggtgcacaaacatttcactgaagatattcaaacaaggcaatatcgttccttggaagttctaatcggatctggctataatacccctgctgacatttggagcacggcatgcatggcctttgaactggccacaggtgactatttgtttgaacctcattcaggggaagagtacactcgagatgaagatcacattgcattgatcatagaacttctggggaaggtgcctcgcaagctcattgtggcaggaaaatattccaaggaatttttcaccaaaaaaggtgacctgaaacatatcacgaagctgaaaccttggggcctttttgaggttctagtggagaagtatgagtggtcgcaggaagaggcagctggcttcacagatttcttactgcccatgttggagctgatccctgagaagagagccactgccgccgagtgtctccggcacccttggcttaactcctaagcccctgcccagcaccacagcagagatcacacactgaccctccgcccttccccttcaagcattttcctcttcccttttcagggtgaagctcttccttcaagagtttctagatcttgttttttttttaatccaacatgttcatttgggtttgcttacttgaccctgtggagatccccacagccattgggcatcctaggtgaatttggccttggttgggctctgccaaagactaatggactaaaatgtgaaacagcctcttgccctgtacctttccttcccattaggacatcctttaaattataagcatcctttttgaaaagagctatgaaggtgtatgagcccatccttttattcattgactctaagagtcaaattttctagtgcatatcctattgccagcataaggatgaggagggggaaagggtcttaattctatgtacagcagagacattaaacttgctgtgtccgggctgcatcatcttcctggactgtttctgttgttctctgtgttcacattttttcctgcaacttttaagctactgtcttttttaaatagctatatgaacaccaaatttgggtaccattttatcactgttcaaagcactgtcaaattcctttcatcctttaatagttaagatctttgaatcttcagtctgatttttaatgtaagcaaaaacagaaccattgaatagtaatttcttgagaacctcaggtgttctataaacagtcctttcctgtatgtcttctattaccctaagaccagagttattttggttggttgttttgttttattttttgtttttgtatccatggctggcactttactcattgcacttgagtttattgccccataactaaaggatcaggatgatggtagaacggagatctgggtttcagagctttcccatttaagaaaaatagatcttgagattctgattcttttccaaacagtcccctgctttcatgtacagctttttctttaccttacccaaaattctggccttgaagcagttttcctctatggctttgcctttctgattttctcagaggctcgagtctttaatataaccccaaatgaaagaaccaaggggaggggtgggatggcacttttttttgttggtcttgttttgttttgttttttggttggttggttcgttattttttaagattagccattctctgctgctatttccctacataatgtcaatttttaaccataattttgacatgattgagatgtacttgaggcttttttgttttaattgagaaaagactttgcaattttttttttaggatgagcctctcctagacttgacctagaatattacatattcctccagtaagtaatactgaagagcaaaagagaggcaggattggggtcacagccgcttcttcagcatggaccaagtgggccttggggattgcagcgttctcgaagtggctgtaggactcgaatttacagaaagccacagaggtgcaacttgaggctctgctagcaagccaccagtgaggctattgggtaaccacctttctatacaggagattggaatctactttgtcatttatccaccacagtgacaaaggaaaagtggtgccgttatgcaatccatttaactcataaacatattactctgagtaactggccagccattcatcggatccttcattgggtactcctgaaatcagacatgttcctgtagaaagaattttaagttaggctttctatgcacctatcaagaatcaagagaatagattgtatcaaacaacggcagggaaatccttcagcaattctaatccactttgggttttcagctgtttttacatctaaagcaatagactagaactgaattatcttctacatagtaaaatcacaattgtggaattacaggaattctggtgatattaaggtgaaataacaaaacacaaaaggccctattttaacagttgatgtgacagtaagttttaatagaacctgtaacttcattttggaaatgcttctccaccaaataagggctttttcccctatttaaggagccagatggattgaaagatgtggaaataggcagctgtagatcttgatcttccaggtaccccatgtacctttattgagcttaattataatactgtcaaattgccacgatctcactaaaggatttctatttgctgtcagttaaaaataaagccctaaatacatttttattctttctactgagggcattgtctgttttctttgtaaatgccgtacaataaacaaattatttaataaccta

SEQ ID NO: 186345 - DNA, 634 bp, Homo sapiens
  Payload ID: 16695
  Gene Symbol: SRPK1
  Gene Name: SRSF protein kinase 1
  ENST ID: ENST00000507292
  CDS Start-End: 1-129
agcattcgggcagagataccctgtgaagatgaacaagagcaagaacataacggaccactggacaacaaagtcttattgatgatgcctgttgtctgtaggaaaatccacggctggaaattttcttgttaatccccttgagccaaaaaatgcagaaaagctcaaggtgaagattgctgaccttggaaatgcttgttgggtgcacaaacatttcactgaagatattcaaacaaggcaatatcgttccttggaagttctaatcggatctggctataatacccctgctgacatttggagcacggcatgcatggtaatgttttttccccttggctttcacttgttaagtggtacatatcttgccctgtttgctaatttcagtaaaccagcaaattaactagcagaaaagaacgtaacacagatgatttaccataggtattctaaattctatgtctagagaggtccgaattcaaaaacctgtctggcatttcatttggttactgctaagttcctgttaggtgaaggaaccaaaagtttcttactacagattgttagtggggggaaataatgaaaacaactactaagaggtgttgttggttttgattaggagattacaagtatctttgcatttttagcactc

SEQ ID NO: 186346 - DNA, 559 bp, Homo sapiens
  Payload ID: 16695
  Gene Symbol: SRPK1
  Gene Name: SRSF protein kinase 1
  ENST ID: ENST00000512445
  CDS Start-End: 93-559
gattaccggtctcaccatggagcggaaagtgcttgcgctccaggcccgaaagaaaaggaccaaggccaagaaggacaaagcccaaaggaaagatggagtcttgctgtactaaccaggctggtcttgaactcctggcctcaagggatcctctcaccaccttggcctcccaaattactagaattacaggaatgggcatttttgtatcatttcttagatctgaaactcagcaccgaggctctgctccccactctgagagtgatctaccagagcaggaagaggagattctgggatctgatgatgatgagcaagaagatcctaatgattattgtaaaggaggttatcatcttgtgaaaattggagatctattcaatgggagataccatgtgatccgaaagttaggctggggacacttttcaacagtatggttatcatgggatattcaggggaagaaatttgtggcaatgaaagtagttaaaagtgctgaacattacactgaaacagcactagatgaaatccggttgctgaagtcagttcgcaattcagaccctaatgatccaaa

SEQ ID NO: 186347 - DNA, 621 bp, Homo sapiens
  Payload ID: 16695
  Gene Symbol: SRPK1
  Gene Name: SRSF protein kinase 1
  ENST ID: ENST00000510290
  CDS Start-End: 182-621
ttttgggccgcggcgggagcgggagtcgccgccactcgagtgcgcaggcgcctggcgattaccggtctcaccatggagcggaaagtgcttgcgctccaggcccgaaagaaaaggaccaaggccaagaaggacaaagcccaaaggaatcagtactgctccccagcctaaaccagctgacaaaatgtcaaagaataagaagaagaaattgaagaagaagcagaagcgccaggcagaattactagagaagcgaatgcaggaaattgaggaaatggagaaagagtcgggccctgggcaaaaaagaccaaacaagcaagaagaatcagagagtcctgttgaaagacccttgaaagagaacccacctaataaaatgacccaagaaaaacttgaagagtcaagtaccattggccaggatcaaacgcttatggaacgtgatacagagggtggtgcagcagaaattaattgcaatggagtgattgaagtcattaattatactcagaacagtaataatgaaacattgagacataaagaggatctacataatgctaatgactgtgatgtccaaaatttgaatcaggaatctagtttcctaagctcccaaaatggagacagcagcacatctca

SEQ ID NO: 186348 - DNA, 581 bp, Homo sapiens
  Payload ID: 16695
  Gene Symbol: SRPK1
  Gene Name: SRSF protein kinase 1
  ENST ID: ENST00000507909
  CDS Start-End: 227-581
actcgagtgcgcaggcgcctggcgattaccggtctcaccatggagcggaaagtgcttgcgctccaggcccgaaagaaaaggaccaaggccaagaaggacaaagcccaaaggaagtgagtcttgtaccccaacatcccattctttggattttcctccggcaccttctctgctctggtttcacgtcttgaacgtgcaccgggtttgggcaccctgtggctgcagccacatggcctcggggcagctcggagggtcgctctccagcaaccatgtggaagagagctgctgttgctcaacgccaggcctgggtcttagcagccccgggcctgctggaaagggctgtcggaggaggaccagagcccgcccggtacctttcctccccaactccacagaggaggcacaaactcccctagcttggacctccccaccggagctggtagatcattatcggtctgtttctgaactctggtctctcttacctgctccccaacgtcttaacttgcctccgacgtcttcacgatctgaaactcagcaccgaggctctgctccccactctgagagtgatctaccagagcaggaagagg

SEQ ID NO: 186349 - DNA, 858 bp, Homo sapiens
  Payload ID: 16695
  Gene Symbol: SRPK1
  Gene Name: SRSF protein kinase 1
  ENST ID: ENST00000508473
  CDS Start-End: 363-593
aaatagaacaaaactaaccttgccaggtttccaagcttggatctctaacactccttcaacgttcaccccggcgttcctccccgctgcgccccctccctctccttgccgccccctcctcgggagcaggtggtaggctccgcgcccaacgcgcaagcgcgcggcatcgtggggcgggggtggggcgggactgagggcggagtgtgagcgggctcggttttgggccgcggcgggagcgggagtcgccgccactcgagtgcgcaggcgcctggcgattaccggtctcaccatggagcggaaagtgcttgcgctccaggcccgaaagaaaaggaccaaggccaagaaggacaaagcccaaaggaaagatggagtcttgctgtactaaccaggctggtcttgaactcctggcctcaagggatcctctcaccaccttggcctcccaaattactagaattacagatctgaaactcagcaccgaggctctgctccccactctgagagtgatctaccagagcaggaagaggagattctgggatctgatgatgatgagcaagaagatcctaatgattattgtaaaggaggttatcatcttgtgaaaattggagatctattcaatgggagataccatgtgatccgaaagttaggctggggacacttttcaacagtatggttatcatgggatattcaggggaagaaatttgtggcaatgaaagtagttaaaagtgctgaacattacactgaaacagcactagatgaaatccggttgctgaagtcagttcgcaattcagaccctaatgatccaaatagagaaatggttgttcaactactagatgactttaaaatatcaggagttaatggaac

SEQ ID NO: 186350 - DNA, 3700 bp, Homo sapiens
  Payload ID: 16696
  Gene Symbol: SRPK2
  Gene Name: SRSF protein kinase 2
  Uniprot ID: P78362
  ENST ID: ENST00000357311
  CDS Start-End: 173-2239
ccattgaatcccagtcctaacagaagtactgcgaatcttgtggcctcattctgaacaaaagggattagagaagaaaaatctcttgatataaggcttgaaagcaagggcaggcaatcttggttgtgaatattttctgatttttccagaaatcaagcagaagattgagctgctgatgtcagttaactctgagaagtcgtcctcttcagaaaggccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcaggggaaaagatttgttgcaatgaaagttgtaaaaagtgcccagcattatacggagacagccttggatgaaataaaattgctcaaatgtgttcgagaaagtgatcccagtgacccaaacaaagacatggtggtccagctcattgacgacttcaagatttcaggcatgaatgggatacatgtctgcatggtcttcgaagtacttggccaccatctcctcaagtggatcatcaaatccaactatcaaggcctcccagtacgttgtgtgaagagtatcattcgacaggtccttcaagggttagattacttacacagtaagtgcaagatcattcatactgacataaagccggaaaatatcttgatgtgtgtggatgatgcatatgtgagaagaatggcagctgaggccactgagtggcagaaagcaggtgctcctcctccttcagggtctgcagtgagtacggctccacagcagaaacctataggaaaaatatctaaaaacaaaaagaaaaaactgaaaaagaaacagaagaggcaggctgagttattggagaagcgcctgcaggagatagaagaattggagcgagaagctgaaaggaaaataatagaagaaaacatcacctcagctgcaccttccaatgaccaggatggcgaatactgcccagaggtgaaactaaaaacaacaggattagaggaggcggctgaggcagagactgcaaaggacaatggtgaagctgaggaccaggaagagaaagaagatgctgagaaagaaaacattgaaaaagatgaagatgatgtagatcaggaacttgcgaacatagaccctacgtggatagaatcacctaaaaccaatggccatattgagaatggcccattctcactggagcagcaactggacgatgaagatgatgatgaagaagactgcccaaatcctgaggaatataatcttgatgagccaaatgcagaaagtgattacacatatagcagctcctatgaacaattcaatggtgaattgccaaatggacgacataaaattcccgagtcacagttcccagagttttccacctcgttgttctctggatccttagaacctgtggcctgcggctctgtgctttctgagggatcaccacttactgagcaagaggagagcagtccatcccatgacagaagcagaacggtttcagcctccagtactggggatttgccaaaagcaaaaacccgggcagctgacttgttggtgaatcccctggatccgcggaatgcagataaaattagagtaaaaattgctgacctgggaaatgcttgttgggtgcataaacacttcacggaagacatccagacgcgtcagtaccgctccatagaggttttaataggagcggggtacagcacccctgcggacatctggagcacggcgtgtatggcatttgagctggcaacgggagattatttgtttgaaccacattctggggaagactattccagagacgaagaccacatagcccacatcatagagctgctaggcagtattccaaggcactttgctctatctggaaaatattctcgggaattcttcaatcgcagaggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgccttcggcatccttggttgaattcttagcaaattctaccaatattgcattctgagctagcaaatgttcccagtacattggacctaaacggtgactctcattctttaacaggattacaagtgagctggcttcatcctcagacctttattttgctttgaggtactgttgtttgacattttgctttttgtgcactgtgatcctggggaagggtagtcttttgtcttcagctaagtagtttactgaccattttcttctggaaacaataacatgtctctaagcattgtttcttgtgttgtgtgacattcaaatgtcatttttttgaatgaaaaatactttcccctttgtgttttggcaggttttgtaactatttatgaagaaatattttagctgagtactatataatttacaatcttaagaaattatcaagttggaaccaagaaatagcaaggaaatgtacaattttatcttctggcaaagggacatcattcctgtattatagtgtatgtaaatgcaccctgtaaatgttactttccattaaatatgggagggggactcaaatttcagaaaagctaccaagtcttgagtgctttgtagcctatgttgcatgtagcggactttaactgctccaaggagttgtgcaaacttttcattccataacagtcttttcacattggattttaaacaaagtggctctgggttataagatgtcattctctatatggcactttaaaggaagaaaagatatgtttctcattctaaaatatgcattataatttagcagtcccatttgtgattttgcatatttttaaaagtacttttaaagaagagcaatttccctttaaaaatgtgatggctcagtaccatgtcatgttgcctcctctgggcgctgtaagttaagctctacatagattaaattggagaaacgtgttaattgtgtggaatgaaaaaatacatatatttttggaaaagcatgatcatgcttgtctagaacacaaggtatggtatatacaatttgcagtgcagtgggcagaatacttctcacagctcaaagataacagtgatcacattcattccataggtagctttacgtgtggctacaacaaattttactagctttttcattgtctttccatgaaacgaagttgagaaaatgattttccctttgcaggttgcacacagttttgtttatgcatttccttaaaattaattgtagactccaggatacaaaccatagtaggcaatacaattttagaatgtaatatatagaggtatatttagcctcttttagaagtcagtggattgaatgtctttttattttaaattttacattcattaaggtgcctcgtttttgactttgtccattaacatttatccatatgcctttgcaataactagattgtgaaaagctaacaagtgttgtaacaataatccattgtttgaggtgcttgcagttgtcttaaaaattaaagtgttttggtttttttttttcc

SEQ ID NO: 186351 - DNA, 3650 bp, Homo sapiens
  Payload ID: 16696
  Gene Symbol: SRPK2
  Gene Name: SRSF protein kinase 2
  Uniprot ID: P78362
  ENST ID: ENST00000393651
  CDS Start-End: 89-2188
ggcggagcgagtggaggctgcagcccagctcgtctcggcgcccgcgtcgccgtcgcgaagccccccgccccgcttccgccgcgtcggaatgagctcccggaaagtgctggccattcaggcccgaaagcggaggccgaaaagagagaaacatccgaaaaagccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcaggggaaaagatttgttgcaatgaaagttgtaaaaagtgcccagcattatacggagacagccttggatgaaataaaattgctcaaatgtgttcgagaaagtgatcccagtgacccaaacaaagacatggtggtccagctcattgacgacttcaagatttcaggcatgaatgggatacatgtctgcatggtcttcgaagtacttggccaccatctcctcaagtggatcatcaaatccaactatcaaggcctcccagtacgttgtgtgaagagtatcattcgacaggtccttcaagggttagattacttacacagtaagtgcaagatcattcatactgacataaagccggaaaatatcttgatgtgtgtggatgatgcatatgtgagaagaatggcagctgaggccactgagtggcagaaagcaggtgctcctcctccttcagggtctgcagtgagtacggctccacagcagaaacctataggaaaaatatctaaaaacaaaaagaaaaaactgaaaaagaaacagaagaggcaggctgagttattggagaagcgcctgcaggagatagaagaattggagcgagaagctgaaaggaaaataatagaagaaaacatcacctcagctgcaccttccaatgaccaggatggcgaatactgcccagaggtgaaactaaaaacaacaggattagaggaggcggctgaggcagagactgcaaaggacaatggtgaagctgaggaccaggaagagaaagaagatgctgagaaagaaaacattgaaaaagatgaagatgatgtagatcaggaacttgcgaacatagaccctacgtggatagaatcacctaaaaccaatggccatattgagaatggcccattctcactggagcagcaactggacgatgaagatgatgatgaagaagactgcccaaatcctgaggaatataatcttgatgagccaaatgcagaaagtgattacacatatagcagctcctatgaacaattcaatggtgaattgccaaatggacgacataaaattcccgagtcacagttcccagagttttccacctcgttgttctctggatccttagaacctgtggcctgcggctctgtgctttctgagggatcaccacttactgagcaagaggagagcagtccatcccatgacagaagcagaacggtttcagcctccagtactggggatttgccaaaagcaaaaacccgggcagctgacttgttggtgaatcccctggatccgcggaatgcagataaaattagagtaaaaattgctgacctgggaaatgcttgttgggtgcataaacacttcacggaagacatccagacgcgtcagtaccgctccatagaggttttaataggagcggggtacagcacccctgcggacatctggagcacggcgtgtatggcatttgagctggcaacgggagattatttgtttgaaccacattctggggaagactattccagagacgaagaccacatagcccacatcatagagctgctaggcagtattccaaggcactttgctctatctggaaaatattctcgggaattcttcaatcgcagaggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgccttcggcatccttggttgaattcttagcaaattctaccaatattgcattctgagctagcaaatgttcccagtacattggacctaaacggtgactctcattctttaacaggattacaagtgagctggcttcatcctcagacctttattttgctttgaggtactgttgtttgacattttgctttttgtgcactgtgatcctggggaagggtagtcttttgtcttcagctaagtagtttactgaccattttcttctggaaacaataacatgtctctaagcattgtttcttgtgttgtgtgacattcaaatgtcatttttttgaatgaaaaatactttcccctttgtgttttggcaggttttgtaactatttatgaagaaatattttagctgagtactatataatttacaatcttaagaaattatcaagttggaaccaagaaatagcaaggaaatgtacaattttatcttctggcaaagggacatcattcctgtattatagtgtatgtaaatgcaccctgtaaatgttactttccattaaatatgggagggggactcaaatttcagaaaagctaccaagtcttgagtgctttgtagcctatgttgcatgtagcggactttaactgctccaaggagttgtgcaaacttttcattccataacagtcttttcacattggattttaaacaaagtggctctgggttataagatgtcattctctatatggcactttaaaggaagaaaagatatgtttctcattctaaaatatgcattataatttagcagtcccatttgtgattttgcatatttttaaaagtacttttaaagaagagcaatttccctttaaaaatgtgatggctcagtaccatgtcatgttgcctcctctgggcgctgtaagttaagctctacatagattaaattggagaaacgtgttaattgtgtggaatgaaaaaatacatatatttttggaaaagcatgatcatgcttgtctagaacacaaggtatggtatatacaatttgcagtgcagtgggcagaatacttctcacagctcaaagataacagtgatcacattcattccataggtagctttacgtgtggctacaacaaattttactagctttttcattgtctttccatgaaacgaagttgagaaaatgattttccctttgcaggttgcacacagttttgtttatgcatttccttaaaattaattgtagactccaggatacaaaccatagtaggcaatacaattttagaatgtaatatatagaggtatatttagcctcttttagaagtcagtggattgaatgtctttttattttaaattttacattcattaaggtgcctcgtttttgactttgtccattaacatttatccatatgcctttgcaataactagattgtgaaaagctaacaagtgttgtaacaataatccattgtttgaggtgcttgcagttgtcttaaaaattaaagtgttttggtttttttttttcca

SEQ ID NO: 186352 - DNA, 666 bp, Homo sapiens
  Payload ID: 16696
  Gene Symbol: SRPK2
  Gene Name: SRSF protein kinase 2
  ENST ID: ENST00000460391
  CDS Start-End: 186-666
ggcggagcgagtggaggctgcagcccagctcgtctcggcgcccgcgtcgccgtcgcgaagccccccgccccgcttccgccgcgtcggaatgagctcccggaaagtgctggccattcaggcccgaaagcggaggccgaaaagagagaaacatccgaaaaaaaatcaagcagaagattgagctgctgatgtcagttaactctgagaagtcgtcctcttcagaaaggccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcaggggaaaagatttgttgcaatgaaagttgtaaaaagtgcccagcattatacggagacagccttggatgaaataaaattgctcaaatgtgttcgagaaagtgatcccagtgacccaaacaaagacatggtggtccagctcattgacgacttcaagatttcaggcatgaatgggatac

SEQ ID NO: 186353 - DNA, 568 bp, Homo sapiens
  Payload ID: 16696
  Gene Symbol: SRPK2
  Gene Name: SRSF protein kinase 2
  ENST ID: ENST00000465112
  CDS Start-End: 93-299
ggccggcggagcgagtggaggctgcagcccagctcgtctcggcgcccgcgtcgccgtcgcgaagccccccgccccgcttccgccgcgtcggaatgagctcccggaaagtgctggccattcaggcccgaaagcggaggccgaaaagagagaaacatccgaaaaagtggagtacatcctgctgcttcaagggtagaagactcctcactgctttccttcatgagatttcaaaggaagtgttggttttttttttgcctggttcaagtattgaccaagaagatgacagtgatgtggtctcttaggagtgaacaaccaaggcgatgggctgtaggatgttgatacatctgaggggccagatggccaccatatcagggaaagccaatgtgttttgaaaaatatgcaaatgttcaataagaaatcaagcagaagattgagctgctgatgtcagttaactctgagaagtcgtcctcttcagaaaggccggagcctcaacagaaagctcctttagttcctcctcctccaccgccaccaccaccaccaccgccacctttgccagaccccacacccccgg

SEQ ID NO: 186354 - DNA, 954 bp, Homo sapiens
  Payload ID: 16696
  Gene Symbol: SRPK2
  Gene Name: SRSF protein kinase 2
  ENST ID: ENST00000465072
  CDS Start-End: 1-444
atggcatttgagctggcaacgggagattatttgtttgaaccacattctggggaagactattccagagacgaagaccacatagcccacatcatagagctgctaggcagtattccaaggcactttgctctatctggaaaatattctcgggaattcttcaatcgcagagatcacatagcattgatcattgaactgctggggaaagtccctcgaaaatacgctatgttggggaaatactccaaggagtttttcaccagaaaaggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgccttcggcatccttggttgaattcttagcaaattctaccaatattgcattctgagctagcaaatgttcccagtacattggacctaaacggtgactctcattctttaacaggattacaagtgagctggcttcatcctcagacctttattttgctttgaggttttgtaactatttatgaagaaatattttagctgagtactatataatttacaatcttaagaaattatcaagttggaaccaagaaatagcaaggaaatgtacaattttatcttctggcaaagggacatcattcctgtattatagttccatgtgaaatcttcatggaaaatgacaagcagtggatcacatatgtgtttatagcagatacaggagctggctatctagaagttggcagacagaactgcccaaaggcagagaaaaggtggatataagatcttccgagtcataaacttcttaggtgaaaaccgatttactaacttgcttcttcccatacctggaccatacataactagttaccacgataaagtaaggaaactttc

SEQ ID NO: 186355 - DNA, 872 bp, Homo sapiens
  Payload ID: 16696
  Gene Symbol: SRPK2
  Gene Name: SRSF protein kinase 2
  ENST ID: ENST00000474770
  CDS Start-End: 1-614
tggatccgcggaatgcagataaaattagagtaaaaattgctgacctgggaaatgcttgttgggtgcataaacacttcacggaagacatccagacgcgtcagtaccgctccatagaggttttaataggagcggggtacagcacccctgcggacatctggagcacggcgtgtatggcatttgagctggcaacgggagattatttgtttgaaccacattctggggaagactattccagagacgaagaccacatagcccacatcatagagctgctaggcagtattccaaggcactttgctctatctggaaaatattctcgggaattcttcaatcgcagagatcacatagcattgatcattgaactgctggggaaagtccctcgaaaatacgctatgttggggaaatactccaaggagtttttcaccagaaaaggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgccttcggcatccttggttgaattcttagcaaattctaccaatattgcattctgagctagcaaatgttcccagtacattggacctaaacggtgactctcattctttaacaggattacaagtgagctggcttcatcctcagacctttattttgctttgaggtactgttgtttgacattttgctttttgtgcactgtgatcctggggaagggtagtcttttgtcttcagctaagtagtttactgaccattttcttctggaaacaataacatgtctctaagcattgtttc

SEQ ID NO: 186356 - DNA, 715 bp, Homo sapiens
  Payload ID: 16696
  Gene Symbol: SRPK2
  Gene Name: SRSF protein kinase 2
  ENST ID: ENST00000482897
  CDS Start-End: 22-715
ggagaggaggaagcggcgctcatggggttgcaaggatgtagaggagcaaagggagagaagaggccgcgggaagagaggtggtgcgagacccgcggaggcgccggccaaggacgggcgcatggagcagcgggcggcgcgaccggccgggtgctggccattcaggcccgaaagcggaggccgaaaagagagaaacatccgaaaaagccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcaggggaaaagatttgttgcaatgaaagttgtaaaaagtgcccagcattatacggagacagccttggatgaaataaaattgctcaaatgtgttcgagaaagtgatcccagtgacccaaacaaagacatggtggtccagctcattgacgacttcaagatttcaggcatgaatgggatacatgtctgcatggtcttcgaagtacttggccaccatctcctcaagtggatcatcaaatccaactatcaag

SEQ ID NO: 186357 - DNA, 2560 bp, Homo sapiens
  Payload ID: 16696
  Gene Symbol: SRPK2
  Gene Name: SRSF protein kinase 2
  Uniprot ID: P78362
  ENST ID: ENST00000489828
  CDS Start-End: 182-2248
gttggagtgggccctgtgcctctgctgtctcctactgctaacgagtgaacaaccaaggcgatgggctgtaggatgttgatacatctgaggggccagatggccaccatatcagggaaagccaatgtgttttgaaaaatatgcaaatgttcaataagaaatcaagcagaagattgagctgctgatgtcagttaactctgagaagtcgtcctcttcagaaaggccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcaggggaaaagatttgttgcaatgaaagttgtaaaaagtgcccagcattatacggagacagccttggatgaaataaaattgctcaaatgtgttcgagaaagtgatcccagtgacccaaacaaagacatggtggtccagctcattgacgacttcaagatttcaggcatgaatgggatacatgtctgcatggtcttcgaagtacttggccaccatctcctcaagtggatcatcaaatccaactatcaaggcctcccagtacgttgtgtgaagagtatcattcgacaggtccttcaagggttagattacttacacagtaagtgcaagatcattcatactgacataaagccggaaaatatcttgatgtgtgtggatgatgcatatgtgagaagaatggcagctgaggccactgagtggcagaaagcaggtgctcctcctccttcagggtctgcagtgagtacggctccacagcagaaacctataggaaaaatatctaaaaacaaaaagaaaaaactgaaaaagaaacagaagaggcaggctgagttattggagaagcgcctgcaggagatagaagaattggagcgagaagctgaaaggaaaataatagaagaaaacatcacctcagctgcaccttccaatgaccaggatggcgaatactgcccagaggtgaaactaaaaacaacaggattagaggaggcggctgaggcagagactgcaaaggacaatggtgaagctgaggaccaggaagagaaagaagatgctgagaaagaaaacattgaaaaagatgaagatgatgtagatcaggaacttgcgaacatagaccctacgtggatagaatcacctaaaaccaatggccatattgagaatggcccattctcactggagcagcaactggacgatgaagatgatgatgaagaagactgcccaaatcctgaggaatataatcttgatgagccaaatgcagaaagtgattacacatatagcagctcctatgaacaattcaatggtgaattgccaaatggacgacataaaattcccgagtcacagttcccagagttttccacctcgttgttctctggatccttagaacctgtggcctgcggctctgtgctttctgagggatcaccacttactgagcaagaggagagcagtccatcccatgacagaagcagaacggtttcagcctccagtactggggatttgccaaaagcaaaaacccgggcagctgacttgttggtgaatcccctggatccgcggaatgcagataaaattagagtaaaaattgctgacctgggaaatgcttgttgggtgcataaacacttcacggaagacatccagacgcgtcagtaccgctccatagaggttttaataggagcggggtacagcacccctgcggacatctggagcacggcgtgtatggcatttgagctggcaacgggagattatttgtttgaaccacattctggggaagactattccagagacgaagaccacatagcccacatcatagagctgctaggcagtattccaaggcactttgctctatctggaaaatattctcgggaattcttcaatcgcagaggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgccttcggcatccttggttgaattcttagcaaattctaccaatattgcattctgagctagcaaatgttcccagtacattggacctaaacggtgactctcattctttaacaggattacaagtgagctggcttcatcctcagacctttattttgctttgaggtactgttgtttgacattttgctttttgtgcactgtgatcctggggaagggtagtcttttgtcttcagctaagtagtttactgaccattttcttctggaaacaataacatgtctctaagcattgtttcttgtgttgtgtgacattcaaatgtcatttttttgaatgaaaaatactttcccct

SEQ ID NO: 186358 - DNA, 1336 bp, Homo sapiens
  Payload ID: 16696
  Gene Symbol: SRPK2
  Gene Name: SRSF protein kinase 2
  ENST ID: ENST00000477925
  CDS Start-End: 1-886
ggagcagcaactggacgatgaagatgatgatgaagaagactgcccaaatcctgaggaatataatcttgatgagccaaatgcagaaagtgattacacatatagcagctcctatgaacaattcaatggtgaattgccaaatggacgacataaaattcccgagtcacagttcccagagttttccacctcgttgttctctggatccttagaacctgtggcctgcggctctgtgctttctgagggatcaccacttactgagcaagaggagagcagtccatcccatgacagaagcagaacggtttcagcctccagtactggggatttgccaaaagcaaaaacccgggcagctgacttgttggtgaatcccctggatccgcggaatgcagataaaattagagtaaaaattgctgacctgggaaatgcttgttgggtgcataaacacttcacggaagacatccagacgcgtcagtaccgctccatagaggttttaataggagcggggtacagcacccctgcggacatctggagcacggcgtgtatggcatttgagctggcaacgggagattatttgtttgaaccacattctggggaagactattccagagacgaagatcacatagcattgatcattgaactgctggggaaagtccctcgaaaatacgctatgttggggaaatactccaaggagtttttcaccagaaaaggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgccttcggcatccttggttgaattcttagcaaattctaccaatattgcattctgagctagcaaatgttcccagtacattggacctaaacggtgactctcattctttaacaggattacaagtgagctggcttcatcctcagacctttattttgctttgaggtactgttgtttgacattttgctttttgtgcactgtgatcctggggaagggtagtcttttgtcttcagctaagtagtttactgaccattttcttctggaaacaataacatgtctctaagcattgtttcttgtgttgtgtgacattcaaatgtcatttttttgaatgaaaaatactttcccctttgtgttttggcaggttttgtaactatttatgaagaaatattttagctgagtactatataatttacaatcttaagaaattatcaagttggaaccaagaaatagcaaggaaatgtacaattttatcttctggcaaaggg

SEQ ID NO: 186359 - DNA, 1717 bp, Homo sapiens
  Payload ID: 16697
  Gene Symbol: SRPK3
  Gene Name: SRSF protein kinase 3
  ENST ID: ENST00000370100
  CDS Start-End: 31-1509
cagcggcggcagcggcggcagtagcagcagatgctgcagggccttctgggctccgacgacgaggaacaggaagaccccaaagactactgcaagggcggctaccaccctgtgaagatcggcgacgtgttcaatgggcggtaccacgtggtgcgcaaactgggctggggccacttctccaccgtctggctctgctgggacatccagcgcaagcgctttgtggccctcaaagtggtgaagagtgcggggcattacacggagacagctgtggatgagatcaagctcctgaaatgtgtccgggacagcgaccccagtgaccccaaaagagagaccattgtccagctcattgatgacttcaggatctcaggagtcaatggagtccatgtgtgcatggtgctggaggtgctgggccaccagctcctcaaatggatcatcaagtccaactaccagggcctgcccgtgccctgcgtgaagagcatcgtgaggcaggtgctgcacggcctggactacctccacaccaagtgcaagatcatccacacggacatcaagcccgagaacatcttgctgtgtgtgggggacgcttacatcaggcgcctggctgccgaggccacggagtggcaacaggcaggggcgccgcccccctcccgctccatagtcagcactgccccccaggaggtcttgaccggtaagctgtccaaaaacaagaggaagaagatgaggcgcaaacggaaacagcagaagcggctgctggaggagcggctgcgggacctgcagaggctggaggccatggaggctgccacccaggctgaggactctggcttgagactagacgggggcagcggctccacatcctcttcaggctgcttctccggctccctcttctctcctgcctcctgctccatcctctccggctcgtccaatcagcgagagaccgggggcctcctgtcgcctagcacaccattcggtgcctcgaacctcctggtgaaccccctggagccccaaaatgcagataagatcaagatcaagatcgcagacctgggcaacgcctgctgggtgcacaagcacttcacggaagacatccagactcggcagtaccgggccgtcgaggtgctgatcggcgccgaatacggccccccggcagacatctggagcacagcctgcatggccttcgagctggccactggtgactacctgttcgagccgcattctggagaagactacagtcgtgatgaggaccacatcgctcacatagtggagcttctgggggacatccccccagccttcgccctctcaggccgctattcccgggagttcttcaaccggagaggagagctgcggcacatccacaatctcaagcactggggcctgtacgaggtactcatggaaaagtacgagtggcccctagagcaggccacacagttcagcgcctttctgctgcccatgatggagtacatccccgaaaagcgggccagtgccgctgactgcctccagcacccctggctcaacccctaggcccggctgtggctccacctccagctctccgtgccttaagggaaaagcgggacagctcccaccaccctgctgggcgccagttctccacaaccacagggcagagagacgctggagccaggcccggctctcagagcgtgttctgcctgagacccccgtgagggctctcggagaaagtgtgtgtattcctttcttaataaagtgtggactg

SEQ ID NO: 186360 - DNA, 1958 bp, Homo sapiens
  Payload ID: 16697
  Gene Symbol: SRPK3
  Gene Name: SRSF protein kinase 3
  Uniprot ID: Q9UPE1
  ENST ID: ENST00000370101
  CDS Start-End: 47-1750
aggagcagccgcccggggcaccggagctgcgggctgcgtggccgggatgagcgccagcacgggcggtggtggggacagcggcggcagcggcggcagtagcagcagctcacaggcctcctgcgggcccgagtcctcgggctccgaactagccctggccacaccggtgcctcagatgctgcagggccttctgggctccgacgacgaggaacaggaagaccccaaagactactgcaagggcggctaccaccctgtgaagatcggcgacgtgttcaatgggcggtaccacgtggtgcgcaaactgggctggggccacttctccaccgtctggctctgctgggacatccagcgcaagcgctttgtggccctcaaagtggtgaagagtgcggggcattacacggagacagctgtggatgagatcaagctcctgaaatgtgtccgggacagcgaccccagtgaccccaaaagagagaccattgtccagctcattgatgacttcaggatctcaggagtcaatggagtccatgtgtgcatggtgctggaggtgctgggccaccagctcctcaaatggatcatcaagtccaactaccagggcctgcccgtgccctgcgtgaagagcatcgtgaggcaggtgctgcacggcctggactacctccacaccaagtgcaagatcatccacacggacatcaagcccgagaacatcttgctgtgtgtgggggacgcttacatcaggcgcctggctgccgaggccacggagtggcaacaggcaggggcgccgcccccctcccgctccatagtcagcactgccccccaggaggtcttgcagaccggtaagctgtccaaaaacaagaggaagaagatgaggcgcaaacggaaacagcagaagcggctgctggaggagcggctgcgggacctgcagaggctggaggccatggaggctgccacccaggctgaggactctggcttgagactagacgggggcagcggctccacatcctcttcaggctgtcaccccgggggcgccagagcaggtccctccccagcctcttcctcccccgccccagggggcggccgtagcctcagcgcgggctcacagacctcaggcttctccggctccctcttctctcctgcctcctgctccatcctctccggctcgtccaatcagcgagagaccgggggcctcctgtcgcctagcacaccattcggtgcctcgaacctcctggtgaaccccctggagccccaaaatgcagataagatcaagatcaagatcgcagacctgggcaacgcctgctgggtgcacaagcacttcacggaagacatccagactcggcagtaccgggccgtcgaggtgctgatcggcgccgaatacggccccccggcagacatctggagcacagcctgcatggccttcgagctggccactggtgactacctgttcgagccgcattctggagaagactacagtcgtgatgaggaccacatcgctcacatagtggagcttctgggggacatccccccagccttcgccctctcaggccgctattcccgggagttcttcaaccggagaggagagctgcggcacatccacaatctcaagcactggggcctgtacgaggtactcatggaaaagtacgagtggcccctagagcaggccacacagttcagcgcctttctgctgcccatgatggagtacatccccgaaaagcgggccagtgccgctgactgcctccagcacccctggctcaacccctaggcccggctgtggctccacctccagctctccgtgccttaagggaaaagcgggacagctcccaccaccctgctgggcgccagttctccacaaccacagggcagagagacgctggagccaggcccggctctcagagcgtgttctgcctgagacccccgtgagggctctcggagaaagtgtgtgtattcctttcttaataaagtgtggactg

SEQ ID NO: 186361 - DNA, 1753 bp, Homo sapiens
  Payload ID: 16697
  Gene Symbol: SRPK3
  Gene Name: SRSF protein kinase 3
  Uniprot ID: Q9UPE1
  ENST ID: ENST00000370104
  CDS Start-End: 49-1749
acaggagcagccgcccggggcaccggagctgcgggctgcgtggccgggatgagcgccagcacgggcggtggtggggacagcggcggcagcggcggcagtagcagcagctcacaggcctcctgcgggcccgagtcctcgggctccgaactagccctggccacaccggtgcctcagatgctgcagggccttctgggctccgacgacgaggaacaggaagaccccaaagactactgcaagggcggctaccaccctgtgaagatcggcgacgtgttcaatgggcggtaccacgtggtgcgcaaactgggctggggccacttctccaccgtctggctctgctgggacatccagcgcaagcgctttgtggccctcaaagtggtgaagagtgcggggcattacacggagacagctgtggatgagatcaagctcctgaaatgtgtccgggacagcgaccccagtgaccccaaaagagagaccattgtccagctcattgatgacttcaggatctcaggagtcaatggagtccatgtgtgcatggtgctggaggtgctgggccaccagctcctcaaatggatcatcaagtccaactaccagggcctgcccgtgccctgcgtgaagagcatcgtgaggcaggtgctgcacggcctggactacctccacaccaagtgcaagatcatccacacggacatcaagcccgagaacatcttgctgtgtgtgggggacgcttacatcaggcgcctggctgccgaggccacggagtggcaacaggcaggggcgccgcccccctcccgctccatagtcagcactgccccccaggaggtcttgaccggtaagctgtccaaaaacaagaggaagaagatgaggcgcaaacggaaacagcagaagcggctgctggaggagcggctgcgggacctgcagaggctggaggccatggaggctgccacccaggctgaggactctggcttgagactagacgggggcagcggctccacatcctcttcaggctgtcaccccgggggcgccagagcaggtccctccccagcctcttcctcccccgccccagggggcggccgtagcctcagcgcgggctcacagacctcaggcttctccggctccctcttctctcctgcctcctgctccatcctctccggctcgtccaatcagcgagagaccgggggcctcctgtcgcctagcacaccattcggtgcctcgaacctcctggtgaaccccctggagccccaaaatgcagataagatcaagatcaagatcgcagacctgggcaacgcctgctgggtgcacaagcacttcacggaagacatccagactcggcagtaccgggccgtcgaggtgctgatcggcgccgaatacggccccccggcagacatctggagcacagcctgcatggccttcgagctggccactggtgactacctgttcgagccgcattctggagaagactacagtcgtgatgaggaccacatcgctcacatagtggagcttctgggggacatccccccagccttcgccctctcaggccgctattcccgggagttcttcaaccggagaggagagctgcggcacatccacaatctcaagcactggggcctgtacgaggtactcatggaaaagtacgagtggcccctagagcaggccacacagttcagcgcctttctgctgcccatgatggagtacatccccgaaaagcgggccagtgccgctgactgcctccagcacccctggctcaacccctaggccc

SEQ ID NO: 186362 - DNA, 1863 bp, Homo sapiens
  Payload ID: 16697
  Gene Symbol: SRPK3
  Gene Name: SRSF protein kinase 3
  ENST ID: ENST00000370108
  CDS Start-End: 49-1653
acaggagcagccgcccggggcaccggagctgcgggctgcgtggccgggatgagcgccagcacgggcggtggtggggacagcggcggcagcggcggcagtagcagcagctcacaggcctcctgcgggcccgagtcctcgggctccgaactagccctggccacaccggtgcctcagatgctgcagggccttctgggctccgacgacgaggaacaggaagaccccaaagactactgcaagggcggctaccaccctgtgaagatcggcgacgtgttcaatgggcggtaccacgtggtgcgcaaactgggctggggccacttctccaccgtctggctctgctgggacatccagcgcaagcgctttgtggccctcaaagtggtgaagagtgcggggcattacacggagacagctgtggatgagatcaagctcctgaaatgtgtccgggacagcgaccccagtgaccccaaaagagagaccattgtccagctcattgatgacttcaggatctcaggagtcaatggagtccatgtgtgcatggtgctggaggtgctgggccaccagctcctcaaatggatcatcaagtccaactaccagggcctgcccgtgccctgcgtgaagagcatcgtgaggcaggtgctgcacggcctggactacctccacaccaagtgcaagatcatccacacggacatcaagcccgagaacatcttgctgtgtgtgggggacgcttacatcaggcgcctggctgccgaggccacggagtggcaacaggcaggggcgccgcccccctcccgctccatagtcagcactgccccccaggaggtcttgaccggtaagctgtccaaaaacaagaggaagaagatgaggcgcaaacggaaacagcagaagcggctgctggaggagcggctgcgggacctgcagaggctggaggccatggaggctgccacccaggctgaggactctggcttgagactagacgggggcagcggctccacatcctcttcaggctgcttctccggctccctcttctctcctgcctcctgctccatcctctccggctcgtccaatcagcgagagaccgggggcctcctgtcgcctagcacaccattcggtgcctcgaacctcctggtgaaccccctggagccccaaaatgcagataagatcaagatcaagatcgcagacctgggcaacgcctgctgggtgcacaagcacttcacggaagacatccagactcggcagtaccgggccgtcgaggtgctgatcggcgccgaatacggccccccggcagacatctggagcacagcctgcatggccttcgagctggccactggtgactacctgttcgagccgcattctggagaagactacagtcgtgatgaggaccacatcgctcacatagtggagcttctgggggacatccccccagccttcgccctctcaggccgctattcccgggagttcttcaaccggagaggagagctgcggcacatccacaatctcaagcactggggcctgtacgaggtactcatggaaaagtacgagtggcccctagagcaggccacacagttcagcgcctttctgctgcccatgatggagtacatccccgaaaagcgggccagtgccgctgactgcctccagcacccctggctcaacccctaggcccggctgtggctccacctccagctctccgtgccttaagggaaaagcgggacagctcccaccaccctgctgggcgccagttctccacaaccacagggcagagagacgctggagccaggcccggctctcagagcgtgttctgcctgagacccccgtgagggctctcggagaaagtgtgtgtattcctttcttaataaagtgtggactgaa

SEQ ID NO: 186363 - DNA, 1900 bp, Homo sapiens
  Payload ID: 16697
  Gene Symbol: SRPK3
  Gene Name: SRSF protein kinase 3
  Uniprot ID: Q9UPE1
  ENST ID: ENST00000393786
  CDS Start-End: 87-1688
ggccaaggctataaattcgcaggccgcggccgggccccacaggagcagccgcccggggcaccggagctgcgggctgcgtggccgggatgagcgccagcacgggcggtggtggggacagcggcggcagcggcggcagtagcagcagctcacaggcctcctgcgggcccgagtcctcgggctccgaactagccctggccacaccggtgcctcagatgctgcagggccttctgggctccgacgacgaggaacaggaagaccccaaagactactgcaagggcggctaccaccctgtgaagatcggcgacgtgttcaatgggcggtaccacgtggtgcgcaaactgggctggggccacttctccaccgtctggctctgctgggacatccagcgcaagcgctttgtggccctcaaagtggtgaagagtgcggggcattacacggagacagctgtggatgagatcaagctcctgaaatgtgtccgggacagcgaccccagtgaccccaaaagagagaccattgtccagctcattgatgacttcaggatctcaggagtcaatggagtccatgtgtgcatggtgctggaggtgctgggccaccagctcctcaaatggatcatcaagtccaactaccagggcctgcccgtgccctgcgtgaagagcatcgtgaggcaggtgctgcacggcctggactacctccacaccaagtgcaagatcatccacacggacatcaagcccgagaacatcttgctgtgtgtgggggacgcttacatcaggcgcctggctgccgaggccacggagtggcaacaggcaggggcgccgcccccctcccgctccatagtcagcactgccccccaggaggtcttgaccggtaagctgtccaaaaacaagaggaagaagatgaggcgcaaacggaaacagcagaagcggctgctggaggagcggctgcgggacctgcagaggctggaggccatggaggctgccacccaggctgaggactctggcttgagactagacgggggcagcggctccacatcctcttcaggcttctccggctccctcttctctcctgcctcctgctccatcctctccggctcgtccaatcagcgagagaccgggggcctcctgtcgcctagcacaccattcggtgcctcgaacctcctggtgaaccccctggagccccaaaatgcagataagatcaagatcaagatcgcagacctgggcaacgcctgctgggtgcacaagcacttcacggaagacatccagactcggcagtaccgggccgtcgaggtgctgatcggcgccgaatacggccccccggcagacatctggagcacagcctgcatggccttcgagctggccactggtgactacctgttcgagccgcattctggagaagactacagtcgtgatgaggaccacatcgctcacatagtggagcttctgggggacatccccccagccttcgccctctcaggccgctattcccgggagttcttcaaccggagaggagagctgcggcacatccacaatctcaagcactggggcctgtacgaggtactcatggaaaagtacgagtggcccctagagcaggccacacagttcagcgcctttctgctgcccatgatggagtacatccccgaaaagcgggccagtgccgctgactgcctccagcacccctggctcaacccctaggcccggctgtggctccacctccagctctccgtgccttaagggaaaagcgggacagctcccaccaccctgctgggcgccagttctccacaaccacagggcagagagacgctggagccaggcccggctctcagagcgtgttctgcctgagacccccgtgagggctctcggagaaagtgtgtgtattcctttcttaataaagtgtggactgaaca

SEQ ID NO: 186364 - DNA, 614 bp, Homo sapiens
  Payload ID: 16697
  Gene Symbol: SRPK3
  Gene Name: SRSF protein kinase 3
  ENST ID: ENST00000430541
  CDS Start-End: 1-614
cagcggcggcagcggcggcagtagcagcaggtagggctcggctggggcacccggagcccctggcgtctctcatgcccactgccactcaccccacccgcagctcacaggcctcctgcgggcccgagtcctcgggctccgaactagccctggccacaccggtgcctcagatgctgcagggccttctgggctccgacgacgaggaacaggaagaccccaaagactactgcaagggcggctaccaccctgtgaagatcggcgacgtgttcaatgggcggtaccacgtggtgcgcaaactgggctggggccacttctccaccgtctggctctgctgggacatccagcgcaagcgctttgtggccctcaaagtggtgaagagtgcggggcattacacggagacagctgtggatgagatcaagctcctgaaatgtgtccgggacagcgaccccagtgaccccaaaagagagaccattgtccagctcattgatgacttcaggatctcaggagtcaatggagtccatgtgtgcatggtgctggaggtgctgggccaccagctcctcaaatggatcatcaagtccaactaccagggcctgcccgtgccctgcgtgaagagcatc

SEQ ID NO: 186365 - DNA, 386 bp, Homo sapiens
  Payload ID: 16697
  Gene Symbol: SRPK3
  Gene Name: SRSF protein kinase 3
  ENST ID: ENST00000458681
  CDS Start-End: 1-386
gacagccttggccccagcccgtccccagggctccccttgcttccagcacaagcacttcacggaagacatccagactcggcagtaccgggccgtcgaggtgctgatcggcgccgaatacggccccccggcagacatctggagcacagcctgcatggccttcgagctggccactggtgactacctgttcgagccgcattctggagaagactacagtcgtgatgaggaccacatcgctcacatagtggagcttctgggggacatccccccagccttcgccctctcaggccgctattcccgggagttcttcaaccggagaggagagctgcggcacatccacaatctcaagcactggggcctgtacgaggtactcatggaaaagtacgagt

SEQ ID NO: 186366 - DNA, 4479 bp, Homo sapiens
  Payload ID: 16697
  Gene Symbol: SRPK3
  Gene Name: SRSF protein kinase 3
  ENST ID: ENST00000489426
  CDS Start-End: 2367-4271
gtgacccaaaaccactggaagagactcaacaccttgcaacactacaaggtcccagatggagcaacagtggggctcgtccctcagctgcaccgtggcagcaccatctcccagagcctggcccagaggtgccccttgggagagaacatacccacgctggaggatggcgaggaggggggggtgtgcctctggcacctggtgaaagccaccgaggagccagaaggggccaaggtgcggtgcagcagcctgcgggagcgcgagccagcaagggccaaggccattccggaaatctacctcacccgtctgctgtccatgaagggcacgctgcagaagtttgtggacgacaccttccaggccattctcagcgtgaaccggcccatccccatcgccgtcaagtacctgtttgaccttctggatgagctagcagagaagcacggcatcgaggacccagggaccctgcacatctggaagaccaacagtctgctgctgcggttctgggtgaatgccttgaagaacccacagctcatctttgatgtacgggtgtcggacaatgtggacgccatccttgctgtcatcgcccagaccttcattgactcctgtaccacctcggagcataaagtgggccgggtgagagcagtgccagcagcagcagctggcaggggcttgaggaggaaaggcttatgggggaagcctagagggctgtgcacagagctctgggtgggcagtggcagcatcatgggggcaccttcacctccgagctcatgcctagcgcctcccctccctccggagcaggattccccagtgaacaaactgctctacgcccgggagatcccacgctacaagcagatggtggagaggtgggtgtcagaggcatcggggctgcggggaagggggctgccccacccctaacgaagtctgctcctccaggtactatgcggacattcgccagagctctccggcgagctaccaggagatgaactctgctttggctgagctctccgggaactacacttctgctccccactgtctggaggctctgcaagaactctacaaccacatccacaggtactatgatcagattatcagtgccctggaggaggaccctgtgggccagaagctgcagctggcctgccgcctgcagcaggtcgccgccctggtggaaaacaaagtgactgacctgtgagctctggctcagacagcagcaagccggatccaccaacaccgcagcgccttatgaccccggaaccgagccagccactgaggggagctggcagagcctgggggcacagggtgcaaagccaggcactgtgcccagcagtgggctccctgcctgccacctcccctgccagcccacccaccttccccccacctgagattgtttctaatttataaggatccccctccttccccctctccccattgtatttatttgcctgctggaaaatcacatccggaaataaaatagaaatatgtctttttattttattttgagacggagtctcgctctctctcccaggctggagtgcagtggcgcaatctcggctcactgcaacctctttttcccggagttcaagcaattctcctgcctcagcctcccgagtagctgggactacaggcgtgtgccaccacacccgactaattttggtatttttagtaaagacagggtttccccatgtcggacaggctggtctcaaaactcctgacttcaggtgatctgcccgcctcagcctcccaaagtgctgggatcacaggcatgagccaccgcgcctggccagaaatgtcttttgacaaagggcccaatccccagcccctgctgttccctgcaggagctgactcagtgctctcctgactgagagtccctcagccccatgcctataacctgctacccacagacaaagagaggccatcaggtacccgggcttcactttccctcccactctctgacctcgctggcccctccagcaatgcctggcccacccctaccagttcacggaccctggtacagggacactgcaccaatatcttgggacaaacaccctctctgccgagccccctccctttcattgggactcctctgtcaggccccagctggcctcccggctccaccctcgcctctccattcccttgtccttgaagtggccagagtgatcttttgctgagcagaagctcagtgaccaccccccaaccccatatcacccaagctccacattaagcctacagacaccaggcctctagtcctcgccctcgaaccatgcggcagccgtggccagcacgtgaagggctggaacgcgtcttggccgcaggccttgccccactgtgccctgtgctgccctggatgcttctggggacccaatttctcctggtctctcatgatgcagcccctgggtcacaggcccctcagtcaccaccgcactcatggggaagtggctatgggcttgcttgtccccagcagtgagcagcttcctgctgcctccctcatgtctggctatggagcagcccacgacaggcaccttgcaaatggtggagaggaagagcaggcgctgggagccagagcgccaggcagcgtcgcaggagcaggttctgggctggcaagctcccaggcctcccctcagcaggcctgttgcctctgctcacaggcctcctgcgggcccgagtcctcgggctccgaactagccctggccacaccggtgcctcagatgctgcagggccttctgggctccgacgacgaggaacaggaagaccccaaagactactgcaagggcggctaccaccctgtgaagatcggcgacgtgttcaatgggcggtaccacgtggtgcgcaaactgggctggggccacttctccaccgtctggctctgctgggacatccagcgcaagcgctttgtggccctcaaagtggtgaagagtgcggggcattacacggagacagctgtggatgagatcaagctcctgaaatgtgtccgggacagcgaccccagtgaccccaaaagagagaccattgtccagctcattgatgacttcaggatctcaggagtcaatggagtccatgtgtgcatggtgctggaggtgctgggccaccagctcctcaaatggatcatcaagtccaactaccagggcctgcccgtgccctgcgtgaagagcatcgtgaggcaggtgctgcacggcctggactacctccacaccaagtgcaagatcatccacacggacatcaagcccgagaacatcttgctgtgtgtgggggacgcttacatcaggcgcctggctgccgaggccacggagtggcaacaggcaggggcgccgcccccctcccgctccatagtcagcactgccccccaggaggtcttgcagaccggtaagctgtccaaaaacaagaggaagaagatgaggcgcaaacggaaacagcagaagcggctgctggaggagcggctgcgggacctgcagaggctggaggccatggaggctgccacccaggctgaggactctggcttgagactagacgggggcagcggctccacatcctcttcaggctgtcaccccgggggcgccagagcaggtccctccccagcctcttcctcccccgccccagggggcggccgtagcctcagcgcgggctcacagacctcaggcttctccggctccctcttctctcctgcctcctgctccatcctctccggctcgtccaatcagcgagagaccgggggcctcctgtcgcctagcacaccattcggtgcctcgaacctcctggtgaaccccctggagccccaaaatgcagataagatcaagatcaagatcgcagacctgggcaacgcctgctgggtgcacaagcacttcacggaagacatccagactcggcagtaccgggccgtcgaggtgctgatcggcgccgaatacggccccccggcagacatctggagcacagcctgcatggccttcgagctggccactggtgactacctgttcgagccgcattctggagaagactacagtcgtgatgaggaccacatcgctcacatagtggagcttctgggggacatccccccagccttcgccctctcaggccgctattcccgggagttcttcaaccggagaggagagctgcggcacatccacaatctcaagcactggggcctgtacgaggtactcatggaaaagtacgagtggcccctagagcaggccacacagttcagcgcctttctgctgcccatgatggagtacatccccgaaaagcgggccagtgccgctgactgcctccagcacccctggctcaacccctaggcccggctgtggctccacctccagctctccgtgccttaagggaaaagcgggacagctcccaccaccctgctgggcgccagttctccacaaccacagggcagagagacgctggagccaggcccggctctcagagcgtgttctgcctgagacccccgtgagggctctcggagaaagtgtgtgtattcctttcttaataaagtgtggactg

SEQ ID NO: 186367 - DNA, 2842 bp, Homo sapiens
  Payload ID: 16698
  Gene Symbol: SOX1
  Gene Name: SRY (sex determining region Y)-box 1
  Uniprot ID: O00570
  ENST ID: ENST00000330949
  CDS Start-End: 13-1188
ccagccgccccgatgtacagcatgatgatggagaccgacctgcactcgcccggcggcgcccaggcccccacgaacctctcgggccccgccggggcgggcggcggcgggggcggaggcgggggcggcggcggcggcgggggcgccaaggccaaccaggaccgggtcaaacggcccatgaacgccttcatggtgtggtcccgcgggcagcggcgcaagatggcccaggagaaccccaagatgcacaactcggagatcagcaagcgcctgggggccgagtggaaggtcatgtccgaggccgagaagcggccgttcatcgacgaggccaagcggctgcgcgcgctgcacatgaaggagcacccggattacaagtaccggccgcgccgcaagaccaagacgctgctcaagaaggacaagtactcgctggccggcgggctcctggcggccggcgcgggtggcggcggcgcggctgtggccatgggcgtgggcgtgggcgtgggcgcggcggccgtgggccagcgcctggagagcccaggcggcgcggcgggcggcggctacgcgcacgtcaacggctgggccaacggcgcctaccccggctcggtggcggcggcggcggcggccgcggccatgatgcaggaggcgcagctggcctacgggcagcacccgggcgcgggcggcgcgcacccgcacgcgcaccccgcgcacccgcacccgcaccacccgcacgcgcacccgcacaacccgcagcccatgcaccgctacgacatgggcgcgctgcagtacagccccatctccaactcgcagggctacatgagcgcgtcgccctcgggctacggcggcctcccctacggcgccgcggccgccgccgccgccgctgcgggcggcgcgcaccagaactcggccgtggcggcggcggcggcggcggcggccgcgtcgtcgggcgccctgggcgcgctgggctctctggtgaagtcggagcccagcggcagcccgcccgccccagcgcactcgcgggcgccgtgccccggggacctgcgcgagatgatcagcatgtacttgcccgccggcgaggggggcgacccggcggcggcagcagcggccgcggcgcagagccggctgcactcgctgccgcagcactaccagggcgcgggcgcgggcgtgaacggcacggtgcccctgacgcacatctagcgccttcgggacgccggggactctgcggcggcgacccacgagctcgcggcccgcgcccggctcccgccccgccccggcgcggcgtggcttttgtacagacgttcccacattcttgtcaaaaggaaaatactggagacgaacgccgggtgacgcgtgtcccccactcaccttccccggagaccctggcgaccgccgggcgctgacaccagacttgggttttagactgaacttcggtgttttcttgagactttttgtacagtatttatcacctacggaggaagcggaaagcgttttctttgctcgaggggacaaaaaagtcaaaacgaggcgagaggcgaagcccacttttgtataccggccggcgcgctcactttcctccgcgttgcttccggacggcgccgaccgccggagcccaagtgacgcggagctcgtcgcatttgttataaatgtagtaaggcaggtccaagcacttacaagttttttgtagttgttaccgctcttttgggttggtttgttaatttatacaaagagattaccaccaccaccccctccttcagacggcggagttatattctgggttttgtaaaactttatgtatctgagcatttccatttttttttttgggttttgtattatttcttgtaaatgcattgtgaaaaattttattttcggcgttgcaatgcggggaggagaagtcagattatgtacatagttttctaaaaagcctttcttctaaaaacgaaaaaagaccccccacccaaaatgtttcgagtcaacaaatttaagagacagagcccattttctccataaatttgtaacatgctatttttatgtgcatgttttatgagttcaaaatgcaatgaggaaatctgacagggaaattatctgtatgaactaaaagtaagggaaccccggggaatgggaggacaggatttttcaaggaacctttttcaatgaaagagaaggaagttaaaacctataggttattttgtagagctgagtgttaatacgggccgagaaataaaagtatcttctgctccggctgtttcactgcggacggctggggctgctgcgcgttaccttgctgcaagcggggcgccttccacctggctgggggtctgcgccacagtttggtccagaggagggaggaggaagggaagaccccagtggtgggaccctggaccaggccatggatgaaggacaaagaccagggcaggtcacgggtttcccaattccccagcaattaagatttcgagcagaatttatctaaatgtgtttcaaggaaacacaatcgctgaaccaaaacgtactgcagccgagccccctccgtccatcctctgcccctccccctggcttctttctcttgggaaaacgggcaaaataattgtgctggattctcacacacacagaaatatcgaccatcaccctcccccgcgtgaactgggatgcaagttgctaaccgatgtgaacgcaaaatgccttgttcattattcctgacgagatcttgaggttgtttgatgctttaaattttttaattatattattttctaggtgtttattggtacattgcagttttttttttgaaatttaaaaatttctgtaaaactttgtcttcaagtaatctgacagcattaaatattgcatttaaaaatta

SEQ ID NO: 186368 - DNA, 2861 bp, Homo sapiens
  Payload ID: 16699
  Gene Symbol: SOX10
  Gene Name: SRY (sex determining region Y)-box 10
  Uniprot ID: P56693
  ENST ID: ENST00000360880
  CDS Start-End: 266-1666
ggggggtgaagggtcactgctgaccggaggcagctctgccaggcagtgtcatcagtgggcttcacgtttgactgacagcccaccagcgtcacctcccagccccgagctggaccgcacaccttgggacacggttttccacttcctaaggacgagccccagactggaggagaggtccgaggaggtgggcgttggactctttgcgaggaccccggcggctggcccgggggaggcggccgaggcggcggcggcggcggccgggggcgacatggcggaggagcaggacctatcggaggtggagctgagccccgtgggctcggaggagccccgctgcctgtccccggggagcgcgccctcgctagggcccgacggcggcggcggcggatcgggcctgcgagccagcccggggccaggcgagctgggcaaggtcaagaaggagcagcaggacggcgaggcggacgatgacaagttccccgtgtgcatccgcgaggccgtcagccaggtgctcagcggctacgactggacgctggtgcccatgcccgtgcgcgtcaacggcgccagcaaaagcaagccgcacgtcaagcggcccatgaacgccttcatggtgtgggctcaggcagcgcgcaggaagctcgcggaccagtacccgcacctgcacaacgctgagctcagcaagacgctgggcaagctctggaggctgctgaacgaaagtgacaagcgccccttcatcgaggaggctgagcggctccgtatgcagcacaagaaagaccacccggactacaagtaccagcccaggcggcggaagaacgggaaggccgcccagggcgaggcggagtgccccggtggggaggccgagcaaggtgggaccgccgccatccaggcccactacaagagcgcccacttggaccaccggcacccaggagagggctcccccatgtcagatgggaaccccgagcacccctcaggccagagccatggcccacccacccctccaaccaccccgaagacagagctgcagtcgggcaaggcagacccgaagcgggacgggcgctccatgggggagggcgggaagcctcacatcgacttcggcaacgtggacattggtgagatcagccacgaggtaatgtccaacatggagacctttgatgtggctgagttggaccagtacctgccgcccaatgggcacccaggccatgtgagcagctactcagcagccggctatgggctgggcagtgccctggccgtggccagtggacactccgcctggatctccaagccaccaggcgtggctctgcccacggtctcaccacctggtgtggatgccaaagcccaggtgaagacagagaccgcggggccccaggggcccccacactacaccgaccagccatccacctcacagatcgcctacacctccctcagcctgccccactatggctcagccttcccctccatctcccgcccccagtttgactactctgaccatcagccctcaggaccctattatggccactcgggccaggcctctggcctctactcggccttctcctatatggggccctcgcagcggcccctctacacggccatctctgaccccagcccctcagggccccagtcccacagccccacacactgggagcagccagtatatacgacactgtcccggccctaaagggggccctgtcgccaccaccccccgcccagcccctgcccccagcctgtgtgccctgttccttgcccacctcaggcctggtggtggcagtggaggaggctgaggaggctgaagaggctgacaggtcggggggctttctgtctggctcactgccctgatgacccacccgccccatccaggctccagcagcaaagccccaggagaacaggctggacagaggagaaggaggttgactgttgcacccacactgaaagatgaggggctgcaccttcccccaggaatgaccctctatcccaggacctgagaagggcctgctcaccctcctcggggaggggaagcaccagggttggtggcatcggaggccttaccactcctatgactcctgttttctctctcacagatagtgagggtctgacatgcccatgccacctatgccacagtgcctaagggctaggccacccagagactgtgcccggagctggccgtgtctcccactcaggggctgagagtagctttgaggagcctcattggggagtggggggttcgagggacttagtggagttctcatcccttcaatgccccctccctttctgaaggcaggaaggagttggcacagaggccccctgatccaattctgtgccaataacctcattctttgtctgagaaacagcccccagtcctcctccactacaacctccatgaccttgagacgcatcccaggaggtgacgaggcaggggctccaggaaaggaatcagagacaattcacagagcctccctccctgggctccttgccagctccctcttcccttactaggctctatggcccctgctcagtcagccccactccctgggcttcccagagagtgacagctgctcaggccctaacccttggctccaggagacacagggcccagcacccaggttgctgtcggcaggctgaagacactagaatcctgacctgtacattctgcccttgcctcttaccccttgcctcccagtggtatttgaataaagtatgtagctatatctgcccctattttcctgttctgcagccccccaaatccacatgtaactcattactgtctcctgttatttatctcagtagtcccctctcctagccactctagcccctattaactctgcattaagcattccacataataaaattaaaggttccggttacctgcttggtga

SEQ ID NO: 186369 - DNA, 2879 bp, Homo sapiens
  Payload ID: 16699
  Gene Symbol: SOX10
  Gene Name: SRY (sex determining region Y)-box 10
  Uniprot ID: P56693
  ENST ID: ENST00000396884
  CDS Start-End: 284-1684
gggctgtccggccagggtggttggtggtaaggattcaggctccgtcctaacgaggccgtggcctgaggctcagggccccccgcccctccctcccagcccaccagcgtcacctcccagccccgagctggaccgcacaccttgggacacggttttccacttcctaaggacgagccccagactggaggagaggtccgaggaggtgggcgttggactctttgcgaggaccccggcggctggcccgggggaggcggccgaggcggcggcggcggcggccgggggcgacatggcggaggagcaggacctatcggaggtggagctgagccccgtgggctcggaggagccccgctgcctgtccccggggagcgcgccctcgctagggcccgacggcggcggcggcggatcgggcctgcgagccagcccggggccaggcgagctgggcaaggtcaagaaggagcagcaggacggcgaggcggacgatgacaagttccccgtgtgcatccgcgaggccgtcagccaggtgctcagcggctacgactggacgctggtgcccatgcccgtgcgcgtcaacggcgccagcaaaagcaagccgcacgtcaagcggcccatgaacgccttcatggtgtgggctcaggcagcgcgcaggaagctcgcggaccagtacccgcacctgcacaacgctgagctcagcaagacgctgggcaagctctggaggctgctgaacgaaagtgacaagcgccccttcatcgaggaggctgagcggctccgtatgcagcacaagaaagaccacccggactacaagtaccagcccaggcggcggaagaacgggaaggccgcccagggcgaggcggagtgccccggtggggaggccgagcaaggtgggaccgccgccatccaggcccactacaagagcgcccacttggaccaccggcacccaggagagggctcccccatgtcagatgggaaccccgagcacccctcaggccagagccatggcccacccacccctccaaccaccccgaagacagagctgcagtcgggcaaggcagacccgaagcgggacgggcgctccatgggggagggcgggaagcctcacatcgacttcggcaacgtggacattggtgagatcagccacgaggtaatgtccaacatggagacctttgatgtggctgagttggaccagtacctgccgcccaatgggcacccaggccatgtgagcagctactcagcagccggctatgggctgggcagtgccctggccgtggccagtggacactccgcctggatctccaagccaccaggcgtggctctgcccacggtctcaccacctggtgtggatgccaaagcccaggtgaagacagagaccgcggggccccaggggcccccacactacaccgaccagccatccacctcacagatcgcctacacctccctcagcctgccccactatggctcagccttcccctccatctcccgcccccagtttgactactctgaccatcagccctcaggaccctattatggccactcgggccaggcctctggcctctactcggccttctcctatatggggccctcgcagcggcccctctacacggccatctctgaccccagcccctcagggccccagtcccacagccccacacactgggagcagccagtatatacgacactgtcccggccctaaagggggccctgtcgccaccaccccccgcccagcccctgcccccagcctgtgtgccctgttccttgcccacctcaggcctggtggtggcagtggaggaggctgaggaggctgaagaggctgacaggtcggggggctttctgtctggctcactgccctgatgacccacccgccccatccaggctccagcagcaaagccccaggagaacaggctggacagaggagaaggaggttgactgttgcacccacactgaaagatgaggggctgcaccttcccccaggaatgaccctctatcccaggacctgagaagggcctgctcaccctcctcggggaggggaagcaccagggttggtggcatcggaggccttaccactcctatgactcctgttttctctctcacagatagtgagggtctgacatgcccatgccacctatgccacagtgcctaagggctaggccacccagagactgtgcccggagctggccgtgtctcccactcaggggctgagagtagctttgaggagcctcattggggagtggggggttcgagggacttagtggagttctcatcccttcaatgccccctccctttctgaaggcaggaaggagttggcacagaggccccctgatccaattctgtgccaataacctcattctttgtctgagaaacagcccccagtcctcctccactacaacctccatgaccttgagacgcatcccaggaggtgacgaggcaggggctccaggaaaggaatcagagacaattcacagagcctccctccctgggctccttgccagctccctcttcccttactaggctctatggcccctgctcagtcagccccactccctgggcttcccagagagtgacagctgctcaggccctaacccttggctccaggagacacagggcccagcacccaggttgctgtcggcaggctgaagacactagaatcctgacctgtacattctgcccttgcctcttaccccttgcctcccagtggtatttgaataaagtatgtagctatatctgcccctattttcctgttctgcagccccccaaatccacatgtaactcattactgtctcctgttatttatctcagtagtcccctctcctagccactctagcccctattaactctgcattaagcattccacataataaaattaaaggttccggttacctgcttggtga

SEQ ID NO: 186370 - DNA, 1095 bp, Homo sapiens
  Payload ID: 16699
  Gene Symbol: SOX10
  Gene Name: SRY (sex determining region Y)-box 10
  ENST ID: ENST00000446929
  CDS Start-End: 1-539
accagtacccgcacctgcacaacgctgagctcagcaagacgctgggcaagctctggaggctgctgaacgaaagtgacaagcgccccttcatcgaggaggctgagcggctccgtatgcagcacaagaaagaccacccggactacaagtaccagcccaggcggcggaagaacgggaaggccgcccagggcgaggcggagtgccccggtggggaggccgagcaaggtgggaccgccgccatccaggcccactacaagagcgcccacttggaccaccggcacccaggagagggctcccccatgtcagatgggaaccccgagcacccctcaggccagagccatggcccacccacccctccaaccaccccgaagacagagctgcagtcgggcaaggcagacccgaagcgggacgggcgctccatgggggagggcgggaagcctcacatcgacttcggcaacgtggacattggtgagatcagccacgagatggggaaactgaagtttgcgaggctgatgctaagaagtgctggtgccagaatctgaacccagctctgactccaaggcttgcatttttaaccatcatcccctccacctgcctgtggtttgcagcccctgcttctgctttgtatctggagcaatgcatcttccactgctccagactgggcatcctcagctcccttccttccatctgcggtctccagcccctagtcaggaccaggggagaggcagggcaccaagaagtagcccagtccccagggtggccaaaatccctccatctaggacctgcatcatggaagctcttcaagcaacctccccaaaactgctggttcccgtgaagctggatggtaaccgaaaccccgatcttttagacaatatccattgcaaagtcatatccaaattgtatgtatgctgtttttgttttgttttagataaaagcaggactttacactgatctttaacagatctcaccttgttgggtttgacccatttccccacctgtattaaactttttagaacttagctctcctttagagctttatgtatctgcaaacttgaatagcctcattcaagtcactaataaaggtcgaaatgaagaggg

SEQ ID NO: 186371 - DNA, 873 bp, Homo sapiens
  Payload ID: 16699
  Gene Symbol: SOX10
  Gene Name: SRY (sex determining region Y)-box 10
  ENST ID: ENST00000427770
  CDS Start-End: 233-873
ccgaggaggtgagtgcgcagcctgctcctccctggcccgcccaggcctgggaccctgctgtgaggtggagagaggcgacaccccgcccttgccccccacctggctctcctctaaaccccgttggggcaggctgagggaagaaggaaaggtgggcgttggactctttgcgaggaccccggcggctggcccgggggaggcggccgaggcggcggcggcggcggccgggggcgacatggcggaggagcaggacctatcggaggtggagctgagccccgtgggctcggaggagccccgctgcctgtccccggggagcgcgccctcgctagggcccgacggcggcggcggcggatcgggcctgcgagccagcccggggccaggcgagctgggcaaggtcaagaaggagcagcaggacggcgaggcggacgatgacaagttccccgtgtgcatccgcgaggccgtcagccaggtgctcagcggctacgactggacgctggtgcccatgcccgtgcgcgtcaacggcgccagcaaaagcaagccgcacgtcaagcggcccatgaacgccttcatggtgtgggctcaggcagcgcgcaggaagctcgcggaccagtacccgcacctgcacaacgctgagctcagcaagacgctgggcaagctctggaggctgctgaacgaaagtgacaagcgccccttcatcgaggaggctgagcggctccgtatgcagcacaagaaagaccacccggactacaagtaccagcccaggcggcggaagaacgggaaggccgcccagggcgaggcggagtgccccggtggggaggccgagcaaggtgggaccgccgccatccaggcccactacaagagcgcccacttggacca

SEQ ID NO: 186372 - DNA, 8719 bp, Homo sapiens
  Payload ID: 16700
  Gene Symbol: SOX11
  Gene Name: SRY (sex determining region Y)-box 11
  Uniprot ID: P35716
  ENST ID: ENST00000322002
  CDS Start-End: 56-1381
acctccgcacgagacccagcggcccgggttggagcgtccagccctgcagcggatcatggtgcagcaggcggagagcttggaagcggagagcaacctgccccgggaggcgctggacacggaggagggcgaattcatggcttgcagcccggtggccctggacgagagcgacccagactggtgcaagacggcgtcgggccacatcaagcggccgatgaacgcgttcatggtatggtccaagatcgaacgcaggaagatcatggagcagtctccggacatgcacaacgccgagatctccaagaggctgggcaagcgctggaaaatgctgaaggacagcgagaagatcccgttcatccgggaggcggagcggctgcggctcaagcacatggccgactaccccgactacaagtaccggccccggaaaaagcccaaaatggacccctcggccaagcccagcgccagccagagcccagagaagagcgcggccggcggcggcggcgggagcgcgggcggaggcgcgggcggtgccaagacctccaagggctccagcaagaaatgcggcaagctcaaggcccccgcggccgcgggcgccaaggcgggcgcgggcaaggcggcccagtccggggactacgggggcgcgggcgacgactacgtgctgggcagcctgcgcgtgagcggctcgggcggcggcggcgcgggcaagacggtcaagtgcgtgtttctggatgaggacgacgacgacgacgacgacgacgacgagctgcagctgcagatcaaacaggagccggacgaggaggacgaggaaccaccgcaccagcagctcctgcagccgccggggcagcagccgtcgcagctgctgagacgctacaacgtcgccaaagtgcccgccagccctacgctgagcagctcggcggagtcccccgagggagcgagcctctacgacgaggtgcgggccggcgcgacctcgggcgccgggggcggcagccgcctctactacagcttcaagaacatcaccaagcagcacccgccgccgctcgcgcagcccgcgctgtcgcccgcgtcctcgcgctcggtgtccacctcctcgtccagcagcagcggcagcagcagcggcagcagcggcgaggacgccgacgacctgatgttcgacctgagcttgaatttctctcaaagcgcgcacagcgccagcgagcagcagctggggggcggcgcggcggccgggaacctgtccctgtcgctggtggataaggatttggattcgttcagcgagggcagcctgggctcccacttcgagttccccgactactgcacgccggagctgagcgagatgatcgcgggggactggctggaggcgaacttctccgacctggtgttcacatattgaaaggcgcccgctgctcgctctttctctcggagggtgcagagctgggttccttgggaggaagttgtagtggtgatgatgatgatgataatgatgatgatgatggtggtgttgatggtggcggtggtagggtggaggggagagaagaagatgctgatgatattgataagatgtcgtgacgcaaagaaattggaaaacatgatgaaaattttggtggagttaaagtgaaatgagtagtttttaaacatttttcctgtcctttttttgtcccccctcccttcctttatcgtgtctcaaggtagttgcatacctagtctggagttgtgattattttcccaaaaaatgtgtttttgtaattactatttctttttcctgaaattcgtgattgcaacaaaggcagagggggcggggcgggggaggggaggtaggacccgctccggaaggcgctgtttgaagcttgtcggtctttgaagtctggaagacgtctgcagaggacccttttggcagcacaactgttactctagggagttggtggagatatttttttttcttaagagaacttaaagaactggtgatttttttttaacaaaaaaagggaccattgcaacttttgttaatttaattttttttttttttttttttttttttttttttggagggagaaaactgatgtcttctatgcatccgattcttaacaaaactgcagggagcttgaaaaaatgcagactgtacaaacgcttacaaaaaaaaaaactgtgaactgacttaagatcagagtttacttttcagatcaaattgtttatggttttacaaatgtgatttctacttgccaactttttttttgtaacttgttcccttatacctccttgattgaataccagacagcctagacctcagtacaaaaggtattgaaacatttttgatacataacagacctcagtcttttttaaaaattaatatattttcaggcgtatttttgtacagtgaaaagggaacattcttgctgtgttttttcagtaagactttcaggcacttcttcccttttgatttcttttttttcctctgttttttagcatgcaagtatgttggtacgttatgtcctggtttaaaaaggattaaaattttaaaataatccttgcatctaaaggccttgtggtttaaaaaaaaaaagcaaacttttttttgtacagctatagtagagatttgttcaatatttgtaggtaaagatttattgaaaatggtgatatagacctcagagctgttatcttagtttaaagattgtatatgtactgtactatagtaggactttatgtatctcatacgctgtgatgtggatggggccccagatggaaggtttgaaactggattctcgatttttagcaaaaaagaaaaaaaaaaggcacatagtttaaaaagtttctcattttgtgcaatataatctaaataaagtacagaccatctgcatattttgtagcaaatggtggcaaagcagactcaatgcactgtcgacatcattgcctgtttttttttttttttttttgtgctggaagtctgtatcttgacaattttaataaatcagctggaactgatagaaactcgcatcgccaatagtctctatggaagtcaaactggaggtcctgttgtcgcagagcattcggtggtgaggctgttgtgtgcgcggatgaggggaggtggcaggagagaattctacatttagggggttaggctgaaaagtgttcaattagcaggctgatttctttttcctcttccgctagttgtgaaagacaggggaagggtgttctttctctctgccctccctttccatctccagctccccatttcctttctcacctcctcctccactccctgcctcttctccccacccatcctggcgggcgggctgcgcggaggctcgggagctggccggggaggggcggatggaggggcctgggttgccagctcccttggtcggggtcctgctcgctggggcttgtgtgttctctgcggcgggccgcgtccccgctgagcctcgcggtgacagccgcctttggcagcgagcgctcggggcacttctatccccgcctctcaaagggtggggacagccgtttccagatttgaattttttctgttctttatttttaacgctgcatcttcgcgtgtgctcagaggtggttgttggcggagaacgccgccgcagtgtttgacctctagcggtgaagggggaaggggaagaggaaaggagagaagtggtcggtgtctgtttccttctgtcccccggggccgtggagctgtcggagggaaggaggacggtgcggggccgcagggggcgcggggcgcggcgggacccaggctacgagcgggagggaggcgggagtcgggggaagacgcggcaggccggccgagggcaccccgaggaacatggcatggcctctgtgcgatccgagtcgcggtctccggggtgcctgggagggccgaaccactggtgagggcgtggggagcagggggtggcagagggcacccgggcggtagtccgggacgcgcaaggcagagccctgacgctccgggtccccgtgcctggctcttcttgcctcgccaccgcgtgctcctgggcgcgccccgccgcgggcccttgaggcgcgcggagacaccagcgctggcttcccgggcccgcgggccggggagggaagcctcggggctgcggggtgagaggaagaaagcaaacccggggagcaggcggctgccgcacccgcgcaccccgggccctcaccacgccctccccgcgcgccggctcaggggctgccccggaatcagctccccggggccgccgcaacgaaggtggatccgcatcttgattgttctccgggagcctcctgggggctccggcggcggcgcgggcgcgacccatcccgctggcgctccccgctcgctgaaccccgtttgcctgtccacaccccctcgctccccaccatttttcctgaccggcctgtgtccccgagccctcgcggcaggcccgagcaggcgatcgcggccgggcacgcgcgccccgggctcccgccccccttccgagcatccgccgcctcttttctgctgggtctgggaggagggaggctgggaggccgctcggggcccagcgtgccagccccggagttcagcctcccgagctgcggcgcccgcagcggaggaggttttcagtggctgattgaaactcactgcaaaatcaccacgactctttcacctactgagatgattgaccgaggtttggccttccatttttactgagatttggcgagaccgaatggaagcgtccgcacagtaactgcagctgctaggccagaggggccccggcgcccttcccgcctcccctcccgcttgcttttgccttactcgatcttaccaccacccctcccccggccccccgactgagaactcgggcctctcacccgccccccagcctcccgctctgggcgagcctcctccccagcccccacccctgggatgcgaagccagcaagcttttgctgcagatggacaggtttcttttctgtggctttttcctttcgataaaccatcagatttcagtagtacatttgggaaaagaaggggctgatggcgttaaccaggttctcaatatagaactggatttctggagttgtttaccttaccccacaccccctcaacatgtagactaatgcagccattggtggtacatttattttagccacggataattgaaccagcggtttacaattgacacgtgctccgtgctggtgattttatgtggcagccctctgctgcagttccgaaacttgttggcaacgtaaacccattgataggctgatctatgtattttgaaagcctgaaaacttggcatgtcttttctgttttaatcatagatgaatcttggacattttctgtggtgaggtggaaactttaagtaaattagtaaagtaataatttggcttcagaatgggaagagatagtcaagattttttttttttaaagccatgtggcctaacttgatacaaaaataaaagtaattgtttggcaatctaaatttaaaacctgttagaactcaggacaggcgcttcaatgcgctttttaacaatatttaaggctgttttgatgagtgcgttgtgagaatcatcttaatgaattctttattgagtgtctaaaacatagtataatacacatggtattcttgccactggatagtcttcaataaaagtttaattgatttttttttgttggtctcttaagtaagtcttatttttaactaagcattgacagaatatcttaaaatggtaacctgggggtggcgggtgggtgctgtgtgcacggcagcctagccagtggggatcctgctgtttattataagtagttcacagactctgatggcattttggtaagctttccatctttaagaaattgaaccagcattctcttattaattctttaaactgtggaagtaatttccagttcttacactctgatacgcatcccttttatttaaaaaaaaaaaaaatgctaataaaaggcagtgtacttaaactgtgctttgcaaatattgtgtatgttatgaatgactacagacactgggcaaattatttgtagaatgattatcctttagctagagaaagaaatcattacaactcttttgggcagagatgtttctttttaatgttaatcaaggggaagtgatttaaatatgcataaatgtagcagtcagggtgatttagttgcttttttcatgaaagaaaaagactcaaaagacaagacttatttttctcttctgggacttgaaatcataatcatctgatattagtacagtacaagaaatttacatttgttttttacttcagaatttaagtgacttttgcccaaggaatttgagaaataaggcaaataagttgctctattttaaagtagtcattcaatataaatatattatatcaatcttaacttttttattctctgatatgattaataatatgtatattcttacttttcttctaatgggcatatgtatccttgtggacactttgagagaggttttcttggactctcccatttatagaatctttatactcttttactgtgtggttccctgcttttaacagatttctgaggcaaatatatttgtgcttttttcttatgtaggaagaccagcgaaaatagtttactgagttgtcaattttatcagtagataagaaactttctttattacagtttcagggaagattttttcaggatatttctcagttattctaagggccaaattttgtaaaatttccattaggaatgtcagtttcaaataccctttgtatagcctaagcctgtgaggataacaagaatgagccttacctatcctaacacagggatttacaagttcccaaagtaaccgtctccatgtaactcttgacatacttttctgagatttggcttatttttattattggttatttctcactgttcattctatttgatttattctacaacatccccttttatttaatgatctggaaaattctgctctttgataacaactcaggatttttttgttcagttttggtttttgccccttcctgtggagcctacattttcaaccacaataaagatgaaacaaaatttatgaaactgagctctcttccattttacttactgctggcttttttttttttttttttccttgattcctaccataccttcgtttttttcattgtacttttttaacactacctatatccattagctgcctaattagttttatctgttccatgtggatgcagtgagtttataagagaatttcacaaacaagtagttttttagtgaacttaaaataaacagaattttaaaggagacctatttttatactcaataaaagcacaaaagtgcagaaagtataaaacggcttacaaagggagacacaagctcataatgttccatgtataaaagtaataactttattgggtagagatattcttacaagatctagcacctctgccagtgcacagataggactgttttaaatgatttgggaacttttggttgcctgcagttgtgaacagagaacttctctacagagaaacaaaccactaaaagcaatatgaccgagttgagatgtggtttccaatgagcaattggtgaatttaagcaacctggatgtgcatatgtggaggctcccgtctcactgtttgatcaaacttcttttatgtagtcacgtagacttgattttttctgctgtgaaaatgaaaaaataaagcaatatgacaaaaagtttaaaaatgcataaaaaataggatttcctctaggctcctcgaagagatttttttaatatgatgcttgtcttactttcttagacacgttacatttccccttccaaaaaaaaaaaaaaggacaactggaagtaatttatcatataaagaattttgatcaaatagatattgacaaagggccctctgtcacatttttcttcatccagcttttgttcaaaaacagtatgcctcctcccttgaatcacatagggagaaacgttatactccattctcattaatttcccattttgtctacttttactcttgtacatatgttgtgggtttaagagtcttttgcatttgttctgtgacacctttttttgaattgactgttttaaaacggaggcctattttttccggtttgggactcctagtggttatggcatcccataatgcttcgtgacggccaccaggacagaaccacctgatgttttagagcagttttcagcatgacactgttaacaagtgtgtattttccaaggccacatgaaacttactttcttagccactccaggtttgggagcagaaaagctgaaaaacccttttgtgtagaagtctgagtggtttgtgggggggaccttttttagagtttgcatgccagcgcacggcctattgctgtgaaacagagagaaggtaaagctacctgaggcagtgcgctggaggatgaagtgtttgatagcactaggggggaaagaaaatgcatggcaaagtttcgtcttctcgtagactatctagcatgcagagtgtagtgtgttgaaacggtgtatgacattgctgtatcaaagttgtaaaattaagcattatttattgaaaactatgtatttttttgtaaaaacctgatcacatagagaatatcagtggcttgtgcttgtgcttcgatctaaccagcttcttgacccacccccccttggtatgcagtgttaatgctcagggttgaaaatagtacactccaatgtctcttttgcaagagtttttcacagaggattacatttgttcaaaagactctaataaaattgtgtgatcaatcttca

SEQ ID NO: 186373 - DNA, 4824 bp, Homo sapiens
  Payload ID: 16701
  Gene Symbol: SOX12
  Gene Name: SRY (sex determining region Y)-box 12
  Uniprot ID: O15370
  ENST ID: ENST00000342665
  CDS Start-End: 525-1472
gcggcgcccgagcgcgaggcggggcccggccgcagcccaagcgggcacctcggtgtttacacggggcggccccgcgcgcgccgcagcggcccgcagacggcgagggggaggggtggtgcgcgcgccggcggggccgcgcggggagaaagacactgaaaggcgtcggcggccgggcggggagcggcgcgcgcgggccgcggcggagccagaggctgcaggaagagcccgcgggggcccggagggtgcgattcctcggcccccgcaaaacaatgtgtgttgtgagccaggacgcaacttgccggaggcggcgggggcgcgccgagcccgcctgagaccgcgctgaccttctccccccgccgtccgttgggcccgagcgcccagctcctcgctccccagttcgcgggggccgggccgagccgcggggcggggccgcccctccgtcgccgctgcctcctcccccacccccagccgcggaggatgcggacggcccccggcggcgtctagcggccccgggcccaggcgcgatggtgcagcagcggggcgcgagggccaagcgggacggcgggccgccgcccccgggacccgggccggccgaggagggggcgcgcgagcccggctggtgcaagaccccgagcggccacatcaagaggccgatgaacgcattcatggtgtggtcgcagcacgaacggcggaagatcatggaccagtggcccgacatgcacaacgccgagatctccaagcgcctgggccgccgctggcagctgctgcaggactcggagaagatcccgttcgtgcgggaggcggagcggctgcggctcaagcacatggcggattacccggactacaagtaccggccgcgcaaaaagagcaagggggcgcccgccaaggcgcggccccgcccccccggtggtagcggtggcggcagccggctcaagcccgggccgcagctgcctggccgcgggggccgccgagcagcgggagggcctttggggggcggggcggcggcgcccgaggacgacgatgaagacgacgacgaggagctgctggaagtgcgcctggtcgagaccccggggcgggagctgtggaggatggtcccggcgggacgggccgctcggggacaagcggagcgcgcccaagggccgtcgggcgagggggcggccgccgccgccgccgcctccccgacaccgtcggaggacgaggagccggaggaagaggaggaggaggcggcagcggctgaggaaggtgaagaggagacggtggcgtcgggggaggagtcgctgggctttctgtccaggctgccccctggcccggccggcctggactgcagcgccctggatcgcgacccggacctgcagcctccctcgggcacgtcgcacttcgagttcccggactactgcacccccgaggttaccgagatgatcgcgggggactggcgcccgtctagcatcgcagacctggttttcacctactgagcccaccgtcagcggggcgcgcacgcccccaaaccagctgtttacatacaggaatcaggtattggggcccctcggaggccgaggctggcaccccatctcccgcgcagcctgccccctcctggacgtgcccatcccccctcagatccagacatgcccctcccccgcagacacaccccaaggcagcccaacccccaccccttccccgacacccaagcccctccccacgtcgccccctcctgcacagccaccagcagccagccccctccgatacacctcccgtcctctcctacagacctgcacccctccccccttttgcacacgcccctcctcgtggccggaggacccgccccctcctttgctccggaatctctcctccctcgcccggcccgccttctctgggttaggggggcgatgcggccgggtggcaacgcacgcgcctcctgcgcccctcccttccctggggggaggggcgcaccccttttatccccggagcgctagggcccgcccctccgctggggcccacccccttcgtgcgcatgcttaatgcttctggggaggagggggctggtcccagcggagccgcactcttcgcccgctccgggcaaaagcgggggcgagtgtagagcgatcctgggaaatcctttgatccgggagccctaggtttcctctccagccaacggggcgtcgctgccttaatgggaggagcactcggaagggttggtttgggcctgaaactctcccaagtggcatagccccttttccggtatggggtctcctacacccacgcgcaccacctctccggtcgcgtggctgcctctacagcctacctatacgtccctttttccccccaactgggaattgagaggtaaggtctttctctggaaatccagcagtagaggaagggaccacccaagaaaactaaaaaccaaggcaccttaccagtctgtctggggacaggatccctgctgcaccttccccaccccctcctgggaagtgccccctcacctcagggcacccgcaacctgggctcctccctgagcgcaccggcccttcctgtcacccaggtccaccctcagtactcaagctgcagtatacagcgggaaaaactgaggcactttggtgctaggggtttgggactgaggcgtggagagcagatgtgatggcaggaagactctcgcttttaaacatctggtttgggagagaccatcgacttggccagtgagactgagaatggattccgagtagtgatgggccgtttgcacctcggtttttccacgtgagaaatggggagaacgctgctgttaggaggaagttgtgtccagttcagggtgccctcgggagccctgtccctgttgctgtggcccctctcacgccgccatctctctgccccgccccgcccctccggcctccccacaccccccttgccctcactacctgtatctcaccggcgtgtgttcaccctcccgggtggctcacacactctcattcacacacacaaatctcaggaacaaacggtcccagagtcctccggacccctgcccagggtctctgcaggtctctgccccacgcgttcccgtcgctgacaaagccaccagctgcctcctttaagcttggtgctccggctctgggcctttcttgcgctctattttttttttttttttttttaagaaaaacaacaacaacaaaaaaagacaatgaaaaaaaaaacgtcatgtgagtgaagagatgtcactgtctgtggtcttggagaactagtctcgtagctgaggggtggggtccctctgtctggggcactggcacccacagcaggactccgccagtctgatgccaggactgaataaagtgtatttgccccgaccttgccctgtggttctgcatgtctgtgctcttcctcaaccctccctaaacagtttgccagattcaagtccgtgtgatttgggcccgagctgggtgtcccagggcaagccaccttgcctgtctaggcctctatgtcaggactccctggccttcatgaagaatagcaaactcatccctgtagggaccaggcaggtaacatagacgagtgactctgggtggacagtggtgtcatgacccacttcaaggggcctacctcctgccagttgtgaccctgtgggaatgcagtccacagtggccaggtggccagatttttcaagaaaagctggatggatgtttctgagtcatcttaatttcaaaatgagactcatattttaaaatttctgtgggccaaatgaaacaagtatgcaggcaggtctggtccgagggggctggcttggccatgcctttctgtgcctttaatgaggactaagaagcaagattgggccacactgtctggactcaaagcccagctccaccactgagcacccgtgtgactctttccatatgtataacgtggggataataataatagctgcttcacaggatgaaatgaagtttgaggtgagaagcattcaccatggtgcccatcgtgttactccattgtcagaggaggaaacggggtcaggcaggaaagcaacttaaaggagggcctgcaagcagccagggtcagagacagggcttggttctgcttcctggtgaagcatggcttcggggtgctgcctctccctccctgtttgaatctgcagattgtgttaggcccccagctgagggcctggagtggtgggattggtcccagtgcctggcgcacattggcctgcagagtagattaactgaatgaccaaagagcaacagaagtctagtgattcttgtctttgaggttctgactggtgttttacaactgagtccaaggcttttccctcctttgtccctctgacacccctccccctaattctcatctgtcagatccagtgtattcctaagctgggacaaagcctctgttttcccagtaggagccagggctgagtgtggaaattacagtgactgcttcttctcagcttctctggttgaaagcaagctggcgaagtaagaggaggtagagttgagaaggtgtggaagatagggacagctgcccccagaactcccttcaagggaggacttccccagctatgggaagtgccatcagggtggccgcagctgcagagagccacttcacctgagaccacgcccttcctggggcagcctgtatctggtgtctgagtgaggcatggtataaacacctggtcatttcaatccaacatgggacggacactgacagacagtactcccagcaggcccaggccagccagggcttcgtcaggcctgcagcacaatttgacttcctatgcccaggcctgcttcctcttcttcctcttcttttcacaggtgcttattcctaataaacatcttgcaacccaaa

SEQ ID NO: 186374 - DNA, 3587 bp, Homo sapiens
  Payload ID: 16702
  Gene Symbol: SOX13
  Gene Name: SRY (sex determining region Y)-box 13
  Uniprot ID: Q9UN79
  ENST ID: ENST00000367204
  CDS Start-End: 110-1978
ggcatgtgagcgggaagcctaggctgccagccgcgaggaccgcacggaggaggagcaggagcgcggagccgcgagccccgagccccgagcccggcgcctggctgagtagatgtccatgaggagccccatctctgcccagctggccctggatggcgttggcaccatggtgaactgcaccatcaagtcagaggagaagaaagagccttgccacgaggccccccagggctcagccactgccgctgaacctcagcctggagacccagcccgggcctcccaggatagtgctgacccccaagctccagcccaggggaatttcaggggctcctgggactgtagctctccagagggtaatgggtccccagaacccaagagaccaggagtgtcggaggctgcctctggaagccaggagaagctggacttcaaccgaaatttgaaagaagtggtgccagccatagagaagctgttgtccagtgactggaaggagaggtttctaggaaggaactctatggaagccaaagatgtcaaagggacccaagagagcctagcagagaaggagctccagcttctggtcatgattcaccagctgtccaccctgcgggaccagctcctgacagcccactcggagcagaagaacatggctgccatgctgtttgagaagcagcagcagcagatggagcttgcccggcagcagcaggagcagattgcaaagcagcagcagcagctgattcagcagcagcataagatcaacctccttcagcagcagatccagcaggttaacatgccttatgtcatgatcccagccttccccccaagccaccaacctctgcctgtcacccctgactcccagctggccttacccattcagcccattccctgcaaaccagtggagtatccgctgcagctgctgcacagcccccctgccccagtggtgaagaggcctggggccatggccacccaccaccccctgcaggagccctcccagcccctgaacctcacagccaagcccaaggcccccgagctgcccaacacctccagctccccaagcctgaagatgagcagctgtgtgccccgcccccccagccatggaggccccacgcgggacctgcagtccagccccccgagcctgcctctgggcttccttggtgaaggggacgctgtcaccaaagccatccaggatgctcggcagctgctgcacagccacagtggggccttggatggctcccccaacacccccttccgtaaggacctcatcagcctggactcatccccagccaaggagcggctggaggacggctgtgtgcacccactggaggaagccatgctgagctgcgacatggatggctcccgccacttccccgagtcccgaaacagcagccacatcaagaggcccatgaacgccttcatggtgtgggccaaggatgagcggaggaagatcctgcaagccttcccagacatgcacaactccagcatcagcaagatccttggatctcgctggaagtccatgaccaaccaggagaagcagccctactatgaggaacaggcgcggctgagccggcagcacctggagaagtatcctgactacaagtacaagccgcggcccaagcgcacctgcatcgtggagggcaagcggctgcgcgtgggagagtacaaggccctgatgaggacccggcgtcaggatgcccgccagagctacgtgatccccccgcaggctggccaggtgcagatgagctcctcagatgtcctgtaccctcgggcagcaggcatgccgctggcacagccactggtggagcactatgtccctcgtagcctggaccccaacatgcctgtgatcgtcaacacctgcagcctcagagaggagggtgagggcacagatgacaggcactcggtggctgatggcgagatgtaccggtacagcgaggacgaggactcggagggcgaagagaagagcgatggggagttggtggtgctcacagactgatcccggctgggtgggcctggccccttctcctctggggaagaccttgtcccaactcgatgggcacagccagccaacctaagactatgttggtacttggacttgttcgtgccccagagatgggcaaagctgtgcacttgcagatacattcatgaggggagaggcgccctcccttcctgaggagctgttggcctgggtgggcaggaactgcagtatggccatgggctgagcaggctgagcacctcagcctttagggcttatggccaggggacactgtatgactctcctctcctgcaggtgtctatccacctggggtatggcatctaccgacctgtctccctggggtcacatgctttgtttccattcttgtcctggctggaccagccactgtgggaccaacacccctcccacactcccccagactgctcgtctatcaccaggatcgctttgtactttgtgcaaaagggtctggctgtcccttgctgttttcatctctgccaagcctattgtgcctctggctgctgtatgtgtgcgcgtgcacgtgtgtgtgtttcatctgttcattcactgcacaagatatttattgagtgcccactacgtgccaggcactgttgctgagttcctgtgggtgtgtctctcgatgccactcctgcttctctgggggcctctttctgtgcttctctttgtccccaaattgctacctctttgtcagtctgggtgtctcaggttctgtgtgtccttgtgtgcatttctgtctctctctgtcctcgtctctctgcaaggccctctatttctctctttcttggtgtctgtcctttgccccctgtgccctctggattctctgggtctatgtaggcccctggtctgccctgggctcatcagccttcctgacctcctcctgccctccccttcactccctccctggctctgccagtcggttcccacggagccatttttagctctgatcagcatgggaatgtgcctcggcctccaaggggctttgtcctggtgcccccgcccctggtcccaacctgatcccacgagggagttgggacaggaggattgatggtgctccccttcctgccagcgtcagaggccctggagaggggctgtccatggcagctggtctttattcctccctcatgagcacagggtcgggggggtccccattcttggaagaggttgagaagactcctgggcttcagcctctcccacccagccctgcccctcacctgcctgccctcccctcccccactctatactagggactggatctcagcctctgatcagtttcacaaagtttgttccctaaggaaatcaaatcccattgtcacctaactctgaagatctaaatagcccttggatcagtatgggaaccccaaatcccacagggccagatgtggagtctgtgtctgcccccgtcttctctccatcctcaaagcccccacttctctccaggctgtttctttttttatgactgtaaacatagatagtgctttattttgttaataataagataatgatgagtaacttaaccagcacatttctcctgtttacactcgggggatttttttgttttctgatgacataataaagacagatcatttcagaa

SEQ ID NO: 186375 - DNA, 538 bp, Homo sapiens
  Payload ID: 16702
  Gene Symbol: SOX13
  Gene Name: SRY (sex determining region Y)-box 13
  ENST ID: ENST00000525442
  CDS Start-End: 366-538
acgcgggtcgagcttagggtgcacccccaacccgctcctcgccgaccgcagaggactaggtctttctcatcagcccgactatgcgcctagtttaaggatttctcagcgggaagccgaagcgacctgcgcgcgtcctgcgtggggctcaggtgcctgcgacgaggcgcagagctcctccaccatggttgcgtggggtgctgggggacagacgcgctccccttgccacggtttcagggtcgttccccagcggaccagaccagcgcggcatcctgtttgttttctgctccggctgctcctgtcccacccccacccccaccgcaggctgcttcttgctacccccacctcccgccctgggatatcgtaggatgtccatgaggagccccatctctgcccagctggccctggatggcgttggcaccatggtgaactgcaccatcaagtcagaggagaagaaagagccttgccacgaggccccccagggctcagccactgccgctgaacctcagcctggagacccagcccgggcctcccaggatag

SEQ ID NO: 186376 - DNA, 699 bp, Homo sapiens
  Payload ID: 16702
  Gene Symbol: SOX13
  Gene Name: SRY (sex determining region Y)-box 13
  ENST ID: ENST00000480326
  CDS Start-End: 1-386
ggacccaagagagcctagcagagaaggagctccagcttctggtcatgattcaccagctgtccaccctgcgggaccagctcctgacagcccactcggagcagaagaacatggctgccatgctgtttgagaagcagcagcagcagatggagcttgcccggcagcagcaggagcagattgcaaagcagcagcagcagctgattcagcagcagcataagatcaacctccttcagcagcagatccagcaggttaacatgccttatgtcatgatcccagccttccccccaagccaccaacctctgcctgtcacccctgactcccagctggccttacccattcagcccattccctgcaaaccaggacttttctccttgctgccttttccatagtggagtatccgctgcagctgctgcacagcccccctgccccagtggtgaagaggcctggggccatggccacccaccaccccctgcaggagccctcccagcccctgaacctcacagccaagcccaaggcccccgagctgcccaacacctccagctccccaagcctgaagatgagcagctgtgtgccccgcccccccagccatggaggccccacgcgggacctgcagtccagccccccgagcctgcctctgggcttccttggtgaaggggacgctgtcaccaaagccatccaggatgctcggcagctgctgcacag

SEQ ID NO: 186377 - DNA, 597 bp, Homo sapiens
  Payload ID: 16702
  Gene Symbol: SOX13
  Gene Name: SRY (sex determining region Y)-box 13
  ENST ID: ENST00000528591
  CDS Start-End: 59-597
agaactgttgggaggctaatggctgatgatgtctgcggcagcagtgctccatgaatggatgtccatgaggagccccatctctgcccagctggccctggatggcgttggcaccatggtgaactgcaccatcaagtcagaggagaagaaagagccttgccacgaggccccccagggctcagccactgccgctgaacctcagcctggagacccagcccgggcctcccaggatagtgctgacccccaagctccagcccaggggaatttcaggggctcctgggactgtagctctccagagggtaatgggtccccagaacccaagagaccaggagtgtcggaggctgcctctggaagccaggagaagctggacttcaaccgaaatttgaaagaagtggtgccagccatagagaagctgttgtccagtgactggaaggagaggtttctaggaaggaactctatggaagccaaagatgtcaaagggacccaagagagcctagcagagaaggagctccagcttctggtcatgattcaccagctgtccaccctgcgggaccagctcctgacagcccactcggagcagaagaacatggctgccatgct

SEQ ID NO: 186378 - DNA, 3476 bp, Homo sapiens
  Payload ID: 16702
  Gene Symbol: SOX13
  Gene Name: SRY (sex determining region Y)-box 13
  Uniprot ID: Q9UN79
  ENST ID: ENST00000618875
  CDS Start-End: 1-1869
atgtccatgaggagccccatctctgcccagctggccctggatggcgttggcaccatggtgaactgcaccatcaagtcagaggagaagaaagagccttgccacgaggccccccagggctcagccactgccgctgaacctcagcctggagacccagcccgggcctcccaggatagtgctgacccccaagctccagcccaggggaatttcaggggctcctgggactgtagctctccagagggtaatgggtccccagaacccaagagaccaggagtgtcggaggctgcctctggaagccaggagaagctggacttcaaccgaaatttgaaagaagtggtgccagccatagagaagctgttgtccagtgactggaaggagaggtttctaggaaggaactctatggaagccaaagatgtcaaagggacccaagagagcctagcagagaaggagctccagcttctggtcatgattcaccagctgtccaccctgcgggaccagctcctgacagcccactcggagcagaagaacatggctgccatgctgtttgagaagcagcagcagcagatggagcttgcccggcagcagcaggagcagattgcaaagcagcagcagcagctgattcagcagcagcataagatcaacctccttcagcagcagatccagcaggttaacatgccttatgtcatgatcccagccttccccccaagccaccaacctctgcctgtcacccctgactcccagctggccttacccattcagcccattccctgcaaaccagtggagtatccgctgcagctgctgcacagcccccctgccccagtggtgaagaggcctggggccatggccacccaccaccccctgcaggagccctcccagcccctgaacctcacagccaagcccaaggcccccgagctgcccaacacctccagctccccaagcctgaagatgagcagctgtgtgccccgcccccccagccatggaggccccacgcgggacctgcagtccagccccccgagcctgcctctgggcttccttggtgaaggggacgctgtcaccaaagccatccaggatgctcggcagctgctgcacagccacagtggggccttggatggctcccccaacacccccttccgtaaggacctcatcagcctggactcatccccagccaaggagcggctggaggacggctgtgtgcacccactggaggaagccatgctgagctgcgacatggatggctcccgccacttccccgagtcccgaaacagcagccacatcaagaggcccatgaacgccttcatggtgtgggccaaggatgagcggaggaagatcctgcaagccttcccagacatgcacaactccagcatcagcaagatccttggatctcgctggaagtccatgaccaaccaggagaagcagccctactatgaggaacaggcgcggctgagccggcagcacctggagaagtatcctgactacaagtacaagccgcggcccaagcgcacctgcatcgtggagggcaagcggctgcgcgtgggagagtacaaggccctgatgaggacccggcgtcaggatgcccgccagagctacgtgatccccccgcaggctggccaggtgcagatgagctcctcagatgtcctgtaccctcgggcagcaggcatgccgctggcacagccactggtggagcactatgtccctcgtagcctggaccccaacatgcctgtgatcgtcaacacctgcagcctcagagaggagggtgagggcacagatgacaggcactcggtggctgatggcgagatgtaccggtacagcgaggacgaggactcggagggcgaagagaagagcgatggggagttggtggtgctcacagactgatcccggctgggtgggcctggccccttctcctctggggaagaccttgtcccaactcgatgggcacagccagccaacctaagactatgttggtacttggacttgttcgtgccccagagatgggcaaagctgtgcacttgcagatacattcatgaggggagaggcgccctcccttcctgaggagctgttggcctgggtgggcaggaactgcagtatggccatgggctgagcaggctgagcacctcagcctttagggcttatggccaggggacactgtatgactctcctctcctgcaggtgtctatccacctggggtatggcatctaccgacctgtctccctggggtcacatgctttgtttccattcttgtcctggctggaccagccactgtgggaccaacacccctcccacactcccccagactgctcgtctatcaccaggatcgctttgtactttgtgcaaaagggtctggctgtcccttgctgttttcatctctgccaagcctattgtgcctctggctgctgtatgtgtgcgcgtgcacgtgtgtgtgtttcatctgttcattcactgcacaagatatttattgagtgcccactacgtgccaggcactgttgctgagttcctgtgggtgtgtctctcgatgccactcctgcttctctgggggcctctttctgtgcttctctttgtccccaaattgctacctctttgtcagtctgggtgtctcaggttctgtgtgtccttgtgtgcatttctgtctctctctgtcctcgtctctctgcaaggccctctatttctctctttcttggtgtctgtcctttgccccctgtgccctctggattctctgggtctatgtaggcccctggtctgccctgggctcatcagccttcctgacctcctcctgccctccccttcactccctccctggctctgccagtcggttcccacggagccatttttagctctgatcagcatgggaatgtgcctcggcctccaaggggctttgtcctggtgcccccgcccctggtcccaacctgatcccacgagggagttgggacaggaggattgatggtgctccccttcctgccagcgtcagaggccctggagaggggctgtccatggcagctggtctttattcctccctcatgagcacagggtcgggggggtccccattcttggaagaggttgagaagactcctgggcttcagcctctcccacccagccctgcccctcacctgcctgccctcccctcccccactctatactagggactggatctcagcctctgatcagtttcacaaagtttgttccctaaggaaatcaaatcccattgtcacctaactctgaagatctaaatagcccttggatcagtatgggaaccccaaatcccacagggccagatgtggagtctgtgtctgcccccgtcttctctccatcctcaaagcccccacttctctccaggctgtttctttttttatgactgtaaacatagatagtgctttattttgttaataataagataatgatgagtaacttaaccagcacatttctcctgtttacactcgggggatttttttgttttctgatgacataataaagacagatcatttcag

SEQ ID NO: 186379 - DNA, 2055 bp, Homo sapiens
  Payload ID: 16703
  Gene Symbol: SOX14
  Gene Name: SRY (sex determining region Y)-box 14
  Uniprot ID: O95416
  ENST ID: ENST00000306087
  CDS Start-End: 502-1224
gcttttggctctcgttcaccagcctccccgcattctcagccaggtgcagcgctaggcgcggcagctccgggaaagccacgggaagggggagccacgactggaaacgcaagaggagagaagggaactagagaaggcaaaggtggagagggggagaaggaggagcttcttgccctggctaaaaaattacctggccacttaatcccggagactccgatacttgggtcccagcccctggtgcctgaagccccccggccgatcgccctctcctcccccgccctttctgcccccactcgctcccccggggctgcctgggcgctgggactggcatgatcagctgaactttgtggggtcagcgcttctctctggcttcccctcagcggcgccaaggcgaggggagcgcagaaccccggctcaggacggacagacagacggccagccgcgcccaggctcgtctgcagaacccttgcactccctacccccacccacctagccgccgggaccatgtccaaaccttcagaccacatcaagcggcccatgaacgccttcatggtatggtcccggggccagcggcgcaagatggcccaggaaaaccccaagatgcacaactcggagatcagcaaacgcctaggtgccgaatggaagcttctgtccgaggcagagaagcggccatacatcgatgaagccaagcggctacgcgcccagcacatgaaggagcaccctgactacaagtaccgacctcggcgcaagcccaagaacctgctcaagaaggacaggtatgtcttccccttgccctacctgggcgacacggacccgctcaaggcggctggcctgcccgtgggggcctccgacggcctcctgagcgcgcccgagaaagcccgggccttcttgccgccggcctcggcgccctactccctgctggaccccgcgcagtttagctcgagcgccatccagaagatgggcgaagtgccccacaccttggctaccggcgctctgccctacgcgtccaccctgggctaccagaacggcgccttcggcagcctcagctgccccagccagcacacgcacacgcacccgtcccccaccaaccctggctacgtggtgccctgtaactgtaccgcctggtctgcctccaccctgcagccccccgtcgcctacatcctcttcccaggcatgaccaagactggcatagacccttattcgtcagcccacgctacggccatgtaacccccagcccggcccggacctgaggcgtggtctgaaagccgggtctgcaccctgtcctctgagcctagccccggcctgcagacgcctccggggtcagccctgccgctgtcccttacaccacccagacttttcctctctcttccagggggaagggtggggcgtcctcccggacccaaggcgcagacaggtaccggaaacttgcaaacgttatgtcagctacacagctgcccctatcccgactctcccaaaacaaatctccgactgtaccccctttggacaaaaaagtaggcagttttgctttatttatatccccttcactctcctcggataggctttggactctgaactcccagattctgatattatatctacaatatgcatatattttttccttttgtcccctgaagaaaagagttagctgtgtctctgtgttttgccatcagacacaactaggagccatttgctcttcatgtatgggggggaaaggcttcaaagttttaaattacagaaagggaaacatttctatttaaaaccatgctatgatagtgtttgcttctttaaagggaaaacaaaaaggacctacatggttatttactttgtgtaaagcagtgcttctagagatctaagtttacttttagacagaatgtcgggttatgaagtcaggaagtagaaggtgaacaaaaaattaaaagaacaaaaacaacctaaatggtcataaatgttttgacgatgtcttggaaatgtacctagaaggattttacctcgttgctctgttcatttgttgaacaaagacgttttgaataaagacaatctgtcattgtaaaaaagtaa

SEQ ID NO: 186380 - DNA, 1396 bp, Homo sapiens
  Payload ID: 16704
  Gene Symbol: SOX15
  Gene Name: SRY (sex determining region Y)-box 15
  Uniprot ID: O60248
  ENST ID: ENST00000250055
  CDS Start-End: 495-1196
ttaaggaggtgcagtcttatgggagggacaggggcggagtcagtctttaaaagctgttcccaggtctggcccgcctgccacaaacgctgagcccaggtgggagaggtctggcctatccgcgcctggcagctgtcggaactccggagaccacaaaggggtttatggtttaccccctccacggaaggtcggtctgatcgcagctgcgggtcggggagagggaccgggggtcccccagtcagtaggcctcagaacacctcttcagtgccggggcaccagacagcggattttgcattcgactctccccaaagtgtgccgaacaggttggaagcaaaggctccggtttaagctctgggcttggggataaaatacactttttaaggacccaagttcctcggcaacgactccagactgggaagacctttccattttcaggatcgacgcttcacgttgaggggagggcattcaggacgccctcttaaggcttctcccaacccatggcgctaccaggctcctcacaggaccaggcctggagcctggagcctccggctgccacggctgctgcctcctcatcttcgggaccccaggagcgggagggcgctgggagccccgcggcccccgggacgctgcccctggagaaggtgaagcggccgatgaacgcgttcatggtgtggagctccgctcagcgccgccagatggcgcagcagaaccccaagatgcacaactccgagatctccaagcgcctgggcgcgcagtggaagctgctggacgaggacgagaagcggcccttcgtggaggaggccaagcggctccgcgcccgacacctgcgcgactaccccgactacaagtaccggcctcggcgcaaggccaagagctcgggcgccggaccttcccgctgcggacagggaagaggcaacctggccagcggcggcccgctctgggggccggggtacgcgaccacccaaccgagcagaggctttgggtacagaccccccagctactcgacagcctacctgcctggcagctatggctcttcccactgcaaactggaagccccctcaccgtgctccctccctcagagtgaccctaggctccagggggaactgctgcccacctatacccactacctgccccctggctctcccactccatacaaccctccccttgctggtgcccccatgcccctaacccacctctaaccctcatggacgcagacctcacgggacgggcctcatcctccttttttaatccagcagcatcccctaccccaggctgtcaaccctttctcctgttggactacagttcagaggcagcctgcagtcctcccatgatagccagggagagccgcacaacatacaattatatttttggtagtattaaacagttttgtattattcaa

SEQ ID NO: 186381 - DNA, 1050 bp, Homo sapiens
  Payload ID: 16704
  Gene Symbol: SOX15
  Gene Name: SRY (sex determining region Y)-box 15
  Uniprot ID: O60248
  ENST ID: ENST00000538513
  CDS Start-End: 149-850
gggagaggtctggcctatccgcgcctggcagctgtcggaactccggagaccacaaaggggtttatggtttaccccctccacggaaggatcgacgcttcacgttgaggggagggcattcaggacgccctcttaaggcttctcccaacccatggcgctaccaggctcctcacaggaccaggcctggagcctggagcctccggctgccacggctgctgcctcctcatcttcgggaccccaggagcgggagggcgctgggagccccgcggcccccgggacgctgcccctggagaaggtgaagcggccgatgaacgcgttcatggtgtggagctccgctcagcgccgccagatggcgcagcagaaccccaagatgcacaactccgagatctccaagcgcctgggcgcgcagtggaagctgctggacgaggacgagaagcggcccttcgtggaggaggccaagcggctccgcgcccgacacctgcgcgactaccccgactacaagtaccggcctcggcgcaaggccaagagctcgggcgccggaccttcccgctgcggacagggaagaggcaacctggccagcggcggcccgctctgggggccggggtacgcgaccacccaaccgagcagaggctttgggtacagaccccccagctactcgacagcctacctgcctggcagctatggctcttcccactgcaaactggaagccccctcaccgtgctccctccctcagagtgaccctaggctccagggggaactgctgcccacctatacccactacctgccccctggctctcccactccatacaaccctccccttgctggtgcccccatgcccctaacccacctctaaccctcatggacgcagacctcacgggacgggcctcatcctccttttttaatccagcagcatcccctaccccaggctgtcaaccctttctcctgttggactacagttcagaggcagcctgcagtcctcccatgatagccagggagagccgcacaacatacaattatatttttggtagtattaaacagttttgtattattcaa

SEQ ID NO: 186382 - DNA, 1093 bp, Homo sapiens
  Payload ID: 16704
  Gene Symbol: SOX15
  Gene Name: SRY (sex determining region Y)-box 15
  Uniprot ID: O60248
  ENST ID: ENST00000570788
  CDS Start-End: 416-952
acaaacgctgagcccaggtgggagaggtctggcctatccgcgcctggcagctgtcggaactccggagaccacaaaggggtttatggtttaccccctccacggaaggtcggtctgatcgcagctgcgggtcggggagagggaccgggggtcccccagtcagtaggcctcagaacacctcttcagtgccggggcaccagacagcggattttgcattcgactctccccaaagtgtgccgaacaggttggaagcaaaggctccggtttaagctctgggcttggggataaaatacactttttaaggacccaagttcctcggcaacgactccagactgggaagacctttccattttcaggatcgacgcttcacgttgaggggagggcattcaggacgccctcttaaggcttctcccaacccatggcgctaccaggctcctcacaggaccaggcctggagcctggagcctccggctgccacggctgctgcctcctcatcttcgggaccccaggagcgggagggcgctgggagccccgcggcccccgggacgctgcccctggagaaggtgaagcggccgatgaacgcgttcatggtgtggagctccgctcagcgccgccagatggcgcagcagaaccccaagatgcacaactccgagatctccaagcgcctgggcgcgcagtggaagctgctggacgaggacgagaagcggcccttcgtggaggaggccaagcggctccgcgcccgacacctgcgcgactaccccgactacaagtaccggcctcggcgcaaggccaagagctcgggcgccggaccttcccgctgcggacagggaagaggcaacctggccagcggcggcccgctctgggggccggggtacgcgaccacccaaccgagcagaggctttgggtacagaccccccagctactcgacagcctacctgcctggcagctatgggtgagtgcctgggaagcgggccgaagacggaggcccatgcgcccctcttctggagccttggtgggggcggatgccggaggacgggagcccacccaagcagaggccactcgcggccaaggtgtggcgggcgcaggcccagtacctc

SEQ ID NO: 186383 - DNA, 2342 bp, Homo sapiens
  Payload ID: 16705
  Gene Symbol: SOX17
  Gene Name: SRY (sex determining region Y)-box 17
  Uniprot ID: Q9H6I2
  ENST ID: ENST00000297316
  CDS Start-End: 205-1449
gcagtgtcactaggccggctgggggccctgggtacgctgtagaccagaccgcgacaggccagaacacgggcggcggcttcgggccgggagacccgcgcagccctcggggcatctcagtgcctcactccccaccccctcccccgggtcgggggaggcggcgcgtccggcggagggttgaggggagcggggcaggcctggagcgccatgagcagcccggatgcgggatacgccagtgacgaccagagccagacccagagcgcgctgcccgcggtgatggccgggctgggcccctgcccctgggccgagtcgctgagccccatcggggacatgaaggtgaagggcgaggcgccggcgaacagcggagcaccggccggggccgcgggccgagccaagggcgagtcccgtatccggcggccgatgaacgctttcatggtgtgggctaaggacgagcgcaagcggctggcgcagcagaatccagacctgcacaacgccgagttgagcaagatgctgggcaagtcgtggaaggcgctgacgctggcggagaagcggcccttcgtggaggaggcagagcggctgcgcgtgcagcacatgcaggaccaccccaactacaagtaccggccgcggcggcgcaagcaggtgaagcggctgaagcgggtggagggcggcttcctgcacggcctggctgagccgcaggcggccgcgctgggccccgagggcggccgcgtggccatggacggcctgggcctccagttccccgagcagggcttccccgccggcccgccgctgctgcctccgcacatgggcggccactaccgcgactgccagagtctgggcgcgcctccgctcgacggctacccgttgcccacgcccgacacgtccccgctggacggcgtggaccccgacccggctttcttcgccgccccgatgcccggggactgcccggcggccggcacctacagctacgcgcaggtctcggactacgctggccccccggagcctcccgccggtcccatgcacccccgactcggcccagagcccgcgggtccctcgattccgggcctcctggcgccacccagcgcccttcacgtgtactacggcgcgatgggctcgcccggggcgggcggcgggcgcggcttccagatgcagccgcaacaccagcaccagcaccagcaccagcaccaccccccgggccccggacagccgtcgccccctccggaggcactgccctgccgggacggcacggaccccagtcagcccgccgagctcctcggggaggtggaccgcacggaatttgaacagtatctgcacttcgtgtgcaagcctgagatgggcctcccctaccaggggcatgactccggtgtgaatctccccgacagccacggggccatttcctcggtggtgtccgacgccagctccgcggtatattactgcaactatcctgacgtgtgacaggtccctgatccgccccagcctgcaggccagaagcagtgttacacacttcctggaggagctaaggaaatcctcagactcctgggtttttgttgttgctgttgttgttttttaaaaggtgtgttggcatataatttatggtaatttattttgtctgccacttgaacagtttgggggggtgaggtttcatttaaaatttgttcagagatttgtttcccatagttggattgtcaaaaccctatttccaagttcaagttaactagctttgaatgtgtcccaaaacagcttcctccatttcctgaaagtttattgatcaaagaaatgttgtcctgggtgtgttttttcaatcttctaaaaaataaaatctggaatcctgcttttttgctctactagtacctctgtcacactagtcttatcaaaaaccagttcttaagatcaatgttaagtttattagttaatgtaaatttctcatcctcgaaaagggtgaacataaatgcctttaaggagtatatctaaaaataaacattaggatatctaagtttgatgtaattgtttcaggaaggaaaaaagaaaagcattctggaatgagcctacttcaagtaatcttagtttctaaaactaacagttaatattttcaattccagtatatcactttaagtagaaggggatgtccaagtaattttggttttctaactgttgaatcataagcttgacctgcccccagaggctttttggatgtttttatctgtgttttgccatctctttacactcctcgacattcagtttaccttaatcttcacatttttacaccttgggaagtggcaagcatcgctgggtttaagataaaggagtcacaaaaactaatcaaaataaaatttgcattatgacaactt

SEQ ID NO: 186384 - DNA, 1864 bp, Homo sapiens
  Payload ID: 16706
  Gene Symbol: SOX18
  Gene Name: SRY (sex determining region Y)-box 18
  Uniprot ID: P35713
  ENST ID: ENST00000340356
  CDS Start-End: 126-1280
ccaccgccgtccccaccgccatccgccctcccggcctggcctgcccttgcgcccggctccccagtgcccgccgcccgcccgccgcgctcccgcgctccgttccgcccaggccgcgcccagctggaatgcagagatcgccgcccggctacggcgcacaggacgacccgcccgcccgccgcgactgtgcatgggccccgggacacggggccgccgctgacacgcgcggcctcgccgccggccccgccgccctcgccgcgcccgccgcgcccgcctcgccgcccagcccgcagcgcagtcccccgcgcagccccgagccggggcgctatggcctcagcccggccggccgcggggaacgccaggcggcagacgagtcgcgcatccggcggcccatgaacgccttcatggtgtgggcaaaggacgagcgcaagcggctggctcagcagaacccggacctgcacaacgcggtgctcagcaagatgctgggcaaagcgtggaaggagctgaacgcggcggagaagcggcccttcgtggaggaagccgaacggctgcgcgtgcagcacttgcgcgaccaccccaactacaagtaccggccgcgccgcaagaagcaggcgcgcaaggcccggcggctggagcccggcctcctgctcccgggattagcgcccccgcagccaccgcccgagcctttccccgcggcgtctggctcggctcgcgccttccgcgagctgcccccgctgggcgccgagttcgacggcctggggctgcccacgcccgagcgctcgcctctggacggcctggagcccggcgaggctgccttcttcccaccgcccgcggcgcccgaggactgcgcgctgcggcccttccgcgcgccctacgcgcccaccgagttgtcgcgggaccccggcggttgctacggggctcccctggcggaggcgctcaggaccgcgccccccgcggcgccgctcgctggcctgtactacggcaccctgggcacgcccggcccgtaccccggcccgctgtcgccgccgcccgaggccccgccgctggagagcgccgagccgctggggcccgccgccgatctgtgggccgacgtggacctcaccgagttcgaccagtacctcaactgcagccggactcggcccgacgcccccgggctcccgtaccacgtggcactggccaaactgggcccgcgcgccatgtcctgcccagaggagagcagcctgatctccgcgctgtcggacgccagcagcgcggtctattacagcgcgtgcatctccggctaggccgccggcgccgcccgggtccctgcagcgcttcctcccgcagcccccgcgaccgatccgaccgcgtcgctgccgctctgctctctcatacgcgtgtatgtttggttccatgtcacagccccctaggagccagtgatgctcggccttgcgcccgttccacctcccaggccacccttcctgggcttctgggccacctgccctcggggggcccctgcgagggtgcctggagttcccacgtgtcccggggcttttccaggaagcccgagcccaggacctgttggcagagttgccagggttacatttttgaagcacctgctccttttcttgcagtgtattttctacaaccagattgtattaatattttttactttgcccttttaaaaaatatacctaatacaatatatttaatttttaattaaactcttaaacttttcttccaagaagtttcagtgatcagaagcgtcactgtggcaaagacttttgcaatgtgaggaatacagatgtttgctttctataaaggaggagcctggagctgggtccccggacggagaggccacaataaatcctcgggcctttcctctgca

SEQ ID NO: 186385 - DNA, 2513 bp, Homo sapiens
  Payload ID: 16707
  Gene Symbol: SOX2
  Gene Name: SRY (sex determining region Y)-box 2
  Uniprot ID: P48431
  ENST ID: ENST00000325404
  CDS Start-End: 438-1391
ggatggttgtctattaacttgttcaaaaaagtatcaggagttgtcaaggcagagaagagagtgtttgcaaaagggggaaagtagtttgctgcctctttaagactaggactgagagaaagaagaggagagagaaagaaagggagagaagtttgagccccaggcttaagcctttccaaaaaataataataacaatcatcggcggcggcaggatcggccagaggaggagggaagcgctttttttgatcctgattccagtttgcctctctctttttttcccccaaattattcttcgcctgattttcctcgcggagccctgcgctcccgacacccccgcccgcctcccctcctcctctccccccgcccgcgggccccccaaagtcccggccgggccgagggtcggcggccgccggcgggccgggcccgcgcacagcgcccgcatgtacaacatgatggagacggagctgaagccgccgggcccgcagcaaacttcggggggcggcggcggcaactccaccgcggcggcggccggcggcaaccagaaaaacagcccggaccgcgtcaagcggcccatgaatgccttcatggtgtggtcccgcgggcagcggcgcaagatggcccaggagaaccccaagatgcacaactcggagatcagcaagcgcctgggcgccgagtggaaacttttgtcggagacggagaagcggccgttcatcgacgaggctaagcggctgcgagcgctgcacatgaaggagcacccggattataaataccggccccggcggaaaaccaagacgctcatgaagaaggataagtacacgctgcccggcgggctgctggcccccggcggcaatagcatggcgagcggggtcggggtgggcgccggcctgggcgcgggcgtgaaccagcgcatggacagttacgcgcacatgaacggctggagcaacggcagctacagcatgatgcaggaccagctgggctacccgcagcacccgggcctcaatgcgcacggcgcagcgcagatgcagcccatgcaccgctacgacgtgagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatgtgagggccggacagcgaactggaggggggagaaattttcaaagaaaaacgagggaaatgggaggggtgcaaaagaggagagtaagaaacagcatggagaaaacccggtacgctcaaaaagaaaaaggaaaaaaaaaaatcccatcacccacagcaaatgacagctgcaaaagagaacaccaatcccatccacactcacgcaaaaaccgcgatgccgacaagaaaacttttatgagagagatcctggacttctttttgggggactatttttgtacagagaaaacctggggagggtggggagggcgggggaatggaccttgtatagatctggaggaaagaaagctacgaaaaactttttaaaagttctagtggtacggtaggagctttgcaggaagtttgcaaaagtctttaccaataatatttagagctagtctccaagcgacgaaaaaaatgttttaatatttgcaagcaacttttgtacagtatttatcgagataaacatggcaatcaaaatgtccattgtttataagctgagaatttgccaatatttttcaaggagaggcttcttgctgaattttgattctgcagctgaaatttaggacagttgcaaacgtgaaaagaagaaaattattcaaatttggacattttaattgtttaaaaattgtacaaaaggaaaaaattagaataagtactggcgaaccatctctgtggtcttgtttaaaaagggcaaaagttttagactgtactaaattttataacttactgttaaaagcaaaaatggccatgcaggttgacaccgttggtaatttataatagcttttgttcgatcccaactttccattttgttcagataaaaaaaaccatgaaattactgtgtttgaaatattttcttatggtttgtaatatttctgtaaatttattgtgatattttaaggttttcccccctttattttccgtagttgtattttaaaagattcggctctgtattatttgaatcagtctgccgagaatccatgtatatatttgaactaatatcatccttataacaggtacattttcaacttaagtttttactccattatgcacagtttgagataaataaatttttgaaatatggacactgaaa

SEQ ID NO: 186386 - DNA, 2778 bp, Homo sapiens
  Payload ID: 16708
  Gene Symbol: SOX21
  Gene Name: SRY (sex determining region Y)-box 21
  Uniprot ID: Q9Y651
  ENST ID: ENST00000376945
  CDS Start-End: 351-1181
gcccggccgccgctacctgcggggagctcaccagcaaacgccactgcagacgaaggacccaaagaacgtaaagggcaaactgccgccgcggggagggggcaccgccgagaagttagagtgtcccagagacaacctgctcgagcgctcggccggagacactaaggcggcccggggcgcggcgtggccctgggctggtcccccagccccctcctccggggcgggagcgacgccggggcgcgacgagccccggccggccgagcgggtctccgcgggcagccaacattgatttcctccgggccgagggcgagggcccgggaggcggcgggctgcagccgcggcagggcgagagcatgtccaagccggtggaccacgtcaagcggcccatgaacgccttcatggtgtggtcgcgggctcagcggcgcaagatggcccaggagaaccccaagatgcacaactcggagatcagcaagcgcttgggcgccgagtggaaactgctcacagagtcggagaagcggccgttcatcgacgaggccaagcgtctacgcgccatgcacatgaaggagcaccccgactacaagtaccggccgcggcgcaagcccaagacgctgctcaagaaggacaagttcgccttcccggtgccctacggcctgggcggcgtggcggacgccgagcaccctgcgctcaaggcgggcgccgggctgcacgcgggggcgggcggcggcctggtgcctgagtcgctgctcgccaatcccgagaaggcggccgcggccgccgccgctgccgccgcacgcgtcttcttcccgcagtcggccgctgccgccgccgctgccgccgccgccgccgccgcgggcagcccctactcgctgctcgacctgggctccaaaatggcagagatctcgtcgtcctcgtccggcctcccgtacgcgtcgtcgctgggctacccgaccgcgggcgcgggcgccttccacggcgcggcggcggcggctgcagcggcggccgccgccgccggggggcacacgcactcgcaccccagcccgggcaacccgggctacatgatcccgtgcaactgcagcgcgtggcccagccccgggctgcagccgccgctcgcctacatcctgctgccgggcatgggcaagccccagctggacccctaccccgcggcctacgctgccgcgctatgaccccgcggggccgcctcgcgaggaccggtgtgcacacgtgtacatatgtataggtacgagcgctgcggcctccccgtgcgccctcccgcgaccgggggcccggtttgtatgtacatagaatgtataggtgccaggtagaggcagagaggccaggcggggcaggagtggccaagcgcgcaagggcgcgggcgagcaggcctgtgaattcgcaggatcatttcagacccgcacttcggcagccaactcgaaagcaggcggttgtgtgcggcagcagttggcgtttgctttgcacttcggaacctgttgcgttttgacccacggaggtggaggagtaactttttgacatgttggcctttccagttttgttggaagtttcatggtcggttttgtttttgtttctcattcttcttcctcgcccctcagccccccaacccccaaccccctcccggtccgtgttgcatgcacgctgttcaaatgtgaggtctgaaatggctggcacacgggaaaagctgcttgtgtcattcgtttctgggagtgggatggctctgagcagcctcgcctccctgtttgtactatttgaactttgcagatctctgttctctcaagcagaactcccaaccagatccattcttgaccagtgaccggctcgaatctggccttttgtgtgagatgatcacggtttcttttgtttatcacgccatttgcaaatcagagcaagagctctttctcaagggcaagaaacgcaaacaagaaatatttgtgagatgaaagttgtcaattggattttcttcctaaacaaacaacaacaacaaactactagaagtctccctgagtccactcgcttggatttctgacacagtttacaaaaaaggaaaaaggcactgctcctattttcccttatggctgagttcaccttaagattgtaaatgtgtatatgtcagtgaaaacattgaggcttggaaaatgtgttattttcgttgccctaagtttgagtcgactttagactcaaaaacattttgagcgaatatcaaagttaacttttaaaaattgcgaaactatttcagaatcgcaattttatcgaagattaaatcagacttttttgtctggtaattatatatttattatttagcaaaactgaagaaaaaaagcacagaattgtttcaacagatgtctctcattttcagctagcatttctctcccaagttgagctggtttaatgtgttttggatttccctcctcaattggcttattttttagatcacctgcaattcatttgcaaattgcaataaaacacattttagaaaaaaggaaccttcaattattagctttgtttctttttaaatgtatatattttgactaatgtttgtgaatgaagttggctaacatgtatttagtttcattttggctttatgtaatataaagtttttaaaattttaaatatggttttaacctttatgtgtaaatgattttctagtgtgaccttctaatttaatattagacgtctaaggtatatctgtaaattagaatccgactatcactctgttcattttttttgaacaaagagtttaaataaagcctgaaccagggaaaagaaaaa

SEQ ID NO: 186387 - DNA, 2517 bp, Homo sapiens
  Payload ID: 16709
  Gene Symbol: SOX3
  Gene Name: SRY (sex determining region Y)-box 3
  Uniprot ID: P41225
  ENST ID: ENST00000370536
  CDS Start-End: 444-1784
tggccgggggatggggcgccggtctgccttgacagggttgcaaagttgttttctaaattccgaaggcgcccctctgccccctccccccaatctgcttgcgtgccccctcccccctccccccgtcacctcctcaggtttcgttctttcaaactttttgaaaccctaattggtggcctctgagtgggcctcgtggactcccgcctcctaagtaactcttaccacgtcactaggccaaagaggggcgtggggtgaacgaaagggctccccgaacttttttttttccagccaggccgaacgggggctcggtaatgattggccagggcgcatcactgcgaacctgtcaatcacgggtcctccgggttgcgaggggcggaccaagccccaaccccggggaatccgagcaggtatataaggggcccagctagagcccaggcagactgtgaatgcgacctgttcgagagaactcatcaggtgcgagaagcccgcgggttcctgctgatttggcgcggagcattttgataagcctacccttcccgccggactcgctggcccacaggcccccaagctccgctccgacggagtcccagggccttttcaccgtggccgctccagccccgggagcgccttctcctcccgccacgctggcgcaccttcttcccgccccggcaatgtacagccttctggagactgaactcaagaaccccgtagggacacccacacaagcggcgggcaccggcggccccgcagccccgggaggcgcaggcaagagtagtgcgaacgcagccggcggcgcgaactcgggcggcggcagcagcggtggtgcgagcggaggtggcgggggtacagaccaggaccgtgtgaaacggcccatgaacgccttcatggtatggtcccgcgggcagcggcgcaaaatggccctggagaaccccaagatgcacaattctgagatcagcaagcgcttgggcgccgactggaaactgctgaccgacgccgagaagcgaccattcatcgacgaggccaagcgacttcgcgccgtgcacatgaaggagtatccggactacaagtaccgaccgcgccgcaagaccaagacgctgctcaagaaagataagtactccctgcccagcggcctcctgcctcccggtgccgcggccgccgccgccgctgccgcggccgcagccgctgccgccagcagtccggtgggcgtgggccagcgcctggacacgtacacgcacgtgaacggctgggccaacggcgcgtactcgctggtgcaggagcagctgggctacgcgcagcccccgagcatgagcagcccgccgccgccgcccgcgctgccgccgatgcaccgctacgacatggccggcctgcagtacagcccaatgatgccgcccggcgctcagagctacatgaacgtcgctgccgcggccgccgccgcctcgggctacgggggcatggcgccctcagccacagcagccgcggccgccgcctacgggcagcagcccgccaccgccgcggccgcagctgcggccgcagccgccatgagcctgggccccatgggctcggtagtgaagtctgagcccagctcgccgccgcccgccatcgcatcgcactctcagcgcgcgtgcctcggcgacctgcgcgacatgatcagcatgtacctgccacccggcggggacgcggccgacgccgcctctccgctgcccggcggtcgcctgcacggcgtgcaccagcactaccagggcgccgggactgcagtcaacggaacggtgccgctgacccacatctgagcaccggcctgcgctcgtccacccttgttccccacccccacccccactcccgccccgcacccccaagttgggacgccttgtttagctttgcttgcctgggactgttgccttgtaccgatgatggggagggctgaaagttttgctgtagctgtcgggttttgtacaaaagcaaaaataagtcaggagcagcgaaaatgggacttctagagagctctcttgccccacgccgctgctcctttcacctttgtaggctgggaatcgctgtgttatttgcaaagaaaaaacagcccccactcctcctcctgagttccagggttattctgttacatttgaaaatgttgtcttgttagtttgcagttagccaaggagtgaatgggagaaacatagtatcgggtgaggccagctggagaactgcaacgcctacgcccccagtcgtgtcgcgtctgttttcctcgtggttttttggggcgctgaccgctccaagcagcgcggcagctaaagccaatgttaatttatagccaggtgtgcgtgtgtctcccgcctcgccgcccctggccgcgggacagcttctgtccaatcatgttgagttggtgatttctgccgtgatctgtttgatatttcttcgcgctaatgtgttcagatttcgtttgggtagtggggaggggctactttgtttcagggttttcaagcttttactcttaattcctaaatgagatcaataaattttataacc

SEQ ID NO: 186388 - DNA, 3265 bp, Homo sapiens
  Payload ID: 16710
  Gene Symbol: SOX30
  Gene Name: SRY (sex determining region Y)-box 30
  Uniprot ID: O94993
  ENST ID: ENST00000265007
  CDS Start-End: 343-2604
gggggagggatgactaaagacaacggctgtaagagaactccacaagagagtcagaacgaaaatgtgcaacaagtgcggcggctcctaccatggcaggtgattcgaggactcagcacgaggcgagagtagggaccaggaagagccggaaaacccgcctgtgattggccgtccacgggtatcggtcgttgtgattgggtgaggcccagacagacagctgcgttttgaaccgcgtagggttctgggtagcaaaggccttgcaaggctcttaaccgaaagggggagggggaaggtcgccaacaaacggctgagctcacaatcctggccggggcgtccccctcccccatggagagagccagacccgagccgccgcctcagccgcgcccgttgcgtcccgctccgcccccgctgccggtcgagggcacctccttttgggcagcagccatggagccccctccgtcgtctcccacactgagcgcggcagccagtgcgaccttggcctcgtcgtgcggggaggcagtggcgtccggcttacagcccgcggtgcggcggctgctgcaggtgaagccagagcaggtgttgctgctaccacagcctcaggcccagaacgaggaagccgctgcctcgtccgcgcaggcgcggctgttgcagttcaggcccgacctgcggctcctgcagccgccgacagcgtcagacggcgccacctccaggcccgagttgcacccggtgcagcccctggcgctgcatgtcaaggccaagaagcagaagctggggcccagcctggatcagtcagtggggcctcgaggggccgtcgaaaccggtcctagagcctccagggtggtcaagttggaaggccccgggccggccctcggctacttccgaggggacgagaagggcaagctggaggcggaggaggtcatgagagactcgatgcaaggcggggcaggcaaaagcccggcagccatccgagaaggtgtgatcaaaacggaggaacccgagagactcctcgaggactgcaggctcggcgcggagcccgcgtccaatggcctggttcatggcagcgcggaggtcatcttggccccaacgtccggtgcctttgggccgcaccagcaagaccttaggatccctttgacgctccacacggtcccccctggggcccggatccagtttcagggagctccgccttcagagctgataagattgaccaaggtccccctgacaccagtgcctactaaaatgcagtccctactggagccttctgtaaaaattgaaaccaaagatgtcccgctcaccgtgttgccctcagatgcaggcataccagatactcccttcagtaaggacagaaatggtcatgtgaagcgacccatgaacgcatttatggtttgggcaaggatccaccgaccagcactagccaaagctaacccagcagccaacaatgcagaaatcagtgtccagcttgggttagagtggaacaaacttagtgaagaacaaaagaaaccctattacgatgaagcacaaaagattaaggaaaagcacagagaggaatttcctggttgggtttatcagcctcgtccagggaagcgaaaacgattccctctaagtgtttccaatgtattttctggtaccacacagaatatcatctctacaaatcctacaacagtttatccttaccgctcacctacgtactctgtggtaattcccagcctacagaatcccatcactcatccagttggtgaaacctcacctgctatccagctgcccacacctgcagtccagagcccaagccctgtcacacttttccagcccagcgtctccagtgctgctcaggtggctgtccaggatccaagtctacctgtctatccagcactcccaccccaacgctttactgggccttcccaaacagacactcatcagctgcattctgaagccactcacactgtgaagcaacccactcctgtctctctagagagcgccaacaggatttcaagtagtgcaagtactgcccatgccagatttgcaacttcgaccatccaacctcctagggagtattccagcgtttccccttgtcccagaagtgctccaatcccccaggcttctcccattccacacccacatgtctaccagccccctccccttggccatccagccacactgttcgggacaccaccaagattctcttttcatcacccttacttcctacccggacctcactacttcccatcaagtacatgcccttacagtcggcctccctttggctatggaaattttccgagttcaatgccagaatgccttagttattatgaagacaggtacccaaaacatgagggtatcttttcaactttaaatagagactattcttttagagactactcaagtgaatgcacacacagtgaaaattctcggagttgtgagaacatgaatggaacttcttactataacagtcatagccacagtggggaagaaaacttaaaccctgtgcctcagctggacattggaaccttggagaatgtcttcacagccccgacatcaactccttctagcatccagcaagtcaatgtcaccgacagtgatgaggaggaagaagaaaaagtgctcagggatttataattttaaaacaaatatgcacagaaaataaacatttcttaaaatatattctgggtcagttggtatgagaaaaaaaaaagcctagaattctttgttgaaagttttcagtcgtgatttgaggagttaaaaccaaatgcaatttatgtcttcataaaattttgattagtgaaactagagtctggatgtttcattgtaggaatatttaagttattaagtagtttaattttaatggctgaaatttgcatcaacatgtattattattactttatcctggaacatgcaaaatactgaagcctcacagttgtatgtgaggggaaaggggaaataaatctagcatagtgtgatttttattttatctcaggatacattttttaaatgattttttgtttgctttttatgtaatacttatggatgttgtcaatttttgatgtaacattttgaaagtattttgacaactcctagtgaacttggacttggttgctaaatttaacttacactaataaccaattataagttccaaatgtgttttaatggcacctgggtgattcttcagctaaatttagtcatttctgtttctaaatatttttatcattttaaaatattttttttccatttggcatacatcgttctttgttgtaattaaataaacatagataaaattgtt

SEQ ID NO: 186389 - DNA, 2716 bp, Homo sapiens
  Payload ID: 16710
  Gene Symbol: SOX30
  Gene Name: SRY (sex determining region Y)-box 30
  Uniprot ID: O94993
  ENST ID: ENST00000311371
  CDS Start-End: 287-1792
cgaaaatgtgcaacaagtgcggcggctcctaccatggcaggtgattcgaggactcagcacgaggcgagagtagggaccaggaagagccggaaaacccgcctgtgattggccgtccacgggtatcggtcgttgtgattgggtgaggcccagacagacagctgcgttttgaaccgcgtagggttctgggtagcaaaggccttgcaaggctcttaaccgaaagggggagggggaaggtcgccaacaaacggctgagctcacaatcctggccggggcgtccccctcccccatggagagagccagacccgagccgccgcctcagccgcgcccgttgcgtcccgctccgcccccgctgccggtcgagggcacctccttttgggcagcagccatggagccccctccgtcgtctcccacactgagcgcggcagccagtgcgaccttggcctcgtcgtgcggggaggcagtggcgtccggcttacagcccgcggtgcggcggctgctgcaggtgaagccagagcaggtgttgctgctaccacagcctcaggcccagaacgaggaagccgctgcctcgtccgcgcaggcgcggctgttgcagttcaggcccgacctgcggctcctgcagccgccgacagcgtcagacggcgccacctccaggcccgagttgcacccggtgcagcccctggcgctgcatgtcaaggccaagaagcagaagctggggcccagcctggatcagtcagtggggcctcgaggggccgtcgaaaccggtcctagagcctccagggtggtcaagttggaaggccccgggccggccctcggctacttccgaggggacgagaagggcaagctggaggcggaggaggtcatgagagactcgatgcaaggcggggcaggcaaaagcccggcagccatccgagaaggtgtgatcaaaacggaggaacccgagagactcctcgaggactgcaggctcggcgcggagcccgcgtccaatggcctggttcatggcagcgcggaggtcatcttggccccaacgtccggtgcctttgggccgcaccagcaagaccttaggatccctttgacgctccacacggtcccccctggggcccggatccagtttcagggagctccgccttcagagctgataagattgaccaaggtccccctgacaccagtgcctactaaaatgcagtccctactggagccttctgtaaaaattgaaaccaaagatgtcccgctcaccgtgttgccctcagatgcaggcataccagatactcccttcagtaaggacagaaatggtcatgtgaagcgacccatgaacgcatttatggtttgggcaaggatccaccgaccagcactagccaaagctaacccagcagccaacaatgcagaaatcagtgtccagcttgggttagagtggaacaaacttagtgaagaacaaaagaaaccctattacgatgaagcacaaaagattaaggaaaagcacagagaggaatttcctggttgggtttatcagcctcgtccagggaagcgaaaacgattccctctaagtgtttccaatgtattttctggtaccacacagaatatcatctctacaaatcctacaacagtttatccttaccgctcacctacgtactctgtggtaattcccagcctacagaatcccatcactcatccagttgtacatgcccttacagtcggcctccctttggctatggaaattttccgagttcaatgccagaatgccttagttattatgaagacaggtacccaaaacatgagggtatcttttcaactttaaatagagactattcttttagagactactcaagtgaatgcacacacagtgaaaattctcggagttgtgagaacatgaatggaacttcttactataacagtcatagccacagtggggaagaaaacttaaaccctgtgcctcagctggacattggaaccttggagaatgtcttcacagccccgacatcaactccttctagcatccagcaagtcaatgtcaccgacagtgatgaggaggaagaagaaaaagtgctcagggatttataattttaaaacaaatatgcacagaaaataaacatttcttaaaatatattctgggtcagttggtatgagaaaaaaaaaagcctagaattctttgttgaaagttttcagtcgtgatttgaggagttaaaaccaaatgcaatttatgtcttcataaaattttgattagtgaaactagagtctggatgtttcattgtaggaatatttaagttattaagtagtttaattttaatggctgaaatttgcatcaacatgtattattattactttatcctggaacatgcaaaatactgaagcctcacagttgtatgtgaggggaaaggggaaataaatctagcatagtgtgatttttattttatctcaggatacattttttaaatgattttttgtttgctttttatgtaatacttatggatgttgtcaatttttgatgtaacattttgaaagtattttgacaactcctagtgaacttggacttggttgctaaatttaacttacactaataaccaattataagttccaaatgtgttttaatggcacctgggtgattcttcagctaaatttagtcatttctgtttctaaatatttttatcattttaaaatattttttttccatttggcatacatcgttctttgttgtaattaaataaacatagataaaattgtt

SEQ ID NO: 186390 - DNA, 1666 bp, Homo sapiens
  Payload ID: 16710
  Gene Symbol: SOX30
  Gene Name: SRY (sex determining region Y)-box 30
  ENST ID: ENST00000519442
  CDS Start-End: 155-1501
atattggctgcggggaaggggacgggggctgttggacatgcgtgcagagtccggcggccacggacgcggtaatattgtccctcggcatccgccgtggtgagacccggcgcgttgctgtgaagacggacgggtctggaagaagtggggtgcggtcatggagaaatgttgtagagggaaggaacaaagtctactgtgcatccagcaaggcataccagatactcccttcagtaaggacagaaatggtcatgtgaagcgacccatgaacgcatttatggtttgggcaaggatccaccgaccagcactagccaaagctaacccagcagccaacaatgcagaaatcagtgtccagcttgggttagagtggaacaaacttagtgaagaacaaaagaaaccctattacgatgaagcacaaaagattaaggaaaagcacagagaggaatttcctggttgggtttatcagcctcgtccagggaagcgaaaacgattccctctaagtgtttccaatgtattttctggtaccacacagaatatcatctctacaaatcctacaacagtttatccttaccgctcacctacgtactctgtggtaattcccagcctacagaatcccatcactcatccagttggtgaaacctcacctgctatccagctgcccacacctgcagtccagagcccaagccctgtcacacttttccagcccagcgtctccagtgctgctcaggtggctgtccaggatccaagtctacctgtctatccagcactcccaccccaacgctttactgggccttcccaaacagacactcatcagctgcattctgaagccactcacactgtgaagcaacccactcctgtctctctagagagcgccaacaggatttcaagtagtgcaagtactgcccatgccagatttgcaacttcgaccatccaacctcctagggagtattccagcgtttccccttgtcccagaagtgctccaatcccccaggcttctcccattccacacccacatgtctaccagccccctccccttggccatccagccacactgttcgggacaccaccaagattctcttttcatcacccttacttcctacccggacctcactacttcccatcaagtacatgcccttacagtcggcctccctttggctatggaaattttccgagttcaatgccagaatgccttagttattatgaagacaggtacccaaaacatgagggtatcttttcaactttaaatagagactattcttttagagactactcaagtgaatgcacacacagtgaaaattctcggagttgtgagaacatgaatggaacttcttactataacagtcatagccacagtggggaagaaaacttaaaccctgtgcctcagctggacattggaaccttggagaatgtcttcacagccccgacatcaactccttctagcatccagcaagtcaatgtcaccgacagtgatgaggaggaagaagaaaaagtgctcagggatttataattttaaaacaaatatgcacagaaaataaacatttcttaaaatatattctgggtcagttggtatgagaaaaaaaaaagcctagaattctttgttgaaagttttcagtcgtgatttgaggagttaaaaccaaatgcaatttatgtcttcataaaattttgattagtg

SEQ ID NO: 186391 - DNA, 5851 bp, Homo sapiens
  Payload ID: 16711
  Gene Symbol: SOX4
  Gene Name: SRY (sex determining region Y)-box 4
  Uniprot ID: Q06945
  ENST ID: ENST00000244745
  CDS Start-End: 1767-3191
agagtgaagcaatctttaattttgaaaacagggaaaacaaatatttagaaagtaaaaccgatttccatcctttacatgccattatacatcctatacaaaactctggaaatctgcctattgaggtaattacggagcactacctaatgtgtttcaagggaaagctcccctgtttgggctatgcaggatttacagggagtttaaatcattaaataaccatagttgacccttgcttggttaagagagtaagcaattattgcaaagtcctcttccctgccttccacaaacagcacaaaaacggttctgaagggatttacacaatacatcaacatctgtgctgtacctagagttgttaaaataattgtgatgacaggtgtctaggtaccactttcttaatggttttcaatatccattgatttattgttttgtggctttctcttcccctttacagctttggctttaagaaagagctggggaacagattttgcaccagaggctgattctttattccaatgctgaaaagaactaataaaaataatcacttggcttttaagcagaaagcttccatttacagtatttcacccttaccccgccccgttccaagccccttgttatctaacataatggttagaatacatttccgtctctccccttaataatttcatgcattaacatcctcttcacacactatacacacacgcacgcgcgcacacacacgcgcgcgcacacacacagcaaaaggaaaaaagaggcagcagaaatctcagctgtacttctagcccttttaaaaagtttgctctgtaaattggaatgaggtcagatttggagcttctcattgcacgcggagattattattgcatcgggttccaagccaatgggaagcccgggggaggggtttggcatgaggaagcgttggttacagcagctgattggctgcagccaagactgtgaaaggataaagaggcgcgaggcggaattggggtctgctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcagggaaaaagaaaaaaaaaaaaaaaagacttgcctgggaggccgcgagaaacttgcattggaagcttcagcaaccagcattcgagaaactcctctctactttagcacggtctccagactcagccgagagacagcaaactgcagcgcggtgagagagcgagagagagggagagagagactctccagcctgggaactataactcctctgcgagaggcggagaactccttccccaaatcttttggggacttttctctctttacccacctccgcccctgcgaggagttgaggggccagttcggccgccgcgcgcgtcttcccgttcggcgtgtgcttggcccggggaaccgggagggcccggcgatcgcgcggcggccgccgcgagggtgtgagcgcgcgtgggcgcccgccgagccgaggccatggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgcctcaagcacatggctgactaccccgactacaagtaccggcccaggaagaaggtgaagtccggcaacgccaactccagctcctcggccgccgcctcctccaagccgggggagaagggagacaaggtcggtggcagtggcgggggcggccatgggggcggcggcggcggcgggagcagcaacgcggggggaggaggcggcggtgcgagtggcggcggcgccaactccaaaccggcgcagaaaaagagctgcggctccaaagtggcgggcggcgcgggcggtggggttagcaaaccgcacgccaagctcatcctggcaggcggcggcggcggcgggaaagcagcggctgccgccgccgcctccttcgccgccgaacaggcgggggccgccgccctgctgcccctgggcgccgccgccgaccaccactcgctgtacaaggcgcggactcccagcgcctcggcctccgcctcctcggcagcctcggcctccgcagcgctcgcggccccgggcaagcacctggcggagaagaaggtgaagcgcgtctacctgttcggcggcctgggcacgtcgtcgtcgcccgtgggcggcgtgggcgcgggagccgaccccagcgaccccctgggcctgtacgaggaggagggcgcgggctgctcgcccgacgcgcccagcctgagcggccgcagcagcgccgcctcgtcccccgccgccggccgctcgcccgccgaccaccgcggctacgccagcctgcgcgccgcctcgcccgccccgtccagcgcgccctcgcacgcgtcctcctcggcctcgtcccactcctcctcttcctcctcctcgggctcctcgtcctccgacgacgagttcgaagacgacctgctcgacctgaaccccagctcaaactttgagagcatgtccctgggcagcttcagttcgtcgtcggcgctcgaccgggacctggattttaacttcgagcccggctccggctcgcacttcgagttcccggactactgcacgcccgaggtgagcgagatgatctcgggagactggctcgagtccagcatctccaacctggttttcacctactgaagggcgcgcaggcagggagaagggccggggggggtaggagaggagaaaaaaaaagtgaaaaaaagaaacgaaaaggacagacgaagagtttaaagagaaaagggaaaaaagaaagaaaaagtaagcagggctggcttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctttttttaaacgcgtgatgaagacagaaggctccggggtgacgaatttggccgatggcagatgttttgggggaacgccgggactgagagactccacgcaggcgaattcccgtttggggcttttttttcctccctcttttccccttgccccctctgcagccggaggaggagatgttgaggggaggaggccagccagtgtgaccggcgctaggaaatgacccgagaaccccgttggaagcgcagcagcgggagctaggggcgggggcggaggaggacacgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattccttataggtgtaaatgagaagacgtgtttttttccttcaccgatgctccatcctcgtatttctttttccttgtaaatgtaatcagatgccattttatatgtggacgtatttatactggccaaacatattttttcttttgtccctttttttctttcctttctttttacttcctttatttctttattccttccttttcctttttttcttttttttttctttttttttttttttttttggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaaccctaaa

SEQ ID NO: 186392 - DNA, 1816 bp, Homo sapiens
  Payload ID: 16712
  Gene Symbol: SOX5
  Gene Name: SRY (sex determining region Y)-box 5
  ENST ID: ENST00000367206
  CDS Start-End: 45-1574
gaccagatgctgcggtgcacggggcagccaccatctctgcatgcatgtctgtgatgtcttccaagcgaccagcctctccgtatggggaagcagatggagaggtagccatggtgacaagcagacagaaagtggaagaagaggagagtgacgggctcccagcctttcaccttcccttgcatgtgagttttcccaacaagcctcactctgaggaatttcagccagtttctctgctgacgcaagagacttgtggccataggactcccacttctcagcacaatacaatggaagttgatggcaataaagttatgtcttcatttgccccacacaactcatctacctcacctcagaaggcagaagaaggtgggcgacagagtggcgagtccttgtctagtacagccctgggaactcctgaacggcgcaagggcagtttagctgatgttgttgacaccttgaagcagaggaaaatggaagagctcatcaaaaacgagccggaagaaacccccagtattgaaaaactactctcaaaggactggaaagacaagcttcttgcaatgggatcggggaactttggcgaaataaaagggactcccgagagcttagctgagaaagaaaggcaactcatgggtatgatcaaccagctgaccagcctccgagagcagctgttggctgcccacgatgagcagaagaaactagctgcctctcagattgagaaacagcgtcagcaaatggagctggccaagcagcaacaagaacaaattgcaagacagcagcagcagcttctacagcaacaacacaaaatcaatttgctccagcaacagatccaggttcaaggtcagctgccgccattaatgattcccgtattccctcctgatcaacggacactggctgcagctgcccagcaaggattcctcctccctccaggcttcagctataaggctggatgtagtgacccttaccctgttcagctgatcccaactaccatggcagctgctgccgcagcaacaccaggcttaggcccactccaactgcagcagttatatgctgcccagctagctgcaatgcaggtatctccaggagggaagctgccaggcataccccaaggcaaccttggtgctgctgtatctcctaccagcattcacacagacaagagcacaaacagcccaccacccaaaagcaaggatgaagtggcacagccactgaacctatcagctaaacccaagacctctgatggcaaatcacccacatcacccacctctccccatatgccagctctgagaataaacagtggggcaggccccctcaaagcctctgtcccagcagcgttagctagtccttcagccagagttagcacaataggttacttaaatgaccatgatgctgtcaccaaggcaatccaagaagctcggcaaatgaaggagcaactccgacgggaacaacaggtgcttgatgggaaggtggctgttgtgaatagtctgggtctcaataactgccgaacagaaaaggaagtgctggagtctcagagtcaagaatttatagggaatcccgagggcgtggtagcaatgaaccccacataaagcgtccaatgaatgccttcatggtgtgggctaaagatgaacggagaaagatccttcaagcctttcctgacatgcacaactccaacatcagcaagatattgggatctcgctggaaagctatgacaaacctagagaaacagccatattatgaggagcaagcccgtctcagcaagcagcacctggagaagtaccctgactataagtacaagcccaggccaaagcgcacctgcctggtggatggc

SEQ ID NO: 186393 - DNA, 3991 bp, Homo sapiens
  Payload ID: 16712
  Gene Symbol: SOX5
  Gene Name: SRY (sex determining region Y)-box 5
  Uniprot ID: P35711
  ENST ID: ENST00000381381
  CDS Start-End: 142-2070
gagaaaatcaattggtttagaaggtttggactcacttgacaggttcagttggagacgatcataggtggctgctgtgacaaagggaaattgtgcttttccagcatgcttactgaccctgatttacctcaggagtttgaaaggatgtcttccaagcgaccagcctctccgtatggggaagcagatggagaggtagccatggtgacaagcagacagaaagtggaagaagaggagagtgacgggctcccagcctttcaccttcccttgcatgtgagttttcccaacaagcctcactctgaggaatttcagccagtttctctgctgacgcaagagacttgtggccataggactcccacttctcagcacaatacaatggaagttgatggcaataaagttatgtcttcatttgccccacacaactcatctacctcacctcagaaggcagaagaaggtgggcgacagagtggcgagtccttgtctagtacagccctgggaactcctgaacggcgcaagggcagtttagctgatgttgttgacaccttgaagcagaggaaaatggaagagctcatcaaaaacgagccggaagaaacccccagtattgaaaaactactctcaaaggactggaaagacaagcttcttgcaatgggatcggggaactttggcgaaataaaagggactcccgagagcttagctgagaaagaaaggcaactcatgggtatgatcaaccagctgaccagcctccgagagcagctgttggctgcccacgatgagcagaagaaactagctgcctctcagattgagaaacagcgtcagcaaatggagctggccaagcagcaacaagaacaaattgcaagacagcagcagcagcttctacagcaacaacacaaaatcaatttgctccagcaacagatccaggttcaaggtcagctgccgccattaatgattcccgtattccctcctgatcaacggacactggctgcagctgcccagcaaggattcctcctccctccaggcttcagctataaggctggatgtagtgacccttaccctgttcagctgatcccaactaccatggcagctgctgccgcagcaacaccaggcttaggcccactccaactgcagcagttatatgctgcccagctagctgcaatgcaggtatctccaggagggaagctgccaggcataccccaaggcaaccttggtgctgctgtatctcctaccagcattcacacagacaagagcacaaacagcccaccacccaaaagcaaggaaaaaacaacactggagagtctgactcagcaactggcagttaaacagaatgaagaaggaaaatttagccatgcaatgatggatttcaatctgagtggagattctgatggaagtgctggagtctcagagtcaagaatttatagggaatcccgagggcgtggtagcaatgaaccccacataaagcgtccaatgaatgccttcatggtgtgggctaaagatgaacggagaaagatccttcaagcctttcctgacatgcacaactccaacatcagcaagatattgggatctcgctggaaagctatgacaaacctagagaaacagccatattatgaggagcaagcccgtctcagcaagcagcacctggagaagtaccctgactataagtacaagcccaggccaaagcgcacctgcctggtggatggcaaaaagctgcgcattggtgaatacaaggcaatcatgcgcaacaggcggcaggaaatgcggcagtacttcaatgttgggcaacaagcacagatccccattgccactgctggtgttgtgtaccctggagccatcgccatggctgggatgccctcccctcacctgccctcggagcactcaagcgtgtctagcagcccagagcctgggatgcctgttatccagagcacttacggtgtgaaaggagaggagccacatatcaaagaagagatacaggccgaggacatcaatggagaaatttatgatgagtacgacgaggaagaggatgatccagatgtagattatgggagtgacagtgaaaaccatattgcaggacaagccaactgataagggtcaaaagattgttgtgaccttaggacttaaagaagccctaactggttcatccttaccagtggccaagcacattaactttctcatacactgactgttactttaactgttagtcttaaatagttgggacatcagctgactaatagacctcagcctcaaaaggcttggaaagaaaaaacaaatacaacaagcaaacaacaatatcaacaacaagagattgaaataagctatgggtaaaataatgccagtaattcagctgctacatccaagcactgaagtcttacccgtcaacttttttttttttttaaataaactttatggctgtttgttctacaatgttctagaaattctcactcaggtacacagtgccaacaagtggcttgtgaatgtgttttgttgttttgtgctacaatttttaaaaagaaaaaagttttgttttgttttttggggtttctgggttttttccttttctttttctttcctttcattttttttctttgtaatgcacctgacagaaaaaaaagaaaaatgaatttctctttacttctctccaccttctccatctctctactttaaagatggaagtctgtgcatgaggggaaagagggaaaaagagcctgtttttaacttccttgctatccaccacaaaataagcaattattttctttagaggactttatctattgcacaccacactacatctttgagcaagtgccaaatttgtactgaagtgttgaccaagttcattttttctctttactttttccttttccttcttaagttaggacagtgttaaatcttagacaatcccttgaaaaacctgaaataccagcagctggtgagatttgacttttttttttaatggaaactgtaggtgctgttctcaggtgaaaagagagagagagagagagacataagaaatttagagaaaaatattttctgatcttggatttttgtgtgtatgtatgtatgtgattatggtactaataataggaataacgttggaccattgtgagttaaacccacatctggggatgaaatcccacatcctcccaagtgactggtctagaaataatcttgaccttgactttgcacttcaaatgacaacttaaccaagtatagggctcagaaattatatttttaaatgtctgattattattggatggatcaggtggccctgtgtaatagaggtgtgcatgtataacatggaagctactagcaaactgctcccagatgtcctttctccctggtcagttggttccattaacgtttgctacttagtgatttttgtttttcctgttgatattttgagcaaaacaatcattgttttcattgaatatatttggccattttttcagacaaatagaattagcttatttcttcaacattccatcctttcccgatcaggaaatgaaactgatgattttataaggtatttttcacccctccatgaagtgaggtggaggcctttagcatttcagaagtgtgggccatatgtagttcatgccataaaaagtaggatttaattaaaagtcattgcagcccaataaaatggagcctggctgcacccagggatccttgccactgctcttcccttgctgtcagattaatccactgaagtccaactttggttcaagcagagtatttgcaaagagcaacaactgaatgtgatgggactgcttatgtagattttgccagccaaatgccaaggcagttgtagggcctgtacaaataaatgcaaaatcatttcaagtcaattgccattatttgtattgaagtatcagatagatagtaaatactgcaactagtagcttgatgtgctatagttttcactccagtcatcattttcctatctcaccccccgaaacaccaccctaaagttggatttttacatataaataaaaaaagaatccctttt

SEQ ID NO: 186394 - DNA, 1379 bp, Homo sapiens
  Payload ID: 16712
  Gene Symbol: SOX5
  Gene Name: SRY (sex determining region Y)-box 5
  Uniprot ID: P35711
  ENST ID: ENST00000396007
  CDS Start-End: 61-1194
aaacagtcagttatagtgggttcaccagactgttggagatttgtgccataggagctgtgcatgcatgatgaagtggcacagccactgaacctatcagctaaacccaagacctctgatggcaaatcacccacatcacccacctctccccatatgccagctctgagaataaacagtggggcaggccccctcaaagcctctgtcccagcagcgttagctagtccttcagccagagttagcacaataggttacttaaatgaccatgatgctgtcaccaaggcaatccaagaagctcggcaaatgaaggagcaactccgacgggaacaacaggtgcttgatgggaaggtggctgttgtgaatagtctgggtctcaataactgccgaacagaaaaggaaaaaacaacactggagagtctgactcagcaactggcagttaaacagaatgaagaaggaaaatttagccatgcaatgatggatttcaatctgagtggagattctgatggaagtgctggagtctcagagtcaagaatttatagggaatcccgagggcgtggtagcaatgaaccccacataaagcgtccaatgaatgccttcatggtgtgggctaaagatgaacggagaaagatccttcaagcctttcctgacatgcacaactccaacatcagcaagatattgggatctcgctggaaagctatgacaaacctagagaaacagccatattatgaggagcaagcccgtctcagcaagcagcacctggagaagtaccctgactataagtacaagcccaggccaaagcgcacctgcctggtggatggcaaaaagctgcgcattggtgaatacaaggcaatcatgcgcaacaggcggcaggaaatgcggcagtacttcaatgttgggcaacaagcacagatccccattgccactgctggtgttgtgtaccctggagccatcgccatggctgggatgccctcccctcacctgccctcggagcactcaagcgtgtctagcagcccagagcctgggatgcctgttatccagagcacttacggtgtgaaaggagaggagccacatatcaaagaagagatacaggccgaggacatcaatggagaaatttatgatgagtacgacgaggaagaggatgatccagatgtagattatgggagtgacagtgaaaaccatattgcaggacaagccaactgataagggtcaaaagattgttgtgaccttaggacttaaagaagccctaactggttcatccttaccagtggccaagcacattaactttctcatacactgactgttactttaactgttagtcttaaatagttgggacatcagctgactaatagacctcagcctcaaaaggcttggaaagaaaaaacaaa

SEQ ID NO: 186395 - DNA, 638 bp, Homo sapiens
  Payload ID: 16712
  Gene Symbol: SOX5
  Gene Name: SRY (sex determining region Y)-box 5
  ENST ID: ENST00000441133
  CDS Start-End: 140-526
gagcgtgcgtgagtgagtgtgtgtgtgtgtgtgtgtgtgtgtgcatgcgtgtgtgaagaatgcacactatctcctgttggttcagttggagacgatcataggtggctgctgtgacaaagggaaattgtgcttttccagcatgcttactgaccctgatttacctcaggagtttgaaaggatgtcttccaagcgaccagcctctccgtatggggaagcagatggagaggtagccatggtgacaagcagacagaaagtggaagaagaggagagtgacgggctcccagcctttcaccttcccttgcatgaagttgatggcaataaagttatgtcttcatttgccccacacaactcatctacctcacctcagaaggcagaagaaggtgggcgacagagtggcgagtccttgtctagtacagccctgggaactcctgaacggcgcaagggcagtttagctgatgttgttgacaccttgaagcagaggaaaatggaagagctcatcaaaaacgagccggaaggctctcattaactttcaagtggaaacaaacaagtattttggcaatactaaacgtaaagtatttccagtgtttaattcacttcaggacaatcacatataaaaataaagcttatctaaatcttaa

SEQ ID NO: 186396 - DNA, 4261 bp, Homo sapiens
  Payload ID: 16712
  Gene Symbol: SOX5
  Gene Name: SRY (sex determining region Y)-box 5
  Uniprot ID: P35711
  ENST ID: ENST00000451604
  CDS Start-End: 103-2394
gagaaaatcaattggtttagaaggtttggactcacttgacaggttcagttggagacgatcataggtggctgctgtgacaaagggaaattgtgcttttccagcatgcttactgaccctgatttacctcaggagtttgaaaggatgtcttccaagcgaccagcctctccgtatggggaagcagatggagaggtagccatggtgacaagcagacagaaagtggaagaagaggagagtgacgggctcccagcctttcaccttcccttgcatgtgagttttcccaacaagcctcactctgaggaatttcagccagtttctctgctgacgcaagagacttgtggccataggactcccacttctcagcacaatacaatggaagttgatggcaataaagttatgtcttcatttgccccacacaactcatctacctcacctcagaaggcagaagaaggtgggcgacagagtggcgagtccttgtctagtacagccctgggaactcctgaacggcgcaagggcagtttagctgatgttgttgacaccttgaagcagaggaaaatggaagagctcatcaaaaacgagccggaagaaacccccagtattgaaaaactactctcaaaggactggaaagacaagcttcttgcaatgggatcggggaactttggcgaaataaaagggactcccgagagcttagctgagaaagaaaggcaactcatgggtatgatcaaccagctgaccagcctccgagagcagctgttggctgcccacgatgagcagaagaaactagctgcctctcagattgagaaacagcgtcagcaaatggagctggccaagcagcaacaagaacaaattgcaagacagcagcagcagcttctacagcaacaacacaaaatcaatttgctccagcaacagatccaggttcaaggtcagctgccgccattaatgattcccgtattccctcctgatcaacggacactggctgcagctgcccagcaaggattcctcctccctccaggcttcagctataaggctggatgtagtgacccttaccctgttcagctgatcccaactaccatggcagctgctgccgcagcaacaccaggcttaggcccactccaactgcagcagttatatgctgcccagctagctgcaatgcaggtatctccaggagggaagctgccaggcataccccaaggcaaccttggtgctgctgtatctcctaccagcattcacacagacaagagcacaaacagcccaccacccaaaagcaaggatgaagtggcacagccactgaacctatcagctaaacccaagacctctgatggcaaatcacccacatcacccacctctccccatatgccagctctgagaataaacagtggggcaggccccctcaaagcctctgtcccagcagcgttagctagtccttcagccagagttagcacaataggttacttaaatgaccatgatgctgtcaccaaggcaatccaagaagctcggcaaatgaaggagcaactccgacgggaacaacaggtgcttgatgggaaggtggctgttgtgaatagtctgggtctcaataactgccgaacagaaaaggaaaaaacaacactggagagtctgactcagcaactggcagttaaacagaatgaagaaggaaaatttagccatgcaatgatggatttcaatctgagtggagattctgatggaagtgctggagtctcagagtcaagaatttatagggaatcccgagggcgtggtagcaatgaaccccacataaagcgtccaatgaatgccttcatggtgtgggctaaagatgaacggagaaagatccttcaagcctttcctgacatgcacaactccaacatcagcaagatattgggatctcgctggaaagctatgacaaacctagagaaacagccatattatgaggagcaagcccgtctcagcaagcagcacctggagaagtaccctgactataagtacaagcccaggccaaagcgcacctgcctggtggatggcaaaaagctgcgcattggtgaatacaaggcaatcatgcgcaacaggcggcaggaaatgcggcagtacttcaatgttgggcaacaagcacagatccccattgccactgctggtgttgtgtaccctggagccatcgccatggctgggatgccctcccctcacctgccctcggagcactcaagcgtgtctagcagcccagagcctgggatgcctgttatccagagcacttacggtgtgaaaggagaggagccacatatcaaagaagagatacaggccgaggacatcaatggagaaatttatgatgagtacgacgaggaagaggatgatccagatgtagattatgggagtgacagtgaaaaccatattgcaggacaagccaactgataagggtcaaaagattgttgtgaccttaggacttaaagaagccctaactggttcatccttaccagtggccaagcacattaactttctcatacactgactgttactttaactgttagtcttaaatagttgggacatcagctgactaatagacctcagcctcaaaaggcttggaaagaaaaaacaaatacaacaagcaaacaacaatatcaacaacaagagattgaaataagctatgggtaaaataatgccagtaattcagctgctacatccaagcactgaagtcttacccgtcaacttttttttttttttaaataaactttatggctgtttgttctacaatgttctagaaattctcactcaggtacacagtgccaacaagtggcttgtgaatgtgttttgttgttttgtgctacaatttttaaaaagaaaaaagttttgttttgttttttggggtttctgggttttttccttttctttttctttcctttcattttttttctttgtaatgcacctgacagaaaaaaaagaaaaatgaatttctctttacttctctccaccttctccatctctctactttaaagatggaagtctgtgcatgaggggaaagagggaaaaagagcctgtttttaacttccttgctatccaccacaaaataagcaattattttctttagaggactttatctattgcacaccacactacatctttgagcaagtgccaaatttgtactgaagtgttgaccaagttcattttttctctttactttttccttttccttcttaagttaggacagtgttaaatcttagacaatcccttgaaaaacctgaaataccagcagctggtgagatttgacttttttttttaatggaaactgtaggtgctgttctcaggtgaaaagagagagagagagagagacataagaaatttagagaaaaatattttctgatcttggatttttgtgtgtatgtatgtatgtgattatggtactaataataggaataacgttggaccattgtgagttaaacccacatctggggatgaaatcccacatcctcccaagtgactggtctagaaataatcttgaccttgactttgcacttcaaatgacaacttaaccaagtatagggctcagaaattatatttttaaatgtctgattattattggatggatcaggtggccctgtgtaatagaggtgtgcatgtataacatggaagctactagcaaactgctcccagatgtcctttctccctggtcagttggttccattaacgtttgctacttagtgatttttgtttttcctgttgatattttgagcaaaacaatcattgttttcattgaatatatttggccattttttcagacaaatagaattagcttatttcttcaacattccatcctttcccgatcaggaaatgaaactgatgattttataaggtatttttcacccctccatgaagtgaggtggaggcctttagcatttcagaagtgtgggccatatgtagttcatgccataaaaagtaggatttaattaaaagtcattgcagcccaataaaatggagcctggctgcacccagggatccttgccactgctcttcccttgctgtcagattaatccactgaagtccaactttggttcaagcagagtatttgcaaagagcaacaactgaatgtgatgggactgcttatgtagattttgccagccaaatgccaaggcagttgtagggcctgtacaaataaatgcaaaatcatttcaagtcaattgccattatttgtattgaagtatcagatagatagtaaatactgcaactagtagcttgatgtgctatagttttcactccagtcatcattttcctatctcaccccccg

SEQ ID NO: 186397 - DNA, 6975 bp, Homo sapiens
  Payload ID: 16712
  Gene Symbol: SOX5
  Gene Name: SRY (sex determining region Y)-box 5
  Uniprot ID: P35711
  ENST ID: ENST00000546136
  CDS Start-End: 4-2256
aggatgtcttccaagcgaccagcctctccgtatggggaagcagatggagaggtagccatggtgacaagcagacagaaagtggaagaagaggagagtgacgggctcccagcctttcaccttcccttgcatgtgagttttcccaacaagcctcactctgaggaatttcagccagtttctctgctgacgcaagagacttgtggccataggactcccacttctcagcacaatacaatggaagttgatggcaataaagttatgtcttcatttgccccacacaactcatctacctcacctcagaaggcagaagaaggtgggcgacagagtggcgagtccttgtctagtacagccctgggaactcctgaacggcgcaagggcagtttagctgatgttgttgacaccttgaagcagaggaaaatggaagagctcatcaaaaacgagccggaagaaacccccagtattgaaaaactactctcaaaggactggaaagacaagcttcttgcaatgggatcggggaactttggcgaaataaaagggactcccgagagcttagctgagaaagaaaggcaactcatgggtatgatcaaccagctgaccagcctccgagagcagctgttggctgcccacgatgagcagaagaaactagctgcctctcagattgagaaacagcgtcagcaaatggagctggccaagcagcaacaagaacaaattgcaagacagcagcagcagcttctacagcaacaacacaaaatcaatttgctccagcaacagatccaggttcaaggtcagctgccgccattaatgattcccgtattccctcctgatcaacggacactggctgcagctgcccagcaaggattcctcctccctccaggcttcagctataaggctggatgtagtgacccttaccctgttcagctgatcccaactaccatggcagctgctgccgcagcaacaccaggcttaggcccactccaactgcagcagttatatgctgcccagctagctgcaatgcaggtatctccaggagggaagctgccaggcataccccaaggcaaccttggtgctgctgtatctcctaccagcattcacacagacaagagcacaaacagcccaccacccaaaagcaaggatgaagtggcacagccactgaacctatcagctaaacccaagacctctgatggcaaatcacccacatcacccacctctccccatatgccagctctgagaataaacagtggggcaggccccctcaaagcctctgtcccagcagcgttagctagtccttcagccagagttagcacaataggttacttaaatgaccatgatgctgtcaccaaggcaatccaagaagctcggcaaatgaaggagcaactccgacgggaacaacaggtgcttgatgggaaggtggctgttgtgaatagtctgggtctcaataactgccgaacagaaaaggaaaaaacaacactggagagtctgactcagcaactggcagttaaacagaatgaagaaggaaaatttagccatgcaatgatggatttcaatctgagtggagattctgatggaagtgctggagtctcagagtcaagaatttatagggaatcccgagggcgtggtagcaatgaaccccacataaagcgtccaatgaatgccttcatggtgtgggctaaagatgaacggagaaagatccttcaagcctttcctgacatgcacaactccaacatcagcaagatattgggatctcgctggaaagctatgacaaacctagagaaacagccatattatgaggagcaagcccgtctcagcaagcagcacctggagaagtaccctgactataagtacaagcccaggccaaagcgcacctgcctggtggatggcaaaaagctgcgcattggtgaatacaaggcaatcatgcgcaacaggcggcaggaaatgcggcagtacttcaatgttgggcaacaagcacagatccccattgccactgctggtgttgtgtaccctggagccatcgccatggctgggatgccctcccctcacctgccctcggagcactcaagcgtgtctagcagcccagagcctgggatgcctgttatccagagcacttacggtgtgaaaggagaggagccacatatcaaagaagagatacaggccgaggacatcaatggagaaatttatgatgagtacgacgaggaagaggatgatccagatgtagattatgggagtgacagtgaaaaccatattgcaggacaagccaactgataagggtcaaaagattgttgtgaccttaggacttaaagaagccctaactggttcatccttaccagtggccaagcacattaactttctcatacactgactgttactttaactgttagtcttaaatagttgggacatcagctgactaatagacctcagcctcaaaaggcttggaaagaaaaaacaaatacaacaagcaaacaacaatatcaacaacaagagattgaaataagctatgggtaaaataatgccagtaattcagctgctacatccaagcactgaagtcttacccgtcaacttttttttttttttaaataaactttatggctgtttgttctacaatgttctagaaattctcactcaggtacacagtgccaacaagtggcttgtgaatgtgttttgttgttttgtgctacaatttttaaaaagaaaaaagttttgttttgttttttggggtttctgggttttttccttttctttttctttcctttcattttttttctttgtaatgcacctgacagaaaaaaaagaaaaatgaatttctctttacttctctccaccttctccatctctctactttaaagatggaagtctgtgcatgaggggaaagagggaaaaagagcctgtttttaacttccttgctatccaccacaaaataagcaattattttctttagaggactttatctattgcacaccacactacatctttgagcaagtgccaaatttgtactgaagtgttgaccaagttcattttttctctttactttttccttttccttcttaagttaggacagtgttaaatcttagacaatcccttgaaaaacctgaaataccagcagctggtgagatttgacttttttttttaatggaaactgtaggtgctgttctcaggtgaaaagagagagagagagagagacataagaaatttagagaaaaatattttctgatcttggatttttgtgtgtatgtatgtatgtgattatggtactaataataggaataacgttggaccattgtgagttaaacccacatctggggatgaaatcccacatcctcccaagtgactggtctagaaataatcttgaccttgactttgcacttcaaatgacaacttaaccaagtatagggctcagaaattatatttttaaatgtctgattattattggatggatcaggtggccctgtgtaatagaggtgtgcatgtataacatggaagctactagcaaactgctcccagatgtcctttctccctggtcagttggttccattaacgtttgctacttagtgatttttgtttttcctgttgatattttgagcaaaacaatcattgttttcattgaatatatttggccattttttcagacaaatagaattagcttatttcttcaacattccatcctttcccgatcaggaaatgaaactgatgattttataaggtatttttcacccctccatgaagtgaggtggaggcctttagcatttcagaagtgtgggccatatgtagttcatgccataaaaagtaggatttaattaaaagtcattgcagcccaataaaatggagcctggctgcacccagggatccttgccactgctcttcccttgctgtcagattaatccactgaagtccaactttggttcaagcagagtatttgcaaagagcaacaactgaatgtgatgggactgcttatgtagattttgccagccaaatgccaaggcagttgtagggcctgtacaaataaatgcaaaatcatttcaagtcaattgccattatttgtattgaagtatcagatagatagtaaatactgcaactagtagcttgatgtgctatagttttcactccagtcatcattttcctatctcaccccccgaaacaccaccctaaagttggatttttacatataaataaaaaaagaatcccttttatttttctctctctcagaagacttgctctggggttttgcttggaggagctgatcatatcctgcatgtcagagatttcattttgtttgtttttctgtttgtttgtttttgatgactttatttacatttgaactgcctctttttgctagtgttgtaatgatgatgatgataaaataataataataatagtaataataataataatggtcagctgttcccagattagtaagttatgtataatttattttatttctccctttctattttattctgctctgatttggaagtgcagccaataagctgttagatatttaaaacaaatttccatctccaactcatatatgtatgtatatgtatatatatatatacatatatatacacacatatacacacacacacacacatttacccacaattttacttctctttccgtaagttttctcttttttaagaattttggccccaacaatatcagttctgatgtttaaaacaaaggagtgaattaataggagggtcgtgttcaatcttaattaacttatgctctcatcactcattttagttatttaattgccacagtcatctagagccaatttttttttgtttttgtttgttttgtttttaagcactctggataaggaaaaaatagacacttgtttttatatcatttttatgtacaatgtgaaaacagatttttaaaaaatttgttctctgtctttgttaacaaattccttccgatttatgtgggttcacctctcacgtttgctggatacttactttacaccatgttatgaaagatgctttgttttcatttcatgagtttgggctacaagaatactttgttttagctccaggtagatgccattgaaggcattcatggctgaaatcaattctaacacacttaccgatgaattgacaacactttggtgtttggtcttttttttgttatattttgttttatttgaaggggaaaacaaaattgttaatggtgacttttaactgctgaaattcaaaatttgattttagttaggtttatgtccgagactaaactgtgcatgaaccgaaacaaaaagcaagttcataccgctgcattctgttctcttgttctgacggttaattcactggacatcaaattttctttgccctagttttccccaaaagaaaacaaaagcaaaaatagttatattaatgttgaaagtgctttgaagtcacttgataaaaggtgctatgaatagcaacttactgtgttactacattgcctttttggcattggttgatttataattttggtaaaggatcctaaaaccctgtattctttttctgtgccccataatgaccaaaaaagataaagaaaatgagagtaagatcaaaagatcaaactaaaacataaacagtctccttcctgtctgctttcttacctatctgttcacactttatctctttccctttctctctctctctcacatgcgcgcgcgcgcgcgcgcacacacacacacacacacacttgccccaacactgagaaataatcttgccagaattctggtttttatagttgttgtagtccgtttctctaaaaatagtcctgttttcatatgaatctaagagaacattaccggagaaaataaagttactcatttatagttactaataataagttagtgattaacttaccacaattggataaaatataaaactattcttcagcacatttatacctaaattagtgaagtccatttgtgaagttcatttggcatctgcagttaagagttaaccatgtataaaatccctcccaaagaacataatcatcgttagaaccaaatcctcttataaagaacaaatataaaaaagttttctgtggtgaagctattttatagatttgatttccggagtagaattttaccttaattcacttaaagaaaattaaccattttttggtccaacttcagatattttcttaatccagaagctgtgactgttcccagaagaaacctcttatatcacatttaaaacataaaaaataattacactttcactcattctaatgggtaaattgttgaattgtaataaacaactgtatatttacaaacaggtttataaggtatttgtctatcaaattaataataaaataaaacttacggggtctgcaaggaaaactatgaaggccacttaaagtggttcaggtatccctttgtcttgtagggcatagctgttggtttagccaggcttttacagtatttaattttaaagtatcctataactatcaacttcccaggttgaagacgatgtgttgagtttcctactgattgattgattcctgtcctccccagtgtttccgtcactggttcactaaaacagtatttatatagctccactggctctaaagctcttagtccttctaatattttggattttacaagtaaaaatggaaaaaaaatagaaaagagacaatcaaatgcctggagcttaaaacaaagtatgtgcaacctaccatctcacttgaaatttaataaaataataagtaattatgtaaatataacatagagttatagatttatattttgttcataacacatagtgtaatataagttgtatattttcatgtttttggttttatgttatcattcatgccacaataaaaataaaacaggagtttatgtgctcttaaaaaaaagatgtgggttgccaccaacctgtttttcgtttttgttttttgtttattttattttatttttttgcattctcctttttcagtattactgccatgcaaggcaccaataaaaacagcaaatgtgttctttactta

SEQ ID NO: 186398 - DNA, 2769 bp, Homo sapiens
  Payload ID: 16712
  Gene Symbol: SOX5
  Gene Name: SRY (sex determining region Y)-box 5
  ENST ID: ENST00000537393
  CDS Start-End: 47-2233
gatcataggtggctgctgtgacaaagggaaattgtgcttttccagcatgcttactgaccctgatttacctcaggagtttgaaaggatgtcttccaagcgaccagcctctccgtatggggaagcagatggagaggtagccatggtgacaagcagacagaaagtggaagaagaggagagtgacgggctcccagcctttcaccttcccttgcatgaagttgatggcaataaagttatgtcttcatttgccccacacaactcatctacctcacctcagaaggcagaagaaggtgggcgacagagtggcgagtccttgtctagtacagccctgggaactcctgaacggcgcaagggcagtttagctgatgttgttgacaccttgaagcagaggaaaatggaagagctcatcaaaaacgagccggaagaaacccccagtattgaaaaactactctcaaaggactggaaagacaagcttcttgcaatgggatcggggaactttggcgaaataaaagggactcccgagagcttagctgagaaagaaaggcaactcatgggtatgatcaaccagctgaccagcctccgagagcagctgttggctgcccacgatgagcagaagaaactagctgcctctcagattgagaaacagcgtcagcaaatggagctggccaagcagcaacaagaacaaattgcaagacagcagcagcagcttctacagcaacaacacaaaatcaatttgctccagcaacagatccaggttcaaggtcagctgccgccattaatgattcccgtattccctcctgatcaacggacactggctgcagctgcccagcaaggattcctcctccctccaggcttcagctataaggctggatgtagtgacccttaccctgttcagctgatcccaactaccatggcagctgctgccgcagcaacaccaggcttaggcccactccaactgcagcagttatatgctgcccagctagctgcaatgcaggtatctccaggagggaagctgccaggcataccccaaggcaaccttggtgctgctgtatctcctaccagcattcacacagacaagagcacaaacagcccaccacccaaaagcaaggatgaagtggcacagccactgaacctatcagctaaacccaagacctctgatggcaaatcacccacatcacccacctctccccatatgccagctctgagaataaacagtggggcaggccccctcaaagcctctgtcccagcagcgttagctagtccttcagccagagttagcacaataggttacttaaatgaccatgatgctgtcaccaaggcaatccaagaagctcggcaaatgaaggagcaactccgacgggaacaacaggtgcttgatgggaaggtggctgttgtgaatagtctgggtctcaataactgccgaacagaaaaggaaaaaacaacactggagagtctgactcagcaactggcagttaaacagaatgaagaaggaaaatttagccatgcaatgatggatttcaatctgagtggagattctgatggaagtgctggagtctcagagtcaagaatttatagggaatcccgagggcgtggtagcaatgaaccccacataaagcgtccaatgaatgccttcatggtgtgggctaaagatgaacggagaaagatccttcaagcctttcctgacatgcacaactccaacatcagcaagatattgggatctcgctggaaagctatgacaaacctagagaaacagccatattatgaggagcaagcccgtctcagcaagcagcacctggagaagtaccctgactataagtacaagcccaggccaaagcgcacctgcctggtggatggcaaaaagctgcgcattggtgaatacaaggcaatcatgcgcaacaggcggcaggaaatgcggcagtacttcaatgttgggcaacaagcacagatccccattgccactgctggtgttgtgtaccctggagccatcgccatggctgggatgccctcccctcacctgccctcggagcactcaagcgtgtctagcagcccagagcctgggatgcctgttatccagagcacttacggtgtgaaaggagaggagccacatatcaaagaagagatacaggccgaggacatcaatggagaaatttatgatgagtacgacgaggaagaggatgatccagatgtagattatgggagtgacagtgaaaaccatattgcaggacaagccaactgataagggtcaaaagattgttgtgaccttaggacttaaagaagccctaactggttcatccttaccagtggccaagcacattaactttctcatacactgactgttactttaactgttagtcttaaatagttgggacatcagctgactaatagacctcagcctcaaaaggcttggaaagaaaaaacaaatacaacaagcaaacaacaatatcaacaacaagagattgaaataagctatgggtaaaataatgccagtaattcagctgctacatccaagcactgaagtcttacccgtcaacttttttttttttttaaataaactttatggctgtttgttctacaatgttctagaaattctcactcaggtacacagtgccaacaagtggcttgtgaatgtgttttgttgttttgtgctacaatttttaaaaagaaaaaagttttgttttgttttttggggtttctgggttttttccttttctttttctttcctttcattttttttctttgtaatgcacctgacagaaaaaaaagaaaaatgaa

SEQ ID NO: 186399 - DNA, 617 bp, Homo sapiens
  Payload ID: 16712
  Gene Symbol: SOX5
  Gene Name: SRY (sex determining region Y)-box 5
  ENST ID: ENST00000538083
  CDS Start-End: 184-617
ttcagtatccttttcccttggatcctgggagtaaaacctcagcagtactccctccctttgccagcctgaggagtcagagactcaaagttgttcccagctcttgcgccttcattgtagagctgcattctgctcagtgggctgccgagaaggaccagaccgaaacaagatttagaagaattctggatgtcttccaagcgaccagcctctccgtatggggaagcagatggagaggtagccatggtgacaagcagacagaaagtggaagaagaggagagtgacgggctcccagcctttcaccttcccttgcatgtgagttttcccaacaagcctcactctgaggaatttcagccagtttctctgctgacgcaagagacttgtggccataggactcccacttctcagcacaatacaatggaagttgatggcaataaagttatgtcttcatttgccccacacaactcatctacctcacctcagaaggcagaagaaggtgggcgacagagtggcgagtccttgtctagtacagccctgggaactcctgaacggcgcaagggcagtttagctgatgttgttgacaccttgaagcagaggaaaatggaagagctcatcaaaaacga

SEQ ID NO: 186400 - DNA, 2365 bp, Homo sapiens
  Payload ID: 16712
  Gene Symbol: SOX5
  Gene Name: SRY (sex determining region Y)-box 5
  Uniprot ID: P35711
  ENST ID: ENST00000541536
  CDS Start-End: 5-1933
caggatgtcttccaagcgaccagcctctccgtatggggaagcagatggagaggtagccatggtgacaagcagacagaaagtggaagaagaggagagtgacgggctcccagcctttcaccttcccttgcatgtgagttttcccaacaagcctcactctgaggaatttcagccagtttctctgctgacgcaagagacttgtggccataggactcccacttctcagcacaatacaatggaagttgatggcaataaagttatgtcttcatttgccccacacaactcatctacctcacctcagaaggcagaagaaggtgggcgacagagtggcgagtccttgtctagtacagccctgggaactcctgaacggcgcaagggcagtttagctgatgttgttgacaccttgaagcagaggaaaatggaagagctcatcaaaaacgagccggaagaaacccccagtattgaaaaactactctcaaaggactggaaagacaagcttcttgcaatgggatcggggaactttggcgaaataaaagggactcccgagagcttagctgagaaagaaaggcaactcatgggtatgatcaaccagctgaccagcctccgagagcagctgttggctgcccacgatgagcagaagaaactagctgcctctcagattgagaaacagcgtcagcaaatggagctggccaagcagcaacaagaacaaattgcaagacagcagcagcagcttctacagcaacaacacaaaatcaatttgctccagcaacagatccaggttcaaggtcagctgccgccattaatgattcccgtattccctcctgatcaacggacactggctgcagctgcccagcaaggattcctcctccctccaggcttcagctataaggctggatgtagtgacccttaccctgttcagctgatcccaactaccatggcagctgctgccgcagcaacaccaggcttaggcccactccaactgcagcagttatatgctgcccagctagctgcaatgcaggtatctccaggagggaagctgccaggcataccccaaggcaaccttggtgctgctgtatctcctaccagcattcacacagacaagagcacaaacagcccaccacccaaaagcaaggaaaaaacaacactggagagtctgactcagcaactggcagttaaacagaatgaagaaggaaaatttagccatgcaatgatggatttcaatctgagtggagattctgatggaagtgctggagtctcagagtcaagaatttatagggaatcccgagggcgtggtagcaatgaaccccacataaagcgtccaatgaatgccttcatggtgtgggctaaagatgaacggagaaagatccttcaagcctttcctgacatgcacaactccaacatcagcaagatattgggatctcgctggaaagctatgacaaacctagagaaacagccatattatgaggagcaagcccgtctcagcaagcagcacctggagaagtaccctgactataagtacaagcccaggccaaagcgcacctgcctggtggatggcaaaaagctgcgcattggtgaatacaaggcaatcatgcgcaacaggcggcaggaaatgcggcagtacttcaatgttgggcaacaagcacagatccccattgccactgctggtgttgtgtaccctggagccatcgccatggctgggatgccctcccctcacctgccctcggagcactcaagcgtgtctagcagcccagagcctgggatgcctgttatccagagcacttacggtgtgaaaggagaggagccacatatcaaagaagagatacaggccgaggacatcaatggagaaatttatgatgagtacgacgaggaagaggatgatccagatgtagattatgggagtgacagtgaaaaccatattgcaggacaagccaactgataagggtcaaaagattgttgtgaccttaggacttaaagaagccctaactggttcatccttaccagtggccaagcacattaactttctcatacactgactgttactttaactgttagtcttaaatagttgggacatcagctgactaatagacctcagcctcaaaaggcttggaaagaaaaaacaaatacaacaagcaaacaacaatatcaacaacaagagattgaaataagctatgggtaaaataatgccagtaattcagctgctacatccaagcactgaagtcttacccgtcaacttttttttttttttaaataaactttatggctgtttgttctacaatgttctagaaattctcactcaggtacacagtgccaacaagtggcttgtgaatgtgttttgttgttttgtgctacaatttttaaaaagaaaaaa

SEQ ID NO: 186401 - DNA, 758 bp, Homo sapiens
  Payload ID: 16712
  Gene Symbol: SOX5
  Gene Name: SRY (sex determining region Y)-box 5
  ENST ID: ENST00000541847
  CDS Start-End: 32-757
ggtgcacggggcagccaccatctctgcatgcatgtctgtgatgtcttccaagcgaccagcctctccgtatggggaagcagatggagaggtagccatggtgacaagcagacagaaagtggaagaagaggagagtgacgggctcccagcctttcaccttcccttgcatgtgagttttcccaacaagcctcactctgaggaatttcagccagtttctctgctgacgcaagagacttgtggccataggactcccacttctcagcacaatacaatggaagttgatggcaataaagttatgtcttcatttgccccacacaactcatctacctcacctcagaaggcagaagaaggtgggcgacagagtggcgagtccttgtctagtacagccctgggaactcctgaacggcgcaagggcagtttagctgatgttgttgacaccttgaagcagaggaaaatggaagagctcatcaaaaacgagccggaagaaacccccagtattgaaaaactactctcaaaggactggaaagacaagcttcttgcaatgggatcggggaactttggcgaaataaaagggactcccgagagcttagctgagaaagaaaggcaactcatgggtatgatcaaccagctgaccagcctccgagagcagctgttggctgcccacgatgagcagaagaaactagctgcctctcagattgagaaacagcgtcagcaaatggagctggccaagcagcaacaagaacaagtgagtaagaactagc

SEQ ID NO: 186402 - DNA, 2589 bp, Homo sapiens
  Payload ID: 16712
  Gene Symbol: SOX5
  Gene Name: SRY (sex determining region Y)-box 5
  Uniprot ID: P35711
  ENST ID: ENST00000545921
  CDS Start-End: 157-2418
agtaggagtggagagcgtgcgtgagtgagtgtgtgtgtgtgtgtgtgtgtgtgtgcatgcgtgtgtgaagaatgcacactatctcctgttggtaagtgtgtgcttactccctgaccagatgctgcggtgcacggggcagccaccatctctgcatgcatgtctgtgatgtcttccaagcgaccagcctctccgtatggggaagcagatggagaggtagccatggtgacaagcagacagaaagtggaagaagaggagagtgacgggctcccagcctttcaccttcccttgcatgtgagttttcccaacaagcctcactctgaggaatttcagccagtttctctgctgacgcaagagacttgtggccataggactcccacttctcagcacaatacaatggaagttgatggcaataaagttatgtcttcatttgccccacacaactcatctacctcacctcagaaggcagaagaaggtgggcgacagagtggcgagtccttgtctagtacagccctgggaactcctgaacggcgcaagggcagtttagctgatgttgttgacaccttgaagcagaggaaaatggaagagctcatcaaaaacgagccggaagaaacccccagtattgaaaaactactctcaaaggactggaaagacaagcttcttgcaatgggatcggggaactttggcgaaataaaagggactcccgagagcttagctgagaaagaaaggcaactcatgggtatgatcaaccagctgaccagcctccgagagcagctgttggctgcccacgatgagcagaagaaactagctgcctctcagattgagaaacagcgtcagcaaatggagctggccaagcagcaacaagaacaaattgcaagacagcagcagcagcttctacagcaacaacacaaaatcaatttgctccagcaacagatccaggttcaaggtcagctgccgccattaatgattcccgtattccctcctgatcaacggacactggctgcagctgcccagcaaggattcctcctccctccaggcttcagctataaggctggatgtagtgacccttaccctgttcagctgatcccaactaccatggcagctgctgccgcagcaacaccaggcttaggcccactccaactgcagcagttatatgctgcccagctagctgcaatgcaggtatctccaggagggaagctgccaggcataccccaaggcaaccttggtgctgctgtatctcctaccagcattcacacagacaagagcacaaacagcccaccacccaaaagcaaggatgaagtggcacagccactgaacctatcagctaaacccaagacctctgatggcaaatcacccacatcacccacctctccccatatgccagctctgagaataaacagtggggcaggccccctcaaagcctctgtcccagcagcgttagctagtccttcagccagagttagcacaataggttacttaaatgaccatgatgctgtcaccaaggcaatccaagaagctcggcaaatgaaggagcaactccgacgggaacaacaggtgcttgatgggaaggtggctgttgtgaatagtctgggtctcaataactgccgaacagaaaaggaaaaaacaacactggagagtctgactcagcaactggcagttaaacagaatgaagaaggaaaatttagccatgcaatgatggatttcaatctgagtggagattctgatggaagtgctggagtctcagagtcaagaatttatagggaatcccgagggcgtggtagcaatgaaccccacataaagcgtccaatgaatgccttcatggtgtgggctaaagatgaacggagaaagatccttcaagcctttcctgacatgcacaactccaacatcagcaagatattgggatctcgctggaaagctatgacaaacctagagaaacagccatattatgaggagcaagcccgtctcagcaagcagcacctggagaagtaccctgactataagtacaagcccaggccaaagcgcacctgcctggtggatggcaaaaagctgcgcattggtgaatacaaggcaatcatgcgcaacaggcggcaggaaatgcggcagtacttcaatgttgggcaacaagcacagatccccattgccactgctggtgttgtgtaccctggagccatcgccatggctgggatgccctcccctcacctgccctcggagcactcaagcgtgtctagcagcccagagcctgggatgcctgttatccagagcacttacggtgtgaaaggagaggagccacatatcaaagaagagatacaggccgaggacatcaatggagaaatttatgatgagtacgacgaggaagaggatgatccagatgtagattatgggagtgacagtgaaaaccatattgcaggacaagccaactgataagggtcaaaagattgttgtgaccttaggacttaaagaagccctaactggttcatccttaccagtggccaagcacattaactttctcatacactgactgttactttaactgttagtcttaaatagttgggacatcagctgactaatagacctcagcctcaaaaggcttgg

SEQ ID NO: 186403 - DNA, 8808 bp, Homo sapiens
  Payload ID: 16713
  Gene Symbol: SOX6
  Gene Name: SRY (sex determining region Y)-box 6
  Uniprot ID: P35712
  ENST ID: ENST00000316399
  CDS Start-End: 22-2448
ctgttttttttctgcagaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggattcctcctgcatggaaaaactactttcaaaagattggaaggaaaaaatggaaagactaaataccagtgaacttcttggagaaattaaaggtacacctgagagcctggcagaaaaagaacggcagctctccaccatgattacccagctgatcagtttacgggagcagctactggcagcgcatgatgaacagaaaaaactggcagcgtcacaaattgagaaacaacggcagcaaatggaccttgctcgccaacagcaagaacagattgcgagacaacagcagcaacttctgcaacagcagcacaaaattaatctcctgcagcaacagatccaggttcagggtcacatgcctccgctcatgatcccaatttttccacatgaccagcggactctggcagcagctgctgctgcccaacagggattcctcttcccccctggaataacatacaaaccaggtgataactaccccgtacagttcattccatcaacaatggcagctgctgctgcttctggactcagccctttacagctccagaagggtcatgtctcccacccacaaattaaccaaaggctaaagggcctaagtgaccgttttggcaggaatttggacacctttgaacatggtggtggccactcttacaaccacaaacagattgagcagctctatgccgctcagctggccagcatgcaggtgtcacctggagcaaagatgccatcaactccacagccaccaaacacagcagggacggtctcacctactgggataaaaaatgaaaagagagggaccagccctgtaactcaagttaaggatgaagcagcagcacagcctctgaatctctcatcccgacccaagacagcagagcctgtaaagtccccaacgtctcccacccagaacctcttcccagccagcaaaaccagccctgtcaatctgccaaacaaaagcagcatccctagccccattggaggaagcctgggaagaggatcctctttagatatcctatctagtctcaactcccctgccctttttggggatcaggatacagtgatgaaagccattcaggaggcgcggaagatgcgagagcagatccagcgggagcaacagcagcaacagccacatggtgttgacgggaaactgtcctccataaataatatggggctgaacagctgcaggaatgaaaaggaaagaacgcgctttgagaatttggggccccagttaacgggaaagtcaaatgaagatggaaaactgggcccaggtgtcatcgaccttactcggccagaagatgcagagggaggtgccactgtggctgaagcacgagtctacagggacgcccgcggccgtgccagcagcgagccacacattaagcgaccaatgaatgcattcatggtttgggcaaaggatgagaggagaaaaatccttcaggccttccccgacatgcataactccaacattagcaaaatcttaggatctcgctggaaatcaatgtccaaccaggagaagcaaccttattatgaagagcaggcccggctaagcaagatccacttagagaagtacccaaactataaatacaaaccccgaccgaaacgcacctgcattgttgatggcaaaaagcttcggattggggagtataagcaactgatgaggtctcggagacaggagatgaggcagttctttactgtggggcaacagcctcagattccaatcaccacaggaacaggtgttgtgtatcctggtgctatcactatggcaactaccacaccatcgcctcagatgacatctgactgctctagcacctcggccagcccggagcccagcctcccggtcatccagagcacttatggtatgaagacagatggcggaagcctagctggaaatgaaatgatcaatggagaggatgaaatggaaatgtatgatgactatgaagatgaccccaaatcagactatagcagtgaaaatgaagccccggaggctgtcagtgccaactgaggagtttttgtttgctgaattaaagtactctgacatttcacccccctccccaacaaagagttattaaagagcccgcatgcatttgtggctccacaattacatcagcagaatggtcttaattgtttcgtaaagtgtgagacagattaagttttccctgatttttcatgaacttgagttttttgttgttattgttattgttgttgttgttgtttttttaatttaggtgaagacatattaaatatgagacaccaggacttgaaacttatctcaacccgtagatgtcttacaagtcttatatttttgtcttactttttttttcttttggatgttgataaaggtttaagttactgttttagatggggttaaacattctcactcaggtatgctgtgccggcctacaggttgtgaatgtgtttttattctgaattattttagaaaacaactgaggatttcatattgtgaaacagaacaagtccacggcgtgtgcagctgcatgtagagcatattcaaaaggcctcggaattccaattttccatttgtagagttaaactttgaatgtgccaaactttttcgtaacttttgaatcttaatattttgaaagtcttaaaggagacactgcaaagtcttagacaatctttggcatcttaaaataaaatagcaaaccaacatttttttttccagaaaatggtaaggtactcaggaatctggagacaagatattgtaaggaatgaacaaggttgccacagtgcatggacccaattgtgtttgcctgttgacgtgccatcagtgcgtgatgtggtatgacatacacacaccagagcaaccgccacaccagatatcgacagagtggtcttctctgcctgagaccacctctcactacatccattatccctttgcctttaaccctgacattcagtcttaacacattttatcttaaataatttattcattccagaatgtcaagggtccacttgctatttattttttttcaattgttggtggcattaatttaataattcttgtttttcaccttccttccccgaagaacttttccgtccttttcacctccttctcctgtgtacatagtgattttatgtccccagaacgcctggaagcatttctgaaaccaagatattattaaaaacctattattgtttttaatcatgagtatgtatctggctgcagggctgtgtattgggatataggtatatagtcttacacttaaacaggtatgcccctgaggttcactgtgacctcaagtcttttgccagaattttcccctaattcagttcacaagtggtagggtctgcatcagtggcatttccccctgaattccattcagcagcaaggttcaacagtggtgactgccaggcaggagagtcctgcggccaaacctgaagcccaaggctcgtgggccatgcaggaatctcagtgaagctgtcatgggctggcacctttacactgagttgccttgtcccagctggcacatctagggagttcattgcaaaatccccaggatgcaaaaagccacatgacagcctcagagcaaagatggtggcaaatagtcatgatacatctagagaatgaaagaaaactgtaagggaggagaaggaggggaatacattccctatatgggatgttcctactgttaactctggggaacagatagctccgggggcagcagatgagttcctctggctgactctatctgtagccacatggggacctgcctacgtgtgaacaaaatgaactgcacttatcacacaaggatttctttgaagacatgctactggggtgggaagcagtgaggttttattccccatctcctaactacagggagctctgccatgtcattttggccttcctgaaactaggacaggttgtctatcggggggcttcccccagagaggtttagtgggagaatgtcagtgaatgggatagttcacctcatgggacaacccagaatctgatcaccaggacataggaatggccccatcagatttcttgagccattttgtcacttggaagaaaatagtgtacctttgtatttatttaagagtgctcaaggcctaatagcaataaacaggtctagccaagaaattacaagctattctgttagctgggagtgctctctataagctgattaaggtactgataggaactctttgttattcatgttggttggggattagaaatttgtttttgtacatttatttcaaatgaggaggaggtcattttttctctcaaaaaatgagtatttattattgtcttactgatttctttgattatatacctctcctcctcagttcactcttgttttttttctttctctttggcttttgcttttgctctctctcacttctttcttattttgttgcattggtagagtgttgtatggctagcattgtattgtatgtaattaattttgcacaaaagcaaacatttagcatagtaggttaattttgtttgtttttatgaccatgccaaaataatattctgggctggtggagaacaaaggactgttctttaggactgaaacttgattttgctcatagtaagtaaaaaaaaacaaaaaacacacacactcacagatgttgtttcgtaagtgttataagcactggatataaatggtattttttatcacttctgactaatgtgaaactgttgtacgaaaactacatgaacaaaagtcatctgtttcgactcgtgtgggcttgcctcacagttgccggatttgagtcatttttatgtcttgttatttcatttatttatgcaaaatacatgtgtgtatgaacactttgttttagctccagctctgcctcagtactggggttcatttacttttagccatgttcttaaaaatgaaaggctattcaggaatgatctgattgtaaacgtctttttcattggatcaaacagtaatgctgtatttgaatctaaattttgtgtataagcagtttatttattagccaagtttggctctaaatatccatggaaattaagaatgacaatcatagggatcaattcattttattttcagtggggcttaaacaaagtttatatgactttaccatctcattttagatttttctaattgtgtaaatataacatagaaatagaatttatttttggttcatgaatacttagtgagatataagttatgtatttcctttttgttctctatccatagatgttggtccaaactgaaagttgatgagtcactgtgcctctcggggtagtgagttatcagctacagtgagagagcagtgtttggcctgcagctgggacagcaaaacgtttcaccagggttctcatgcagttcagaacccactgtccacagatccagacatttcccttttttcttacagaaagttgatgattggacatactaaatttccactacagttaggagacagtcagtttgctttgggagtctacataaatcttctaagatagttctgtgaccatttaatagcaagaagcatgaatgccactacaaaggcaaaaatccacctctgagatcggccgttaataaacgtcccgtcatgtcagtttagattcaagaatgttaagcaactttgtttttgcggtgctccctatttcatagtatcttcaaatcaaaaataaaaattatctccattttgttaaagaacttacagggtcagggttctccttgtcacttagaattgggacactgccaggcaatcctctcccaaaaaaaaaaaaaaaaaaaaatagccatatggaatggaaggaaaaggagaaaagaaggaagaaaggaaaaaagtaggaagggagagagaaaaaaaaggtcgctttgcggatacgagccgctaggctgacaacttttctatttcattggcagatatgaagcagtgtcttttccagtaaggtacggaagctttgttgttttcatgtgtacccagctcagccttttagaagcacctcggtttgcttcattaggtatttgatactctccagccttgtcctcaggcctgatttgatttgccagggtcctgacaccaaagcccaggccaagttctaaattcaggtgtgggctcacagtgctattgagcttgtcgaattctggcctcccctgaacattagccccacgggagcctgagggtgtttgaaaagggcgtgatcactctagggctgaaattaaaggctgctttcttttccttctgaagccaggctgcttcttcggagtacaccctcctgagccaggagcacaagcactagcagaaagcagggattgtttcaggaaagcccatttaccctcagtaggaaggcagcctggtcacttgaacagcacagctgaggctgcttctctcaatttactcattttgcaaagaattgacctctaccaactcattagggagaggaaaaagaatcacttagtaattttaaatcatatgagaagtcctgtaccaagtgccaacaactgcaaagaaatgcagctagaggaatgtattgaaattactactgggtcttcctttttaatgagaaaatgacaaaaatggttgctgtagccctgcctgattttgtacacgtttgtctaagaattgagttggcacttaagctcacttctcaaagtataataatattgtatgacctcatttgtcctttcacaaaagcacttgcatcatttccttaagtcatctgctccctgacatgttttcttccctaataaacaacttctgtctgttattcctgccaatgatgttctgtttctgatgccatatcctattgagcgtgcccctgtactaatatcattgaaaatattgatatgcaaacacatttccttttcatccccattctatctttccctttggggacagattgctttccaaaagctcatgaacaaatatttggaatgctggtacctttggggcagaggtaagggtgggcggggtgggggcagaaaggtaatgcttaatgcagataactcttctaatcagtgtccatggcaatatgaacgcttgaagaaaactcagtgacatatcttgctcagtagtttcttattcctgaagaaccacaagcataaagtgaggcctcagtgctggtgctcttggagtatggggaatgtgcaaatatttaactgttttgtatgctgcacattgcaggtctgctcatgtgcattctccctttgtcttcctttgtcatatgtgtttttgcttttttgaaagtgcagtctttattgtaccctcctccagcttgtagcaaattagaatgcttagcatttatgttcattcattattgtatttgccatgtaaaatttttattaccttagacaagcttataagctgttactacataacttatcttactgtaactcttttatttcccccgacgttgtaatttgtttgtgatgtatattgtgaaattgtattctatgttaatttaatcagcacaattcactgacatgctggactgacatgctggctgctgtttcaaagtgtaaagtttgtgtagggctgttgggacaactgcaactctgttgtcaaggtactgtgctttggttcctatagcaacactgggtgtggcccttgaattgctaagggcatttaatacatcctggagcaaattttaactgcagattttctttgtagaaattctatgtataatgcaggtacctacttggcccatggctggtaactatttgggcaattagaaaaaaagaaaaaaacataaaaactagtgtctattgctgctttgaatatgtttgaaagtctgaaaatgtaaatagtttatcaaaaaaaaatcttgtacagtccagtgtaaagtttttaaatgaccttaagggttgccatcacatctttctcacactctcctcttgataataataataataaaaagtttgctaaggattaaagaaatgggaaaaataaaaaaaatctcttcaaatttacaggaatgaatcattgttcttagctttgttgcatacacaaacttcttggattttgttgtgcagtattgacgtgagataaagctcaacattgaataatctttcagtggtacttttcaaagtcttcccctcctctgcctcataattaagggaaaagacaaaattgaaagacacactgtctttatctatcctggtgtatgttggcaccttagctactttttttttttcctttttgcacaaggtgctttcctgatatgttcaacatgccatctttgggtgataatgtatatgccgtgatggggctcaggccccttaggggagtgtctataagaactgcctatttatgctcatttacctcaagactgtcctctctaccctaatctagttgtcatcactccatcttttgtactgctgttgacacttacaaattaaagataaattttgttttatga

SEQ ID NO: 186404 - DNA, 8865 bp, Homo sapiens
  Payload ID: 16713
  Gene Symbol: SOX6
  Gene Name: SRY (sex determining region Y)-box 6
  Uniprot ID: P35712
  ENST ID: ENST00000396356
  CDS Start-End: 79-2505
gtcactttcatgaattcaaaggcaatttaccagtgatttctgggtgctggggctgatattttttgtgcatatttaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggattcctcctgcatggaaaaactactttcaaaagattggaaggaaaaaatggaaagactaaataccagtgaacttcttggagaaattaaaggtacacctgagagcctggcagaaaaagaacggcagctctccaccatgattacccagctgatcagtttacgggagcagctactggcagcgcatgatgaacagaaaaaactggcagcgtcacaaattgagaaacaacggcagcaaatggaccttgctcgccaacagcaagaacagattgcgagacaacagcagcaacttctgcaacagcagcacaaaattaatctcctgcagcaacagatccaggttcagggtcacatgcctccgctcatgatcccaatttttccacatgaccagcggactctggcagcagctgctgctgcccaacagggattcctcttcccccctggaataacatacaaaccaggtgataactaccccgtacagttcattccatcaacaatggcagctgctgctgcttctggactcagccctttacagctccagaagggtcatgtctcccacccacaaattaaccaaaggctaaagggcctaagtgaccgttttggcaggaatttggacacctttgaacatggtggtggccactcttacaaccacaaacagattgagcagctctatgccgctcagctggccagcatgcaggtgtcacctggagcaaagatgccatcaactccacagccaccaaacacagcagggacggtctcacctactgggataaaaaatgaaaagagagggaccagccctgtaactcaagttaaggatgaagcagcagcacagcctctgaatctctcatcccgacccaagacagcagagcctgtaaagtccccaacgtctcccacccagaacctcttcccagccagcaaaaccagccctgtcaatctgccaaacaaaagcagcatccctagccccattggaggaagcctgggaagaggatcctctttagatatcctatctagtctcaactcccctgccctttttggggatcaggatacagtgatgaaagccattcaggaggcgcggaagatgcgagagcagatccagcgggagcaacagcagcaacagccacatggtgttgacgggaaactgtcctccataaataatatggggctgaacagctgcaggaatgaaaaggaaagaacgcgctttgagaatttggggccccagttaacgggaaagtcaaatgaagatggaaaactgggcccaggtgtcatcgaccttactcggccagaagatgcagagggaggtgccactgtggctgaagcacgagtctacagggacgcccgcggccgtgccagcagcgagccacacattaagcgaccaatgaatgcattcatggtttgggcaaaggatgagaggagaaaaatccttcaggccttccccgacatgcataactccaacattagcaaaatcttaggatctcgctggaaatcaatgtccaaccaggagaagcaaccttattatgaagagcaggcccggctaagcaagatccacttagagaagtacccaaactataaatacaaaccccgaccgaaacgcacctgcattgttgatggcaaaaagcttcggattggggagtataagcaactgatgaggtctcggagacaggagatgaggcagttctttactgtggggcaacagcctcagattccaatcaccacaggaacaggtgttgtgtatcctggtgctatcactatggcaactaccacaccatcgcctcagatgacatctgactgctctagcacctcggccagcccggagcccagcctcccggtcatccagagcacttatggtatgaagacagatggcggaagcctagctggaaatgaaatgatcaatggagaggatgaaatggaaatgtatgatgactatgaagatgaccccaaatcagactatagcagtgaaaatgaagccccggaggctgtcagtgccaactgaggagtttttgtttgctgaattaaagtactctgacatttcacccccctccccaacaaagagttattaaagagcccgcatgcatttgtggctccacaattacatcagcagaatggtcttaattgtttcgtaaagtgtgagacagattaagttttccctgatttttcatgaacttgagttttttgttgttattgttattgttgttgttgttgtttttttaatttaggtgaagacatattaaatatgagacaccaggacttgaaacttatctcaacccgtagatgtcttacaagtcttatatttttgtcttactttttttttcttttggatgttgataaaggtttaagttactgttttagatggggttaaacattctcactcaggtatgctgtgccggcctacaggttgtgaatgtgtttttattctgaattattttagaaaacaactgaggatttcatattgtgaaacagaacaagtccacggcgtgtgcagctgcatgtagagcatattcaaaaggcctcggaattccaattttccatttgtagagttaaactttgaatgtgccaaactttttcgtaacttttgaatcttaatattttgaaagtcttaaaggagacactgcaaagtcttagacaatctttggcatcttaaaataaaatagcaaaccaacatttttttttccagaaaatggtaaggtactcaggaatctggagacaagatattgtaaggaatgaacaaggttgccacagtgcatggacccaattgtgtttgcctgttgacgtgccatcagtgcgtgatgtggtatgacatacacacaccagagcaaccgccacaccagatatcgacagagtggtcttctctgcctgagaccacctctcactacatccattatccctttgcctttaaccctgacattcagtcttaacacattttatcttaaataatttattcattccagaatgtcaagggtccacttgctatttattttttttcaattgttggtggcattaatttaataattcttgtttttcaccttccttccccgaagaacttttccgtccttttcacctccttctcctgtgtacatagtgattttatgtccccagaacgcctggaagcatttctgaaaccaagatattattaaaaacctattattgtttttaatcatgagtatgtatctggctgcagggctgtgtattgggatataggtatatagtcttacacttaaacaggtatgcccctgaggttcactgtgacctcaagtcttttgccagaattttcccctaattcagttcacaagtggtagggtctgcatcagtggcatttccccctgaattccattcagcagcaaggttcaacagtggtgactgccaggcaggagagtcctgcggccaaacctgaagcccaaggctcgtgggccatgcaggaatctcagtgaagctgtcatgggctggcacctttacactgagttgccttgtcccagctggcacatctagggagttcattgcaaaatccccaggatgcaaaaagccacatgacagcctcagagcaaagatggtggcaaatagtcatgatacatctagagaatgaaagaaaactgtaagggaggagaaggaggggaatacattccctatatgggatgttcctactgttaactctggggaacagatagctccgggggcagcagatgagttcctctggctgactctatctgtagccacatggggacctgcctacgtgtgaacaaaatgaactgcacttatcacacaaggatttctttgaagacatgctactggggtgggaagcagtgaggttttattccccatctcctaactacagggagctctgccatgtcattttggccttcctgaaactaggacaggttgtctatcggggggcttcccccagagaggtttagtgggagaatgtcagtgaatgggatagttcacctcatgggacaacccagaatctgatcaccaggacataggaatggccccatcagatttcttgagccattttgtcacttggaagaaaatagtgtacctttgtatttatttaagagtgctcaaggcctaatagcaataaacaggtctagccaagaaattacaagctattctgttagctgggagtgctctctataagctgattaaggtactgataggaactctttgttattcatgttggttggggattagaaatttgtttttgtacatttatttcaaatgaggaggaggtcattttttctctcaaaaaatgagtatttattattgtcttactgatttctttgattatatacctctcctcctcagttcactcttgttttttttctttctctttggcttttgcttttgctctctctcacttctttcttattttgttgcattggtagagtgttgtatggctagcattgtattgtatgtaattaattttgcacaaaagcaaacatttagcatagtaggttaattttgtttgtttttatgaccatgccaaaataatattctgggctggtggagaacaaaggactgttctttaggactgaaacttgattttgctcatagtaagtaaaaaaaaacaaaaaacacacacactcacagatgttgtttcgtaagtgttataagcactggatataaatggtattttttatcacttctgactaatgtgaaactgttgtacgaaaactacatgaacaaaagtcatctgtttcgactcgtgtgggcttgcctcacagttgccggatttgagtcatttttatgtcttgttatttcatttatttatgcaaaatacatgtgtgtatgaacactttgttttagctccagctctgcctcagtactggggttcatttacttttagccatgttcttaaaaatgaaaggctattcaggaatgatctgattgtaaacgtctttttcattggatcaaacagtaatgctgtatttgaatctaaattttgtgtataagcagtttatttattagccaagtttggctctaaatatccatggaaattaagaatgacaatcatagggatcaattcattttattttcagtggggcttaaacaaagtttatatgactttaccatctcattttagatttttctaattgtgtaaatataacatagaaatagaatttatttttggttcatgaatacttagtgagatataagttatgtatttcctttttgttctctatccatagatgttggtccaaactgaaagttgatgagtcactgtgcctctcggggtagtgagttatcagctacagtgagagagcagtgtttggcctgcagctgggacagcaaaacgtttcaccagggttctcatgcagttcagaacccactgtccacagatccagacatttcccttttttcttacagaaagttgatgattggacatactaaatttccactacagttaggagacagtcagtttgctttgggagtctacataaatcttctaagatagttctgtgaccatttaatagcaagaagcatgaatgccactacaaaggcaaaaatccacctctgagatcggccgttaataaacgtcccgtcatgtcagtttagattcaagaatgttaagcaactttgtttttgcggtgctccctatttcatagtatcttcaaatcaaaaataaaaattatctccattttgttaaagaacttacagggtcagggttctccttgtcacttagaattgggacactgccaggcaatcctctcccaaaaaaaaaaaaaaaaaaaaatagccatatggaatggaaggaaaaggagaaaagaaggaagaaaggaaaaaagtaggaagggagagagaaaaaaaaggtcgctttgcggatacgagccgctaggctgacaacttttctatttcattggcagatatgaagcagtgtcttttccagtaaggtacggaagctttgttgttttcatgtgtacccagctcagccttttagaagcacctcggtttgcttcattaggtatttgatactctccagccttgtcctcaggcctgatttgatttgccagggtcctgacaccaaagcccaggccaagttctaaattcaggtgtgggctcacagtgctattgagcttgtcgaattctggcctcccctgaacattagccccacgggagcctgagggtgtttgaaaagggcgtgatcactctagggctgaaattaaaggctgctttcttttccttctgaagccaggctgcttcttcggagtacaccctcctgagccaggagcacaagcactagcagaaagcagggattgtttcaggaaagcccatttaccctcagtaggaaggcagcctggtcacttgaacagcacagctgaggctgcttctctcaatttactcattttgcaaagaattgacctctaccaactcattagggagaggaaaaagaatcacttagtaattttaaatcatatgagaagtcctgtaccaagtgccaacaactgcaaagaaatgcagctagaggaatgtattgaaattactactgggtcttcctttttaatgagaaaatgacaaaaatggttgctgtagccctgcctgattttgtacacgtttgtctaagaattgagttggcacttaagctcacttctcaaagtataataatattgtatgacctcatttgtcctttcacaaaagcacttgcatcatttccttaagtcatctgctccctgacatgttttcttccctaataaacaacttctgtctgttattcctgccaatgatgttctgtttctgatgccatatcctattgagcgtgcccctgtactaatatcattgaaaatattgatatgcaaacacatttccttttcatccccattctatctttccctttggggacagattgctttccaaaagctcatgaacaaatatttggaatgctggtacctttggggcagaggtaagggtgggcggggtgggggcagaaaggtaatgcttaatgcagataactcttctaatcagtgtccatggcaatatgaacgcttgaagaaaactcagtgacatatcttgctcagtagtttcttattcctgaagaaccacaagcataaagtgaggcctcagtgctggtgctcttggagtatggggaatgtgcaaatatttaactgttttgtatgctgcacattgcaggtctgctcatgtgcattctccctttgtcttcctttgtcatatgtgtttttgcttttttgaaagtgcagtctttattgtaccctcctccagcttgtagcaaattagaatgcttagcatttatgttcattcattattgtatttgccatgtaaaatttttattaccttagacaagcttataagctgttactacataacttatcttactgtaactcttttatttcccccgacgttgtaatttgtttgtgatgtatattgtgaaattgtattctatgttaatttaatcagcacaattcactgacatgctggactgacatgctggctgctgtttcaaagtgtaaagtttgtgtagggctgttgggacaactgcaactctgttgtcaaggtactgtgctttggttcctatagcaacactgggtgtggcccttgaattgctaagggcatttaatacatcctggagcaaattttaactgcagattttctttgtagaaattctatgtataatgcaggtacctacttggcccatggctggtaactatttgggcaattagaaaaaaagaaaaaaacataaaaactagtgtctattgctgctttgaatatgtttgaaagtctgaaaatgtaaatagtttatcaaaaaaaaatcttgtacagtccagtgtaaagtttttaaatgaccttaagggttgccatcacatctttctcacactctcctcttgataataataataataaaaagtttgctaaggattaaagaaatgggaaaaataaaaaaaatctcttcaaatttacaggaatgaatcattgttcttagctttgttgcatacacaaacttcttggattttgttgtgcagtattgacgtgagataaagctcaacattgaataatctttcagtggtacttttcaaagtcttcccctcctctgcctcataattaagggaaaagacaaaattgaaagacacactgtctttatctatcctggtgtatgttggcaccttagctactttttttttttcctttttgcacaaggtgctttcctgatatgttcaacatgccatctttgggtgataatgtatatgccgtgatggggctcaggccccttaggggagtgtctataagaactgcctatttatgctcatttacctcaagactgtcctctctaccctaatctagttgtcatcactccatcttttgtactgctgttgacacttacaaattaaagataaattttgttttatga

SEQ ID NO: 186405 - DNA, 2707 bp, Homo sapiens
  Payload ID: 16713
  Gene Symbol: SOX6
  Gene Name: SRY (sex determining region Y)-box 6
  Uniprot ID: P35712
  ENST ID: ENST00000528252
  CDS Start-End: 192-2597
ccttggggttagttttagtcatatttttatctctataaaacatcaggctgggaggtggtgtgtgcctgtagtctcaactgctagggagcctgaggcaggaagactccttgagcacaggagttcaaggccagcctgtgcaacatagtgagaccctatcactctggaaaaaaaaaaaaaatctgcggagaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggattcctcctgcatggaaaaactactttcaaaagattggaaggaaaaaatggaaagactaaataccagtgaacttcttggagaaattaaaggtacacctgagagcctggcagaaaaagaacggcagctctccaccatgattacccagctgatcagtttacgggagcagctactggcagcgcatgatgaacagaaaaaactggcagcgtcacaaattgagaaacaacggcagcaaatggaccttgctcgccaacagcaagaacagattgcgagacaacagcagcaacttctgcaacagcagcacaaaattaatctcctgcagcaacagatccaggttcagggtcacatgcctccgctcatgatcccaatttttccacatgaccagcggactctggcagcagctgctgctgcccaacagggattcctcttcccccctggaataacatacaaaccaggtgataactaccccgtacagttcattccatcaacaatggcagctgctgctgcttctggactcagccctttacagctccagcagctctatgccgctcagctggccagcatgcaggtgtcacctggagcaaagatgccatcaactccacagccaccaaacacagcagggacggtctcacctactgggataaaaaatgaaaagagagggaccagccctgtaactcaagttaaggatgaagcagcagcacagcctctgaatctctcatcccgacccaagacagcagagcctgtaaagtccccaacgtctcccacccagaacctcttcccagccagcaaaaccagccctgtcaatctgccaaacaaaagcagcatccctagccccattggaggaagcctgggaagaggatcctctttaggtaaatggaaaagtcaacaccaggaagagacttacgaattagatatcctatctagtctcaactcccctgccctttttggggatcaggatacagtgatgaaagccattcaggaggcgcggaagatgcgagagcagatccagcgggagcaacagcagcaacagccacatggtgttgacgggaaactgtcctccataaataatatggggctgaacagctgcaggaatgaaaaggaaagaacgcgctttgagaatttggggccccagttaacgggaaagtcaaatgaagatggaaaactgggcccaggtgtcatcgaccttactcggccagaagatgcagagggaagtaaagcaatgaatggctctgcagctaaactacagcagtattattgttggccaacaggaggtgccactgtggctgaagcacgagtctacagggacgcccgcggccgtgccagcagcgagccacacattaagcgaccaatgaatgcattcatggtttgggcaaaggatgagaggagaaaaatccttcaggccttccccgacatgcataactccaacattagcaaaatcttaggatctcgctggaaatcaatgtccaaccaggagaagcaaccttattatgaagagcaggcccggctaagcaagatccacttagagaagtacccaaactataaatacaaaccccgaccgaaacgcacctgcattgttgatggcaaaaagcttcggattggggagtataagcaactgatgaggtctcggagacaggagatgaggcagttctttactgtggggcaacagcctcagattccaatcaccacaggaacaggtgttgtgtatcctggtgctatcactatggcaactaccacaccatcgcctcagatgacatctgactgctctagcacctcggccagcccggagcccagcctcccggtcatccagagcacttatggtatgaagacagatggcggaagcctagctggaaatgaaatgatcaatggagaggatgaaatggaaatgtatgatgactatgaagatgaccccaaatcagactatagcagtgaaaatgaagccccggaggctgtcagtgccaactgaggagtttttgtttgctgaattaaagtactctgacatttcacccccctccccaacaaagagttattaaagagcccgcatgcatttgtggctccacaattacatcagcagaa

SEQ ID NO: 186406 - DNA, 1818 bp, Homo sapiens
  Payload ID: 16713
  Gene Symbol: SOX6
  Gene Name: SRY (sex determining region Y)-box 6
  ENST ID: ENST00000530378
  CDS Start-End: 688-1167
acagtcgtcaccgttgcggcccctcgccgccccggggcactttgggagttgtagttttctgattcattgcatactggcccgaataaaaaagatgtgtccgtgactaaaactacaattcccaggaagccccgaggctcaattcgcgctgtgtggcgggagtgccctcagaggccccgccttcggctggtggaggaagcgttcccgcggatgtgtatggcgaattgttggcacctggatggtaaatcttcaagttactgtgaaacaagatcacaaacgaaaaagtaacataggaaatactaaagactgggacattttatcagattttactcagtttcatatacagaaggctataggactgttttgccggattctaaatgacaacttttaaatcagagccttgaaatctacagaagtccaatatatactgaggaacaaagggaatgtggaaatgaaagagagagggagagagaggctggcagatgtaatgagacgcggtgaaggtgtacgcagactggcactcccactcctcccttctgctctcactgcagccctgggtaactcgcaggctaacacaaacagcttttctcccgcagcctgccctctgtcactgtcactttcatgaattcaaaggcaatttaccagtgatttctgggtgctggggctgatattttttgtgcatatttaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggcaagtctttctttcaagatttctggagtaccttagttattttaaaccataactgctgaaaggagaataacatgaatctagagaactttttaaaaagtaactgaaattatcgaacattagcagcattgaatagagtttcctctctgacataacaagaaaatatggacaaaatactctagttctaaagtgtacaacttacatatgaagaaatgctacaggaatttcccttaagatcaggaacaaggccaagctgcccactgtcaccactatattcaacatttttctgaaggagggtaaattcagcctccgtcttggctagaagtgggtaatccaagtaatgcaaattaaaactatattgagatgacaattctagctcattgaattgttgaaaattaaagatgtgaaacacattcttctgtcaaggttgtgaagaaacaggtattctattttggagggcatggaagttattataagtctttcagaaacaaatttcacagcatctgtcaaaacaacatatacactttcttttgatccagtagtcctcttcttggaatttaccctgaagatacaccttcagtgatatgaaaaaagatatgcaaaaagctgtttgttgacttattatttgtaattgcaaacaacctacatatgcatataggagagtgattaaataaattatgctgcagtccc

SEQ ID NO: 186407 - DNA, 549 bp, Homo sapiens
  Payload ID: 16713
  Gene Symbol: SOX6
  Gene Name: SRY (sex determining region Y)-box 6
  ENST ID: ENST00000529469
  CDS Start-End: 312-549
aaagaaagagcaagccccataatggcagcatctttatcttgcacactagtctgtctcttgtgcctgtaacaatgccaggaactttagtaactatttttttttgaattttgacaatcttggtcgacaagggtaaaaaaggacattccagaagcagaaaaacatgagcaaaagtatggagacatcaaaggtcatggcatatgttcgtttatcatggctggaatgaggggtatgaggaagatgactgagagtgtgtactttggagtcagtcagagcagagttgacttcattttatgctacctttatgattaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatgg

SEQ ID NO: 186408 - DNA, 2656 bp, Homo sapiens
  Payload ID: 16713
  Gene Symbol: SOX6
  Gene Name: SRY (sex determining region Y)-box 6
  Uniprot ID: P35712
  ENST ID: ENST00000528429
  CDS Start-End: 69-2555
gttaggagagaccattggggataggaaagatgaaaggtcatggtgagcttcaaggacatgaaagaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggattcctcctgcatggaaaaactactttcaaaagattggaaggaaaaaatggaaagactaaataccagtgaacttcttggagaaattaaaggtacacctgagagcctggcagaaaaagaacggcagctctccaccatgattacccagctgatcagtttacgggagcagctactggcagcgcatgatgaacagaaaaaactggcagcgtcacaaattgagaaacaacggcagcaaatggaccttgctcgccaacagcaagaacagattgcgagacaacagcagcaacttctgcaacagcagcacaaaattaatctcctgcagcaacagatccaggttcagggtcacatgcctccgctcatgatcccaatttttccacatgaccagcggactctggcagcagctgctgctgcccaacagggattcctcttcccccctggaataacatacaaaccaggtgataactaccccgtacagttcattccatcaacaatggcagctgctgctgcttctggactcagccctttacagctccagaagggtcatgtctcccacccacaaattaaccaaaggctaaagggcctaagtgaccgttttggcaggaatttggacacctttgaacatggtggtggccactcttacaaccacaaacagattgagcagctctatgccgctcagctggccagcatgcaggtgtcacctggagcaaagatgccatcaactccacagccaccaaacacagcagggacggtctcacctactgggataaaaaatgaaaagagagggaccagccctgtaactcaagttaaggatgaagcagcagcacagcctctgaatctctcatcccgacccaagacagcagagcctgtaaagtccccaacgtctcccacccagaacctcttcccagccagcaaaaccagccctgtcaatctgccaaacaaaagcagcatccctagccccattggaggaagcctgggaagaggatcctctttagatatcctatctagtctcaactcccctgccctttttggggatcaggatacagtgatgaaagccattcaggaggcgcggaagatgcgagagcagatccagcgggagcaacagcagcaacagccacatggtgttgacgggaaactgtcctccataaataatatggggctgaacagctgcaggaatgaaaaggaaagaacgcgctttgagaatttggggccccagttaacgggaaagtcaaatgaagatggaaaactgggcccaggtgtcatcgaccttactcggccagaagatgcagagggaagtaaagcaatgaatggctctgcagctaaactacagcagtattattgttggccaacaggaggtgccactgtggctgaagcacgagtctacagggacgcccgcggccgtgccagcagcgagccacacattaagcgaccaatgaatgcattcatggtttgggcaaaggatgagaggagaaaaatccttcaggccttccccgacatgcataactccaacattagcaaaatcttaggatctcgctggaaatcaatgtccaaccaggagaagcaaccttattatgaagagcaggcccggctaagcaagatccacttagagaagtacccaaactataaatacaaaccccgaccgaaacgcacctgcattgttgatggcaaaaagcttcggattggggagtataagcaactgatgaggtctcggagacaggagatgaggcagttctttactgtggggcaacagcctcagattccaatcaccacaggaacaggtgttgtgtatcctggtgctatcactatggcaactaccacaccatcgcctcagatgacatctgactgctctagcacctcggccagcccggagcccagcctcccggtcatccagagcacttatggtatgaagacagatggcggaagcctagctggaaatgaaatgatcaatggagaggatgaaatggaaatgtatgatgactatgaagatgaccccaaatcagactatagcagtgaaaatgaagccccggaggctgtcagtgccaactgaggagtttttgtttgctgaattaaagtactctgacatttcacccccctccccaacaaagagttattaaagagcccgcatgcatttgtggctccacaattaca

SEQ ID NO: 186409 - DNA, 2699 bp, Homo sapiens
  Payload ID: 16713
  Gene Symbol: SOX6
  Gene Name: SRY (sex determining region Y)-box 6
  Uniprot ID: P35712
  ENST ID: ENST00000527619
  CDS Start-End: 184-2598
gggataggaaagatgaaaggtcatggtgagcttcaaggacatgaaaggttgttgtctcatgtaacaatagtagattgttttttttcctaatatttctagccagcccctaagtcaggtgatggaacaaatacctacagtttagtcaggtgaaacaggagtgggtggaggaaggaaagaagaaaaatgggaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggattcctcctgcatggaaaaactactttcaaaagattggaaggaaaaaatggaaagactaaataccagtgaacttcttggagaaattaaaggtacacctgagagcctggcagaaaaagaacggcagctctccaccatgattacccagctgatcagtttacgggagcagctactggcagcgcatgatgaacagaaaaaactggcagcgtcacaaattgagaaacaacggcagcaaatggaccttgctcgccaacagcaagaacagattgcgagacaacagcagcaacttctgcaacagcagcacaaaattaatctcctgcagcaacagatccaggttcagggtcacatgcctccgctcatgatcccaatttttccacatgaccagcggactctggcagcagctgctgctgcccaacagggattcctcttcccccctggaataacatacaaaccaggtgataactaccccgtacagttcattccatcaacaatggcagctgctgctgcttctggactcagccctttacagctccagcagctctatgccgctcagctggccagcatgcaggtgtcacctggagcaaagatgccatcaactccacagccaccaaacacagcagggacggtctcacctactgggataaaaaatgaaaagagagggaccagccctgtaactcaagttaaggatgaagcagcagcacagcctctgaatctctcatcccgacccaagacagcagagcctgtaaagtccccaacgtctcccacccagaacctcttcccagccagcaaaaccagccctgtcaatctgccaaacaaaagcagcatccctagccccattggaggaagcctgggaagaggatcctctttaggtaaatggaaaagtcaacaccaggaagagacttacgaattagatatcctatctagtctcaactcccctgccctttttggggatcaggatacagtgatgaaagccattcaggaggcgcggaagatgcgagagcagatccagcgggagcaacagcagcaacagccacatggtgttgacgggaaactgtcctccataaataatatggggctgaacagctgcaggaatgaaaaggaaagaacgcgctttgagaatttggggccccagttaacgggaaagtcaaatgaagatggaaaactgggcccaggtgtcatcgaccttactcggccagaagatgcagagggaagtaaagcaatgaatggctctgcagctaaactacagcagtattattgttggccaacaggaggtgccactgtggctgaagcacgagtctacagggacgcccgcggccgtgccagcagcgagccacacattaagcgaccaatgaatgcattcatggtttgggcaaaggatgagaggagaaaaatccttcaggccttccccgacatgcataactccaacattagcaaaatcttaggatctcgctggaaatcaatgtccaaccaggagaagcaaccttattatgaagagcaggcccggctaagcaagatccacttagagaagtacccaaactataaatacaaaccccgaccgaaacgcacctgcattgttgatggcaaaaagcttcggattggggagtataagcaactgatgaggtctcggagacaggagatgaggcagttctttactgtggggcaacagcctcagattccaatcaccacaggaacaggtgttgtgtatcctggtgctatcactatggcaactaccacaccatcgcctcagatgacatctgactgctctagcacctcggccagcccggagcccagcctcccggtcatccagagcacttatggtatgaagacagatggcggaagcctagctggaaatgaaatgatcaatggagaggatgaaatggaaatgtatgatgactatgaagatgaccccaaatcagactatagcagtgaaaatgaagccccggaggctgtcagtgccaactgaggagtttttgtttgctgaattaaagtactctgacatttcacccccctccccaacaaagagttattaaagagcccgcatgcatttgtggctccacaattaca

SEQ ID NO: 186410 - DNA, 534 bp, Homo sapiens
  Payload ID: 16713
  Gene Symbol: SOX6
  Gene Name: SRY (sex determining region Y)-box 6
  ENST ID: ENST00000526673
  CDS Start-End: 116-534
gtggaggtagaggatgatttcaattagaaataatgacagcaatagacgcttccaatgaagatatcgtggccaccaaaggacaaaggcaagaagttaattcctgaagtcgagaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttga

SEQ ID NO: 186411 - DNA, 586 bp, Homo sapiens
  Payload ID: 16713
  Gene Symbol: SOX6
  Gene Name: SRY (sex determining region Y)-box 6
  ENST ID: ENST00000533411
  CDS Start-End: 110-586
gattattaatccagctagagaagaaatatgcttttacttagcaagaatgagtatccaaagagctgataatattgttaaggcagcggggtggaatggcagagcttgaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggattcctcctgcatggaaaaactactttcaaaa

SEQ ID NO: 186412 - DNA, 3216 bp, Homo sapiens
  Payload ID: 16714
  Gene Symbol: SOX7
  Gene Name: SRY (sex determining region Y)-box 7
  Uniprot ID: Q9BT81
  ENST ID: ENST00000304501
  CDS Start-End: 80-1246
aagttggacgccccgacccgtgcgagggccaggtccgcgcctgccccgccaggcgaagcgaggcgacccgcgtgcggccatggcttcgctgctgggagcctacccttggcccgagggtctcgagtgcccggccctggacgccgagctgtcggatggacaatcgccgccggccgtcccccggcccccgggggacaagggctccgagagccgtatccggcggcccatgaacgccttcatggtttgggccaaggacgagaggaaacggctggcagtgcagaacccggacctgcacaacgccgagctcagcaagatgctgggaaagtcgtggaaggcgctgacgctgtcccagaagaggccgtacgtggacgaggcggagcggctgcgcctgcagcacatgcaggactaccccaactacaagtaccggccgcgcaggaagaagcaggccaagcggctgtgcaagcgcgtggacccgggcttccttctgagctccctctcccgggaccagaacgccctgccggagaagagaagcggcagccggggggcgctgggggagaaggaggacaggggtgagtactcccccggcactgccctgcccagcctccggggctgctaccacgaggggccggctggtggtggcggcggcggcaccccgagcagtgtggacacgtacccgtacgggctgcccacacctcctgaaatgtctcccctggacgtgctggagccggagcagaccttcttctcctccccctgccaggaggagcatggccatccccgccgcatcccccacctgccagggcacccgtactcaccggagtacgccccaagccctctccactgtagccaccccctgggctccctggcccttggccagtcccccggcgtctccatgatgtcccctgtacccggctgtcccccatctcctgcctattactccccggccacctaccacccactccactccaacctccaagcccacctgggccagctttccccgcctcctgagcaccctggcttcgacgccctggatcaactgagccaggtggaactcctgggggacatggatcgcaatgaattcgaccagtatttgaacactcctggccacccagactccgccacaggggccatggccctcagtgggcatgttccggtctcccaggtgacaccaacgggtcccacagagaccagcctcatctccgtcctggctgatgccacggccacgtactacaacagctacagtgtgtcatagagctggaggcgccccgtccggtcagccctcgcgccctctccttcttgtgccttgagtggcagaggagccgtccagccacaccagctttcctcccaccgctcagggcagggaggtctgaactgcggccccagagcctttggcctaagctggactctccttatccgagtgccgcctctatccccttccccacgttccagcccctgcagcccacattttaagtatattccttcaagtgagttttcctccagcccctgagagttgctgtctcccagtggaatgttcactgacgtcttttcttggtagccatcatcgaaactaatggggggacagacttgatagccaaggtcccttctggtccagttttctgatttagggttctctcaagattaataaaggaagatggggaaatttgactcattaatgagctcgctaacctacgatctggtgataattttgtgtgcacagcccaaggaccacgaggctttctgcactttctgcacccccttccaaagtgaccacaaaatttcaaagggactcatacaatttgagaaaaaacagtcaacctgatttgagaaattaaccagtatggctaactatatcacagaaaatgggattgagttaaaactattttattttaaatatacattttaaagcagttctttttttttgttaatttgtttattatacacacacttcaagagaatatgcacagtctaggccgggcacggtggctcacgcctgtaatcccagcactttgggaggccgaggcatgtggatcacctgaggtcaggagtttgagaccagcctagacaacatggtgaaaccttgtctctatgaaaaatacaaaatttgctgggagtggtggtgcatgcctgtaatcccagctacttggaaggctgaggcaggagaatgtcttgaacctaggaggtggaggttgcagtgagctgagattgcaccattgcactccagcctgtgcaacaagagtgaaactccatttcaagaaaaaaaaaaaaaaaagaatatgcacagtctgaatgtataccaggagtgtgagagacacatgcccacttcatgcaactcctaaactcaaagtctaaatcagatatttttattaacaatgacaacttgttgccaactccctgtttctaatgaccaaagacccagggtacctaaaaggactttgcaaccaagcaaagtcactgtcttcaaatctggatacacactttcccctctgtagattcaaaaggtgcttccttcccggctgtctccagcttccttactctcttttctgggatttctttttctcttctttctgctcttcctccactgctgaactggtccctaactgaaacagcccctgacttatcccaagcatgcttcctttagctgctgtgagaatttgtcttcctcaccagccaggtcctcaggcaaagtcctcagccagtgctttagagcaacttcccgcaaatcagaaactcactgtgattccaaaaatgtttctgagccctggacccctgcccccaaaatattttcatctttcccccaaacctcctttaaaggagcatgcataacagtgtgctgaaagacagttgttggttttttgattttagcatattatttcctgtatgaaatatgttttatataatctcctattatttttatcttatgttttgtattgttgataaatcctttttgtccttctaagatgtcctattgtaaaatcacttataaggtatgattactctttatgctattactttatatgccatttggtaataaatagtaaattgttgatgatatgattgactgatgcgcagtccagagcatgtatgaataatctcataaaacagtatcacagacattaagctaaactgtttcgtttttttgaaagaacaactcatactttggaacagttgtcaatattaatttgttgcaaatatttaatttaaataaacatttttgtaccatga

SEQ ID NO: 186413 - DNA, 3049 bp, Homo sapiens
  Payload ID: 16715
  Gene Symbol: SOX8
  Gene Name: SRY (sex determining region Y)-box 8
  Uniprot ID: P57073
  ENST ID: ENST00000293894
  CDS Start-End: 116-1456
ggcgagggtcggggccaccgcgcggcgacctcgggtcccggagcgaccgcagggcagccccgggcgccggccccggtgcgcgtctcctgtgcgcgcccctccgcgcgcggccccgatgctggacatgagcgaggcccgctcccagccgccctgcagcccgtccggcaccgccagctccatgtcgcacgtggaggactcggactcggacgcgccgccgtctcccgccggctccgagggcctgggccgcgcgggggtcgcggtggggggcgcccggggcgacccggcggaggcggcggacgagcgcttcccggcctgcatccgcgacgccgtgtcgcaggtgctcaagggctacgactggagtctggtgcccatgccggtgcgcggcggcggcggcggcgcgctcaaagccaagccgcatgtgaagcggcccatgaacgcattcatggtgtgggcgcaggcggcgcgccgcaagctggccgaccagtacccgcacctgcacaacgccgagctcagcaagacgctgggcaagctgtggcgcttgctgagcgagagcgagaagcggcccttcgtggaggaggcagagcgccttcgcgtgcagcacaagaaggaccaccccgactacaagtaccagccacggcgcaggaagagcgccaaagccggccacagcgactccgactcgggcgcggagctgggaccccaccctggcggcggtgccgtgtacaaggctgaagcagggcttggagatgggcaccaccatggcgaccacacagggcagacccacgggccgcccaccccgcccaccacccccaagacggagctgcagcaggcgggcgccaagccggagctgaagctggagggacgccggccggtggacagcgggcgccagaacatcgacttcagcaacgtggacatctcggagctcagcagcgaggtcatgggcaccatggacgccttcgacgtccacgagttcgaccagtacctgcccctgggcggccccgccccacccgagccgggccaggcctatgggggcgcctacttccacgccggggcgtcccccgtgtgggcccacaagagtgccccgtcggcctccgcgtcgcccaccgagacgggtcccccacggccgcacatcaagacggagcagccgagccccggccactacggcgaccagccccgaggctcgcccgactacggttcctgcagcggccagtccagcgccaccccggccgcccccgccggccccttcgccggctcacagggcgactatggcgacctgcaggcctccagctactatggtgcctaccctggctacgcacccggcctctaccagtacccctgcttccactcgccgcgccggccctacgcctcacccctgctcaacggcctggccctgccgcccgcccacagccccaccagtcactgggaccagccggtgtacaccaccctgaccaggccctgagggcccagccgcggggagggactcgcaggcgtcagggggcagccttgtcccggcccagtgtgtgtgaccagggcgggaggggccccagtggctgagctccaagtgcctgctgaagtctgcagggaaacacgcttgctgcccgtggccctcggcctccagatggccacacctctgccgacgacggaccagctccctctcccttctatctttctttttgaggtggtgggattattccacaaagaagggctgccgtttggtccctcttccgtgaggactggcggcaccagcaccttcgctttgcatctcggtagaggagaaacggcagcacagcccaaggaccaaaggagggggtggcaggggccttgcagggcgctgtgaggtccaggccggtcttggcgccgagagcccctgcactcaaggccacattccctcgacaacggctgcacgggctgtccgggatccggggtgtctgtccgcagactgggatgagtctactcgagcatctccgggacctgcctgtcagatctgaggtgtctccttgctggcagagtgcgctcacgcgagggctggctgtgatgaacacatctctcttttatttttatgtttttgataatttttatttttgaagcttaaatgtgtttcttctgaaagctgttaaagatgtatttatgttctgtgttattttatctttaattaatgaggtaattcgggcaaagagtagaatttaagacaaaacggaagctgggaagcttcccttgagggcaggcaggaggtggagttgcagctgttggccggcatcacgttgctcgttgctcggcttatgggaggccgccctggagggcccggaggtcccaaggtccctgggaggactgggcccctcatgcctcgagcttggcaaccgaaaacccgagggaggagaagggacctgccttgtgacatctctgatcaggttggggtgccccagcacccagtaccagtttggggtttgggaagcaggactccgtccctgtccccgactgtgccacgtggtaggacacataggacacaggaattcctgggtccttgcccatgactgtgccatgtggtaggacacaggacacaggaattcctggaaagtggtggcttcagaagtgatcttggctcgcaggcaccagtgccacctaccaagctgtgaaactaaaccttctccactaaacgtcgttagggcctcagttctagacgagtcatacctgattcacctgcactgcttcccctgtgtgctgagcatagagcatacaatagcgcctacttcacggaaacttgtgcctttaaactttgtaaacttaaacacagccgagaagttgcttctttgtactttttctacttttcctacttttttgtagaaaaaaaagataatgcctctgcttctatttctctgggggtgggggtgggggccgggagccgtcgcagacccgtttcatgcagcgtctcccttggcaccgcgttcggaggacgcaccctcactcccctgctgccttcactcctttctgaccaagcaacgctaacttttgtacagatcgatttgataaaattaaacaaagtgctttttatgga

SEQ ID NO: 186414 - DNA, 3935 bp, Homo sapiens
  Payload ID: 16716
  Gene Symbol: SOX9
  Gene Name: SRY (sex determining region Y)-box 9
  Uniprot ID: P48436
  ENST ID: ENST00000245479
  CDS Start-End: 373-1902
ggagagccgaaagcggagctcgaaactgactggaaacttcagtggcgcggagactcgccagtttcaaccccggaaacttttctttgcaggaggagaagagaaggggtgcaagcgcccccacttttgctctttttcctcccctcctcctcctctccaattcgcctccccccacttggagcgggcagctgtgaactggccaccccgcgccttcctaagtgctcgccgcggtagccggccgacgcgccagcttccccgggagccgcttgctccgcatccgggcagccgaggggagaggagcccgcgcctcgagtccccgagccgccgcggcttctcgcctttcccggccaccagccccctgccccgggcccgcgtatgaatctcctggaccccttcatgaagatgaccgacgagcaggagaagggcctgtccggcgcccccagccccaccatgtccgaggactccgcgggctcgccctgcccgtcgggctccggctcggacaccgagaacacgcggccccaggagaacacgttccccaagggcgagcccgatctgaagaaggagagcgaggaggacaagttccccgtgtgcatccgcgaggcggtcagccaggtgctcaaaggctacgactggacgctggtgcccatgccggtgcgcgtcaacggctccagcaagaacaagccgcacgtcaagcggcccatgaacgccttcatggtgtgggcgcaggcggcgcgcaggaagctcgcggaccagtacccgcacttgcacaacgccgagctcagcaagacgctgggcaagctctggagacttctgaacgagagcgagaagcggcccttcgtggaggaggcggagcggctgcgcgtgcagcacaagaaggaccacccggattacaagtaccagccgcggcggaggaagtcggtgaagaacgggcaggcggaggcagaggaggccacggagcagacgcacatctcccccaacgccatcttcaaggcgctgcaggccgactcgccacactcctcctccggcatgagcgaggtgcactcccccggcgagcactcggggcaatcccagggcccaccgaccccacccaccacccccaaaaccgacgtgcagccgggcaaggctgacctgaagcgagaggggcgccccttgccagaggggggcagacagccccctatcgacttccgcgacgtggacatcggcgagctgagcagcgacgtcatctccaacatcgagaccttcgatgtcaacgagtttgaccagtacctgccgcccaacggccacccgggggtgccggccacgcacggccaggtcacctacacgggcagctacggcatcagcagcaccgcggccaccccggcgagcgcgggccacgtgtggatgtccaagcagcaggcgccgccgccacccccgcagcagcccccacaggccccgccggccccgcaggcgcccccgcagccgcaggcggcgcccccacagcagccggcggcacccccgcagcagccacaggcgcacacgctgaccacgctgagcagcgagccgggccagtcccagcgaacgcacatcaagacggagcagctgagccccagccactacagcgagcagcagcagcactcgccccaacagatcgcctacagccccttcaacctcccacactacagcccctcctacccgcccatcacccgctcacagtacgactacaccgaccaccagaactccagctcctactacagccacgcggcaggccagggcaccggcctctactccaccttcacctacatgaaccccgctcagcgccccatgtacacccccatcgccgacacctctggggtcccttccatcccgcagacccacagcccccagcactgggaacaacccgtctacacacagctcactcgaccttgaggaggcctcccacgaagggcgaagatggccgagatgatcctaaaaataaccgaagaaagagaggaccaaccagaattccctttggacatttgtgtttttttgtttttttattttgttttgttttttcttcttcttcttcttccttaaagacatttaagctaaaggcaactcgtacccaaatttccaagacacaaacatgacctatccaagcgcattacccacttgtggccaatcagtggccaggccaaccttggctaaatggagcagcgaaatcaacgagaaactggactttttaaaccctcttcagagcaagcgtggaggatgatggagaatcgtgtgatcagtgtgctaaatctctctgcctgtttggactttgtaattatttttttagcagtaattaaagaaaaaagtcctctgtgaggaatattctctattttaaatatttttagtatgtactgtgtatgattcattaccattttgaggggatttatacatatttttagataaaattaaatgctcttatttttccaacagctaaactactcttagttgaacagtgtgccctagcttttcttgcaaccagagtatttttgtacagatttgctttctcttacaaaaagaaaaaaaaaatcctgttgtattaacatttaaaaacagaattgtgttatgtgatcagttttgggggttaactttgcttaattcctcaggctttgcgatttaaggaggagctgccttaaaaaaaaataaaggccttattttgcaattatgggagtaaacaatagtctagagaagcatttggtaagctttatcatatatatattttttaaagaagagaaaaacaccttgagccttaaaacggtgctgctgggaaacatttgcactcttttagtgcatttcctcctgcctttgcttgttcactgcagtcttaagaaagaggtaaaaggcaagcaaaggagatgaaatctgttctgggaatgtttcagcagccaataagtgcccgagcacactgcccccggttgcctgcctgggccccatgtggaaggcagatgcctgctcgctctgtcacctgtgcctctcagaacaccagcagttaaccttcaagacattccacttgctaaaattatttattttgtaaggagaggttttaattaaaacaaaaaaaaattcttttttttttttttttccaattttaccttctttaaaataggttgttggagctttcctcaaagggtatggtcatctgttgttaaattatgttcttaactgtaaccagtttttttttatttatctctttaatctttttttattattaaaagcaagtttctttgtattcctcaccctagatttgtataaatgcctttttgtccatcccttttttctttgttgtttttgttgaaaacaaactggaaacttgtttctttttttgtataaatgagagattgcaaatgtagtgtatcactgagtcatttgcagtgttttctgccacagacctttgggctgccttatattgtgtgtgtgtgtgggtgtgtgtgtgttttgacacaaaaacaatgcaagcatgtgtcatccatatttctctgcatcttctcttggagtgagggaggctacctggaggggatcagcccactgacagaccttaatcttaattactgctgtggctagagagtttgaggattgctttttaaaaaagacagcaaacttttttttttatttaaaaaaagatatattaacagttttagaagtcagtagaataaaatcttaaagcactcataatatggcatccttcaatttctgtataaaagcagatctttttaaaaagatacttctgtaacttaagaaacctggcatttaaatcatattttgtctttaggtaaaagctttggtttgtgttcgtgttttgtttgtttcacttgtttccctcccagccccaaaccttttgttctctccgtgaaacttacctttccctttttctttctcttttttttttttgtatattattgtttacaataaatatacattgcattaaaaagaaa

SEQ ID NO: 186415 - DNA, 2561 bp, Homo sapiens
  Payload ID: 16717
  Gene Symbol: SSUH2
  Gene Name: ssu-2 homolog (C. elegans)
  Uniprot ID: Q9Y2M2
  ENST ID: ENST00000317371
  CDS Start-End: 1227-2288
ctcctaagaattctctcacctgccttctgcccttaggctctgctagattgcaaatgacctgctttctttctgatcctgggctgcgttcccacccctgtcagatagtaaatcccaagtaaggtacctgctttcggcagctctgagctttcttcttggacacctaaaacccacagtcctccaggctccgatagattgcaaatgacctgctttctttctgatcctgggctgcgttcagacccctgtgggatagtaaatcccaagtaaggtacttgccttccgcagatctgagctttcttcttagacacctaatacccacagtcctccaggctccgatagattgcaaatgacctgctttctttctgatcccgggctgctgagttcggacccctgttggatagtaaatcccaagtaaggtacctgccttcggcagctctgagatttcttcttggacacctaatacccacagtcctccaggggcaagaggatgctattactgcaaagagtacagaggatgtacacccgtctataatatagttggtgatttccagaggctgagaagatattactgacaatcccgtcaacatgctgtgtgaccaccgtggattgtaatatccaggaaaacgttactgctaatgtcacaggacgtgtagaccctgccatcaaattcgtaatatcctagcgggacttcactagtcatttcacaatgcgtgtgcaccctttgatattattcgtattgtcctgaagagatgttactactgatgtcccaatgcagttacctgtgtgtcccctgtggtacctatggaaaccagttgttgggaaatccttgttaagaaaatgggccttgtaatagtacctcttagggctgctgtgaaggaaggataacatggaagcaacatgcctatcatagtgctttgtgtatgcccctgtcaaccatcactctactttgtgtgtgtgagtttgaccacctgaatctttttggcaccatctcaagtataattcaaatcacgaggcatttgtgcatatcgacaatacacccatcgtggtgtggtggacctcagttttgaggccgagagtcctctggcgccccccacagagctcctggagagactgcccagctatgactggcttcttcaagggggcagaggacagatattcttcccacctttggaggccccagggaggccccaggagcaaaggtcctggccctcgttcctggaacacaggagatgccctccccagttggactgctgagggctttaccactaccgtggcctcagtttctcgcctgcacgttgaggaggctggctggcccgcgtgagtccacaggcccttcccagaagcccccgcctctctgttcggtcccctgcagagtccctgcgatgacggaggaggtggcccgggaagccctcctcagctttgtggactctaagtgctgctacagcagcacggtggctggagacctcgtcatccaggagctgaagcggcagaccctctgcaggtaccgtctggagacctttagtgaatccaggataagcgagtggacatttcaaccctttactaaccactctgtggatgggccgcaaagaggcgcctcccccaggctctgggacatcaaggttcaaggtcctccgatgtttcaggaagacaccaggaagttccaggtccctcactcgtcactggtcaaggaatgccacaaatgccatgggcgtgggcggtacaagtgcagcggctgccacggggcgggcacggtgcggtgcccatcctgctgcggagccaagcgcaaagccaagcagtcccggagatgtcagctgtgcgcggggtccggcaggcgaagatgcagcacttgctcagggagagggaacaagacctgcgccacctgcaagggggagaagaagctgttgcacttcatccagcttgtcatcatgtggaagaacagcttgtttgagtttgtgtctgagcaccggctcaactgccccagggagctccttgctaaagccaaaggagaaaacctctttaaggatgaaaactcggtggtgtaccccatcgtggacttccctctgcgagacatctctcttgcctcccagaggggcattgcagagcacagcgctgccttggcctcccgtgcccgcgtcctgcagcagcgccagaccattgagctgatccccctcacagaagttcactattggtaccaaggaaagacttatgtctactacatctatggcactgaccaccaggtgtatgcggtggactatcctgagcggtattgctgtggctgtaccatcgtgtgacatagcatggctgtccccagagcctgccattcacgtttgccaaggaagatggccgacactctctgagtgtgttcactgttggctgcattggacaatcacatacaaaccctggcatgtccttccagaaaaaccagcttatcatctatcaagctccaaccccttatacagctcctctggtggaatccatgactcatatgtttaacctacaataattcagctatacacattcctgtagaacaaatgagagaaataatttaaatggcaaggactttg

SEQ ID NO: 186416 - DNA, 1799 bp, Homo sapiens
  Payload ID: 16717
  Gene Symbol: SSUH2
  Gene Name: ssu-2 homolog (C. elegans)
  Uniprot ID: Q9Y2M2
  ENST ID: ENST00000341795
  CDS Start-End: 270-1331
atgcgggacacgctgtagaacagctcacactggctggcactgctaagcaggtgcggaggggagtcagagacccccggatggaggggtgtggtggacctcagttttgaggccgagagtcctctggcgccccccacagagctcctggagagactgcccagctatgactggcttcttcaagggggcagaggacagatattcttcccacctttggaggccccagggaggccccaggagcaaaggtcctggccctcgttcctggaacacaggagatgccctccccagttggactgctgagggctttaccactaccgtggcctcagtttctcgcctgcacgttgaggaggctggctggcccgcgtgagtccacaggcccttcccagaagcccccgcctctctgttcggtcccctgcagagtccctgcgatgacggaggaggtggcccgggaagccctcctcagctttgtggactctaagtgctgctacagcagcacggtggctggagacctcgtcatccaggagctgaagcggcagaccctctgcaggtaccgtctggagacctttagtgaatccaggataagcgagtggacatttcaaccctttactaaccactctgtggatgggccgcaaagaggcgcctcccccaggctctgggacatcaaggttcaaggtcctccgatgtttcaggaagacaccaggaagttccaggtccctcactcgtcactggtcaaggaatgccacaaatgccatgggcgtgggcggtacaagtgcagcggctgccacggggcgggcacggtgcggtgcccatcctgctgcggagccaagcgcaaagccaagcagtcccggagatgtcagctgtgcgcggggtccggcaggcgaagatgcagcacttgctcagggagagggaacaagacctgcgccacctgcaagggggagaagaagctgttgcacttcatccagcttgtcatcatgtggaagaacagcttgtttgagtttgtgtctgagcaccggctcaactgccccagggagctccttgctaaagccaaaggagaaaacctctttaaggatgaaaactcggtggtgtaccccatcgtggacttccctctgcgagacatctctcttgcctcccagaggggcattgcagagcacagcgctgccttggcctcccgtgcccgcgtcctgcagcagcgccagaccattgagctgatccccctcacagaagttcactattggtaccaaggaaagacttatgtctactacatctatggcactgaccaccaggtgtatgcggtggactatcctgagcggtattgctgtggctgtaccatcgtgtgacatagcatggctgtccccagagcctgccattcacgtttgccaaggaagatggccgacactctctgagtgtgttcactgttggctgcattggacaatcacatacaaaccctggcatgtccttccagaaaaaccagcttatcatctatcaagctccaaccccttatacagctcctctggtggaatccatgactcatatgtttaacctacaataattcagctatacacattcctgtagaacaaatgagagaaataatttaaatggcaaggactttgcctctggtctccaagttaatgccccgatgatgcgtgtgatttgattttgctttttccctttgtcggtcttggttctggtgtgcttcttctagtgggagcctcttgacgatctgagtattactgaaatgttcaaggatacacacaaatatctggccctaatgcacaataaatactgcacttaggcataaagtgcaa

SEQ ID NO: 186417 - DNA, 1874 bp, Homo sapiens
  Payload ID: 16717
  Gene Symbol: SSUH2
  Gene Name: ssu-2 homolog (C. elegans)
  ENST ID: ENST00000413305
  CDS Start-End: 37-507
gaagggcagacatctctttggcaggacgtctggaacatggacagggatctgaatgaagatgacagtgtggtggacctcagttttgaggccgagagtcctctggcgccccccacagagctcctggagagactgcccagctatgactggcttcttcaagggggcagaggacagatattcttcccacctttggaggccccagggaggccccaggagcaaaggtcctggccctcgttcctggaacacaggaagaaccctgcttcctccggggagtcatctctggcctctccagcccacagtgtctcttgtgctgccatccatggatctgaagacagacgggcccctctgtgtgccagggctggaggatgctggagatacaagtgtgcagaattgtggattaatggctctcagggctgccatggagaaatgcatgaagatgcaaggggaggaaggaggattctttcctcttggaggtgttggggccagaaagacttcaagtccctgcgatgacggaggaggtggcccgggaagccctcctcagctttgtggactctaagtgctgctacagcagcacggtggctggagacctcgtcatccaggagctgaagcggcagaccctctgcaggtaccgtctggagacctttagtgaatccaggataagcgagtggacatttcaaccctttactaaccactctgtggatgggccgcaaagaggcgcctcccccaggctctgggacatcaaggttcaaggtcctccgatgtttcaggaagacaccaggaagttccaggtccctcactcgtcactggtcaaggaatgccacaaatgccatgggcgtgggcggtacaagtgcagcggctgccacggggcgggcacggtgcggtgcccatcctgctgcggagccaagcgcaaagccaagcagtcccggagatgtcagctgtgcgcggggtccggcaggcgaagatgcagcacttgctcagggagagggaacaagacctgcgccacctgcaagggggagaagaagctgttgcacttcatccagcttgtcatcatgtggaagaacagcttgtttgagtttgtgtctgagcaccggctcaactgccccagggagctccttgctaaagccaaaggagaaaacctctttaaggatgaaaactcggtggtgtaccccatcgtggacttccctctgcgagacatctctcttgcctcccagaggggcattgcagagcacagcgctgccttggcctcccgtgcccgcgtcctgcagcagcgccagaccattgagctgatccccctcacagaagttcactattggtaccaaggaaagacttatgtctactacatctatggcactgaccaccaggtgtatgcggtggactatcctgagcggtattgctgtggctgtaccatcgtgtgacatagcatggctgtccccagagcctgccattcacgtttgccaaggaagatggccgacactctctgagtgtgttcactgttggctgcattggacaatcacatacaaaccctggcatgtccttccagaaaaaccagcttatcatctatcaagctccaaccccttatacagctcctctggtggaatccatgactcatatgtttaacctacaataattcagctatacacattcctgtagaacaaatgagagaaataatttaaatggcaaggactttgcctctggtctccaagttaatgccccgatgatgcgtgtgatttgattttgctttttccctttgtcggtcttggttctggtgtgcttcttctagtgggagcctcttgacgatctgagtattactgaaatgttcaaggatacacacaaatatctggccctaatgcacaataaatactgcacttaggcataaa

SEQ ID NO: 186418 - DNA, 3219 bp, Homo sapiens
  Payload ID: 16717
  Gene Symbol: SSUH2
  Gene Name: ssu-2 homolog (C. elegans)
  ENST ID: ENST00000455157
  CDS Start-End: 334-588
agtctagaaaaccccacagctcctaagaattctctcacctgccttctgcccttaggctccgatagattgcaaatgacctgctttctttctgatcccgggctgctgagttcggacccctgttggatagtaaatcccaagtaaggtacctgccttcggcagctctgagatttcttcttggacacctaatacccacagtcctccaggaaaacgttactgctaatgtcacaggacgtgtagaccctgccatcaaattcgtaatatcctagcgggacttcactagtcatttcacaatgcgtgtgcaccctttgatattattcgtattgtcctgaagagatgttactactgatgtcccaatgcagaaagcagttccctcctttgtgcagtgcagctagaagaaaacaacattgtcttgggacacgcatcattactaagaatttttccgtaaatttatctgtgtgccttctacagttacctgtgtgtcccctgtggtacctatggaaaccagttgttgggaaatccttgttaaggtatctgatgaatctccatatctcttacactgcacacaataaatacccattgaatgaatgaatacatatatggatggatggacagacggatgatgcatggtagatggatgaatactggatcccatgcccattgagggtttgggtcaggggactgatgtgagcagacacacagaagcacgggcagcccccggcctccagcagattcttccaacccagctggaaagacatgatatggacttgggaattctctaactctgaaaggccccctctgctgaggtgtcccatgttcacagacagtgtgcatgaccagagaaaatgggccttgtaatagtacctcttagggctgctgtgaaggaaggataacatggaagcaacatgcctatcatagtgctttgtgtatgcccctgtcaaccatcactctactttgtgtgtgtgagtttgaccacctgaatctttttggcaccatctcaagtataattcaaatcacgaggcatttgtgcatatcgacaatacacccatcgtggtgtggtggacctcagttttgaggccgagagtcctctggcgccccccacagagctcctggagagactgcccagctatgactggcttcttcaagggggcagaggacagatattcttcccacctttggaggccccagggaggccccaggagcaaaggtcctggccctcgttcctggaacacagagtccctgcgatgacggaggaggtggcccgggaagccctcctcagctttgtggactctaagtgctgctacagcagcacggtggctggagacctcgtcatccaggagctgaagcggcagaccctctgcaggtaccgtctggagacctttagtgaatccaggataagcgagtggacatttcaaccctttactaaccactctgtggatgggccgcaaagaggcgcctcccccaggctctgggacatcaaggttcaaggtcctccgatgtttcaggaagacaccaggaagttccaggtccctcactcgtcactggtcaaggaatgccacaaatgccatgggcgtgggcggtacaagtgcagcggctgccacggggcgggcacggtgcggtgcccatcctgctgcggagccaagcgcaaagccaagcagtcccggagatgtcagctgtgcgcggggtccggcaggcgaaggtaggggcatctccccagcaccgcggtgaagtgctcttgctttctggcttttcattgcctgcccatctggaaggcaaacaggaacccatctgtctcgtcactgctgtgtccccagagctctgcacgtagtaggtgctctgtggttatttgaagagtaggtgagcttttctcaaggcctggcatttctggacaaggctggaactcgtcatgcaatatatgtggaaagagtgtgaagaaagagccactgcagggaggaaacacagggacggggttaccaggaaaggagacctctcccgcccacgggttgggaagtgaatatcaaaaaccacctaaaggccagatttttaactcactgaggatcagttcctgggcaagcccctatttataactcattttggggtctgaatggaggaggagtcaaggaaagttggttgattgactaaacaataaacaaaatttcatcactgctcacagctttgcaaacactgggccattgcattttgtaaatcctatcctttagtgtatttataactttttaagggaaacaggaaaccgtgaggagtaaaaatactcaaggttgggttggttaatgatacttttgcctcattaaagcccaggccatccttctgacaagccagttggagaagctttggtggcaccttccatcgtggttggtagagacagtctctgactgggaaaaagacacttatttttctttcatttgcaagtgaaaggaatccaattcaaattggctttggcaaaaaaagtcgatttacaggcctagatgcagcacttgctcagggagagggaacaagacctgcgccacctgcaagggggagaagaagctgttgcacttcatccagcttgtcatcatgtggaagaacagcttgtttgagtttgtgtctgagcaccggctcaactgccccagggagctccttgctaaagccaaaggagaaaacctctttaaggatgaaaactcggtggtgtaccccatcgtggacttccctctgcgagacatctctcttgcctcccagaggggcattgcagagcacagcgctgccttggcctcccgtgcccgcgtcctgcagcagcgccagaccattgagctgatccccctcacagaagttcactattggtaccaaggaaagacttatgtctactacatctatggcactgaccaccaggtgtatgcggtggactatcctgagcggtattgctgtggctgtaccatcgtgtgacatagcatggctgtccccagagcctgccattcacgtttgccaaggaagatggccgacactctctgagtgtgttcactgttggctgcattggacaatcacatacaaaccctggcatgtccttccagaaaaaccagcttatcatctatcaagctccaaccccttatacagctcctctggtggaatccatgactcatatgtttaacctacaataattcagctatacacattcctgtagaacaaatgagagaaataatttaaatggcaaggactttgcctctggtctcc

SEQ ID NO: 186419 - DNA, 1634 bp, Homo sapiens
  Payload ID: 16717
  Gene Symbol: SSUH2
  Gene Name: ssu-2 homolog (C. elegans)
  ENST ID: ENST00000420394
  CDS Start-End: 148-267
tgtagaacagctcacactggctggcactgctaagcaggtgcggaggggagtcagagacccccggatggaggggtgtggtggacctcagttttgaggccgagagtcctctggcgccccccacagagctcctggagagactgcccagctatgactggcttcttcaagggggcagaggacagatattcttcccacctttggaggccccagggaggccccaggagcaaaggtcctggccctcgttcctggaacacagagtccctgcgatgacggaggaggtggcccgggaagccctcctcagctttgtggactctaagtgctgctacagcagcacggtggctggagacctcgtcatccaggagctgaagcggcagaccctctgcaggtaccgtctggagacctttagtgaatccaggataagcgagtggacatttcaaccctttactaaccactctgtggatgggccgcaaagaggcgcctcccccaggctctgggacatcaaggttcaaggtcctccgatgtttcaggaagacaccaggaagttccaggtccctcactcgtcactggtcaaggaatgccacaaatgccatgggcgtgggcggtacaagtgcagcggctgccacggggcgggcacggtgcggtgcccatcctgctgcggagccaagcgcaaagccaagcagtcccggagatgtcagctgtgcgcggggtccggcaggcgaagatgcagcacttgctcagggagagggaacaagacctgcgccacctgcaagggggagaagaagctgttgcacttcatccagcttgtcatcatgtggaagaacagcttgtttgagtttgtgtctgagcaccggctcaactgccccagggagctccttgctaaagccaaaggagaaaacctctttaaggatgaaaactcggtggtgtaccccatcgtggacttccctctgcgagacatctctcttgcctcccagaggggcattgcagagcacagcgctgccttggcctcccgtgcccgcgtcctgcagcagcgccagaccattgagctgatccccctcacagaagttcactattggtaccaaggaaagacttatgtctactacatctatggcactgaccaccaggtgtatgcggtggactatcctgagcggtattgctgtggctgtaccatcgtgtgacatagcatggctgtccccagagcctgccattcacgtttgccaaggaagatggccgacactctctgagtgtgttcactgttggctgcattggacaatcacatacaaaccctggcatgtccttccagaaaaaccagcttatcatctatcaagctccaaccccttatacagctcctctggtggaatccatgactcatatgtttaacctacaataattcagctatacacattcctgtagaacaaatgagagaaataatttaaatggcaaggactttgcctctggtctccaagttaatgccccgatgatgcgtgtgatttgattttgctttttccctttgtcggtcttggttctggtgtgcttcttctagtgggagcctcttgacgatctgagtattactgaaatgttcaaggatacacacaaatatctggccctaatgcacaataaatactgcacttaggcataaa

SEQ ID NO: 186420 - DNA, 559 bp, Homo sapiens
  Payload ID: 16717
  Gene Symbol: SSUH2
  Gene Name: ssu-2 homolog (C. elegans)
  ENST ID: ENST00000427408
  CDS Start-End: 41-559
actcgaagggcagacatctctttggcaggacgtctggaacatggacagggatctgaatgaagatgacagtgtggtggacctcagttttgaggccgagagtcctctggcgccccccacagagctcctggagagactgcccagctatgactggcttcttcaagggggcagaggacagatattcttcccacctttggaggccccagggaggccccaggagcaaaggtcctggccctcgttcctggaacacagagtccctgcgatgacggaggaggtggcccgggaagccctcctcagctttgtggactctaagtgctgctacagcagcacggtggctggagacctcgtcatccaggagctgaagcggcagaccctctgcaggtaccgtctggagacctttagtgaatccaggataagcgagtggacatttcaaccctttactaaccactctgtggatgggccgcaaagaggcgcctcccccaggctctgggacatcaaggttcaaggtcctccgatgtttcaggaagacaccaggaagttccaggtccctcactcgtcactg

SEQ ID NO: 186421 - DNA, 1645 bp, Homo sapiens
  Payload ID: 16717
  Gene Symbol: SSUH2
  Gene Name: ssu-2 homolog (C. elegans)
  ENST ID: ENST00000415132
  CDS Start-End: 227-1174
ataacatggaagcaacatgcctatcatagtgctttgtgtatggtgtggtggacctcagttttgaggccgagagtcctctggcgccccccacagagctcctggagagactgcccagctatgactggcttcttcaagggggcagaggacagatattcttcccacctttggaggccccagggaggccccaggagcaaaggtcctggccctcgttcctggaacacaggagatgccctccccagttggactgctgagggctttaccactaccgtggcctcagtttctcgcctgcacgttgaggaggctggctggcccgcgtgagtccacaggcccttcccagaagcccccgcctctctgttcggtcccctgcagagtccctgcgatgacggaggaggtggcccgggaagccctcctcagctttgtggactctaagtgctgctacagcagcacggtggctggagacctcgtcatccaggagctgaagcggcagaccctctgcaggtaccgtctggagacctttagtgaatccaggataagcgagtggacatttcaaccctttactaaccactctgtggatgggccgcaaagaggcgcctcccccaggctctgggacatcaaggttcaaggtcctccgatgtttcaggaagacaccaggaagttccaggtccctcactcgtcactggtcaaggaatgccacaaatgccatgggcgtgggcggtacaagtgcagcggctgccacggggcgggcacggtgcggtgcccatcctgctgcggagccaagcgcaaagccaagcagtcccggagatgtcagctgtgcgcggggtccggcaggcgaagatgcagcacttgctcagggagagggaacaagacctgcgccacctgcaagggggagaagaagctgttgcacttcatccagcttgtcatcatgtggaagaacagcttgtttgagtttgtgtctgagcaccggctcaactgccccagggagctccttgctaaagccaaaggagaaaacctctttaaggatgaaaactcggtggtgtaccccatcgtggacttccctctgcgagacatctctcttgcctcccagaggggcattgcagagcacagcgctgccttggcctcccgtgcccgcgtcctgcagcaggtgagccagggcggaggggccatctggctctgacgtctcttcctgggctgctgagccctctttcctgagaacgtcggagcggaaggatgaggacgtagagcgccagaccattgagctgatccccctcacagaagttcactattggtaccaaggaaagacttatgtctactacatctatggcactgaccaccaggtgtatgcggtggactatcctgagcggtattgctgtggctgtaccatcgtgtgacatagcatggctgtccccagagcctgccattcacgtttgccaaggaagatggccgacactctctgagtgtgttcactgttggctgcattggacaatcacatacaaaccctggcatgtccttccagaaaaaccagcttatcatctatcaagctccaaccccttatacagctcctctggtggaatccatgactcatatgtttaacctacaataattcagctatacacattcctgtagaacaaatgagagaaataattta

SEQ ID NO: 186422 - DNA, 2632 bp, Homo sapiens
  Payload ID: 16717
  Gene Symbol: SSUH2
  Gene Name: ssu-2 homolog (C. elegans)
  ENST ID: ENST00000435138
  CDS Start-End: 268-525
atgtttcaccatgaggtttagaggggacacagatccagaccatatcatcgccccagggattccgactccccaagtctggagtggggcctaaggctctgtatttctaacaagctccctgttgagcccaagctgctgctgttcctaggcaccgctgaccaacacaacacgctcgttcaaccccctcaaggtgctctgaagattcctcgaaaatacatctgagaaattcttttgacatcccggattattctccagcctacttagttataaatgagtctgcgtgtgtctcagtctgtgctgataagacggatggagtcctcctttccttacagtaacggtctcactctgttgctcactgacgctggtcttgatcttctgggctcaagcagtcttctcacctcagcctcccaaagtgctgggatcacagacgtgagctaccgatcccagctaccattgttcttaatcaatggtatcaatgtttttttaaatggaggaagaggtaacatttgccagttatatctttgttgaatgcacgggctctgaggattagacaccaggcattgtgctaaacacatcgtatccgctgtcactggatcgccaccatgactctcagaagaagaagggatgctcattccacccactgagatggctttcaaatcgacagtagaatccagcacatattctgtctttggaaaattgctccaggtgtatcctcagaacaatccagccccgtcgtcactttccacagccactgcttggcacctgcggtagctctgagaggctccgttatgcgtgtggcatcagcctttttttctagcagccttgggctccgatagattgcaaatgacctgctttctttctgatcccgggctgctgagttcggacccctgttggatagtaaatcccaagtaaggtacctgccttcggcagctctgagatttcttcttggacacctaatacccacagtcctccagttacctgtgtgtcccctgtggtacctatggaaaccagttgttgggaaatccttgttaagaaaatgggccttgtaatagtacctcttagggctgctgtgaaggaaggataacatggaagcaacatgcctatcatagtgctttgtgtatggtgtggtggacctcagttttgaggccgagagtcctctggcgccccccacagagctcctggagagactgcccagctatgactggcttcttcaagggggcagaggacagatattcttcccacctttggaggccccagggaggccccaggagcaaaggtcctggccctcgttcctggaacacaggagatgccctccccagttggactgctgagggctttaccactaccgtggcctcagtttctcgcctgcacgttgaggaggctggctggcccgcgtgagtccacaggcccttcccagaagcccccgcctctctgttcggtcccctgcagagtccctgcgatgacggaggaggtggcccgggaagccctcctcagctttgtggactctaagtgctgctacagcagcacggtggctggagacctcgtcatccaggagctgaagcggcagaccctctgcaggtaccgtctggagacctttagtgaatccaggataagcgagtggacatttcaaccctttactaaccactctgtggatgggccgcaaagaggcgcctcccccaggctctgggacatcaaggttcaaggtcctccgatgtttcaggaagacaccaggaagttccaggtccctcactcgtcactggtcaaggaatgccacaaatgccatgggcgtgggcggtacaagtgcagcggctgccacggggcgggcacggtgcggtgcccatcctgctgcggagccaagcgcaaagccaagcagtcccggagatgtcagctgtgcgcggggtccggcaggcgaagatgcagcacttgctcagggagagggaacaagacctgcgccacctgcaagggggagaagaagctgttgcacttcatccagcttgtcatcatgtggaagaacagcttgtttgagtttgtgtctgagcaccggctcaactgccccagggagctccttgctaaagccaaaggagaaaacctctttaaggatgaaaactcggtggtgtaccccatcgtggacttccctctgcgagacatctctcttgcctcccagaggggcattgcagagcacagcgctgccttggcctcccgtgcccgcgtcctgcagcagcgccagaccattgagctgatccccctcacagaagttcactattggtaccaaggaaagacttatgtctactacatctatggcactgaccaccaggtgtatgcggtggactatcctgagcggtattgctgtggctgtaccatcgtgtgacatagcatggctgtccccagagcctgccattcacgtttgccaaggaagatggccgacactctctgagtgtgttcactgttggctgcattggacaatcacatacaaaccctggcatgtccttccagaaaaaccagcttatcatctatcaagctccaaccccttatacagctcctctggtggaatccatgactcatatgtttaacctacaataattcagctatacacattcctgtagaacaaatgagagaaataatttaaatggcaagg

SEQ ID NO: 186423 - DNA, 1636 bp, Homo sapiens
  Payload ID: 16717
  Gene Symbol: SSUH2
  Gene Name: ssu-2 homolog (C. elegans)
  Uniprot ID: Q9Y2M2
  ENST ID: ENST00000544814
  CDS Start-End: 41-1168
actcgaagggcagacatctctttggcaggacgtctggaacatggacagggatctgaatgaagatgacagtgtggtggacctcagttttgaggccgagagtcctctggcgccccccacagagctcctggagagactgcccagctatgactggcttcttcaagggggcagaggacagatattcttcccacctttggaggccccagggaggccccaggagcaaaggtcctggccctcgttcctggaacacagagtccctgcgatgacggaggaggtggcccgggaagccctcctcagctttgtggactctaagtgctgctacagcagcacggtggctggagacctcgtcatccaggagctgaagcggcagaccctctgcaggtaccgtctggagacctttagtgaatccaggataagcgagtggacatttcaaccctttactaaccactctgtggatgggccgcaaagaggcgcctcccccaggctctgggacatcaaggttcaaggtcctccgatgtttcaggaagacaccaggaagttccaggtccctcactcgtcactggtcaaggaatgccacaaatgccatgggcgtgggcggtacaagtgcagcggctgccacggggcgggcacggtgcggtgcccatcctgctgcggagccaagcgcaaagccaagcagtcccggagatgtcagctgtgcgcggggtccggcaggcgaagatgcagcacttgctcagggagagggaacaagacctgcgccacctgcaagggggagaagaagctgttgcacttcatccagcttgtcatcatgtggaagaacagcttgtttgagtttgtgtctgagcaccggctcaactgccccagggagctccttgctaaagccaaaggagaaaacctctttaaggatgaaaactcggtggtgtaccccatcgtggacttccctctgcgagacatctctcttgcctcccagaggggcattgcagagcacagcgctgccttggcctcccgtgcccgcgtcctgcagcagcgccagaccattgagctgatccccctcacagaagttcactattggtaccaaggaaagacttatgtctactacatctatggcactgaccaccaggtgtatgcggtggactatcctgagcggtattgctgtggctgtaccatcgtgtgacatagcatggctgtccccagagcctgccattcacgtttgccaaggaagatggccgacactctctgagtgtgttcactgttggctgcattggacaatcacatacaaaccctggcatgtccttccagaaaaaccagcttatcatctatcaagctccaaccccttatacagctcctctggtggaatccatgactcatatgtttaacctacaataattcagctatacacattcctgtagaacaaatgagagaaataatttaaatggcaaggactttgcctctggtctccaagttaatgccccgatgatgcgtgtgatttgattttgctttttccctttgtcggtcttggttctggtgtgcttcttctagtgggagcctcttgacgatctgagtattactgaaatgttcaaggatacacacaaatatctggccctaatgcacaataaatactgcacttaggcataaagtgcaa

SEQ ID NO: 186424 - DNA, 1290 bp, Homo sapiens
  Payload ID: 16718
  Gene Symbol: SSU72
  Gene Name: SSU72 homolog, RNA polymerase II CTD phosphatase
  Uniprot ID: Q9NP77
  ENST ID: ENST00000291386
  CDS Start-End: 313-897
ggcgccgtgacgctcagccgggccttgtggagtgcgggtctctgctgcggacgccgggggccggcgcggcgttggccgcccccggcctcgccgagtgcagcgcgcccgaaggccagtgcctgcgctccgtccgcggcccggcgcccagggtgggcggggaggccgccgcgcagtcgccgcacgctacaccgccggcgccgtcgtttcgcgtcgcccgcttccggccaccgcggccgccattttgttcgcgcggaagcgccgcggtagggtgggaacccaagcgggagagccgcgggatttgcggccgccgccatgccgtcgtccccgctgcgggtggcggtggtgtgctcgagcaaccagaaccggagcatggaggcgcacaacatcctcagcaaacggggattcagcgtccgatcctttggaacagggactcacgtgaagcttccaggaccagctcccgacaagcccaatgtttatgatttcaaaaccacatatgaccagatgtacaatgatcttcttaggaaagacaaagaactctatacacagaatgggattttacatatgctggacagaaataagagaatcaagccccggccagaaagattccagaactgcaaagacctgtttgatctgatcctcacttgcgaagagagagtgtatgaccaggtggtggaagatctgaattccagagaacaggagacctgccagcctgtgcacgtggtcaatgtggacatccaggacaaccacgaggaggccaccctgggggcgtttctcatctgtgagctctgccagtgtatccagcacacggaagacatggagaacgagatcgacgagctgctgcaggagttcgaggagaagagtggccgcacctttctgcacaccgtctgcttctactgagcccagcgcccgcatggagccgcctctggagcttcctgttgttcatactttttccttcctgacatttgtttttacttacaggtgttctgctggtgacggtagcattacccaaataaactgtgcatatgaaatgggagaggagatgccaaaacgccagatgaaagcaatcaagtttcttcttttccacttttacttatgagcaggatattgattacaaagtttttcttctttaaccaaaaaggaaagacaacggtttgtgtgcacttcccgacatacctgtgtcttcgtgtgcctgccttccctccctcctccccaccgggccggactgtacagagccctgctgcggcgtgttaggaatgacctggaattgtcaataaacagatgctgctgtca

SEQ ID NO: 186425 - DNA, 4176 bp, Homo sapiens
  Payload ID: 16718
  Gene Symbol: SSU72
  Gene Name: SSU72 homolog, RNA polymerase II CTD phosphatase
  Uniprot ID: Q9NP77
  ENST ID: ENST00000359060
  CDS Start-End: 28-489
agagccgcgggatttgcggccgccgccatgccgtcgtccccgctgcgggtggcggtggtgtgctcgagcaaccagaaccggagcatggaggcgcacaacatcctcagcaaacggggattcagcgtccgatcctttggaacagggactcacgtgaagcttccaggaccagctcccgacaagcccaatgtttatgatttcaaaaccacatatgaccagatgtacaatgatcttcttaggaaagacaaagaactgtatcccagcgggttgccctttaaaaaccccccgtgtggtcctccctggaaggtgttacgtgtggctcgggcacaggaggcgtgtcaccctgtgcagtgcacacactggctcctctgtctttgcgagagcttggtttctattcctggtgcacgtcggatcgtccacgggttagttccagtgccacccatggcagtaggcgtggtgaggcgcacagacacggtgtggggttcaccctgacgtggttcagcagagggtcgtgacatagcgtagaccagggatgcttaggtgaggaggtggaacccacaaaatcccattgcttttcacactgcagggctgccccgttatttcctttgcaggttggtgtgcgtgcgtgtgtgcgtgcgtgcctgatacacatggagccgggctgcttcacacatctggtgaggtcgttagaaggtcagataaagaagagggcggagcttgctaaccaagctgttagaagaaataatgggagagaacattccttcatttcaggaggacacagagcaggctaggtctgccgcgaagactcctatagagagaagagtattcttaaactagattctgatggacgcaacaccagttgcataatggttatgacaatcagtgcccgggtttttgaccaggcatttcatggtcacccccacgctaatggaaagtttctggatcttattttgttatagtgagtgatttgtagttttcagaacggaggccaggccaaacgtattccaaatgaaaagagaataggtgtcaaatgctaaaccttttatcttcgtgttggcactgttgccatccccgccctctcccgacatccccgcccttgaccagcatctctggccttgcccagcattgtctatgtattggcactcttgccatccccgccctttcccagcagagtctcactgtgtcaccccggctggagtgcagtggcgagatcttggctcactgcagactcactgcaacatccacctcccgggttccagtgattctcctgcttcagcctcctgggtagctgggattacaggcacgcgccaccacacctggctaatttttgtatttttagtagtcacagggtttcaccatgttggccaggctggtcttaaactcctgacttcaggtgatccaccctcctcgtcctcccaaagtgctgggattacaggcgtgagccaccatgctcagccctactcttgtatttttttttttttttttttttgagatggagtcagagtctcaccctgttgcccaaggtggagtgtagcggcttgatctcagctcactgcaacctccccctcccaagttcaagcgattctctgcctcagcctcccgaatagctgggattacaggcatccgctgtcatgcctggctaatttttgtatttttagtagagacgggggtttcaccatcttgaccaaactggtcttgaactcttgacctcgtgatccagctgcctcggcctctcagagtgttgggattacaggcgtgagccaccatgcctggcctcttggaatatttaataagctaaaaaattcttatacacaggtagattaattaggtagccaggagtggcccctgaaagtatgtctggcaaaacctagaactgcatcctagccatcactgtaccttctgccctccctgctgtctcctctgccagttacagttaaaaggttgtgggtgaggacgctgggcagagtcccaggcgtctgctgtcagctccccagcccggcctgcctgccgagccatctgggcgtcccacggtggagagtgtggtgcttgtgacgcggtggtgctgggagccatcctggtggcagatgtgggctctcactgcaagtcagtgtaagtccccagggactgtcagcagcacgtcctgctgcccctctctctgcagaagccctggtaacctgcgtttggaaaaatctctaaggatttctgaggagctgtcaggccatgtccttgtccaccctgtgtggggcacggcttcgacatggctctgctcccgtcgtgggctgagaaggagcaggtggggctgtgccttggaaaggaggccctcccgacatgcctttgtgcgaggtccctgtccatgctgtctccatcccggagccttacggcgatgggtggccacagagcctattccaagagtctggtttagggctgggtcttcccatcttcacctctgagtcttaggcgatgcgtgaccacgcagccccttccaggagtctggtttagggctgggtcttcccatcttcacctctgagtcttaggcggtgcatgaccacgcagccccttcccggagtctggtttagggctgcgtgctcaagagtctggtttggggctgggtcttcccatcgccctggaggaggcttttgtctcatctcatgattcacattaaactctgtgccatgaagcttagcctgacatcctgtttttgacaattactcttcagttagcactgtttatttttaagttcttgtatattcagtaagagaaagaaaagcagagagtgacgcacatcctcacactcccttgattggtgtaagctcagccccttcatgtcagcccactgtgacctcctgggttccagacctgggaagtacttgccacgttctgcaaggactgagtccagcttcagcagtctcatccggaaggacttggtataggcagaggatgagcctgtctctggtcattctaaaagaaggagctgagcccagtgtcccagaattcggaagctcctcctttacagagggactgtaggggttggtgatctcccaggaagcatcggcccagaagaaccccgcgtgcgtgtgtgtgctcttggtgtgtggtggggggaaggagtggcagcaggggtggcgctgggacactgtcagccacgggctctgctttggggacctcgtgtgggaaaggcattgcctgtggtggcccctcaggaggctctaggaggagcgtgccttcattaccttatttcactcggggggcgtctttgccccctaggtgggggcagaaggtgcagaatgggaagcctgccacttagctaaagctcttgcacatgatgcccttggcctggagaggagtgaagtccccaggcagttccctgtggacactggcacgatgccgggtggggcctcaggggtgttgagatgtgcaggtcgggaggaccccgataacgtttcctggttagtgatgggtgcaggggggccgcgggaagtgactgttacaagtgagagcccgaaagcaaatctgccccacagcagccggtgcgttggcagaagtcatcgccgtaaactgcagtggaagcaagacggggttcaagatgcggcccaaagataagacgcagcacttggtcgagtgttcacagcgtcaagacaaaggacgggccggcgcggtgactcaggcctgtaatcccagcactttgggaggccgaggtgggtggatcatgaggtcagaagttagagaccagcctggccaacatagtgaaaccccatttctactaaaaatacaaaaattagccgggcatggtggtgcacgcctgtagtcccagctacttgggaggctgaggcaggagagttgcttgaacctgggaggcagagcctgcagtgagccgagatcgcgctacggcactccagcctgggtgacagagtgagactctgtctcaaaaaaataaaaaaggaaggacagtgtgacttgggaggaaaatgctgcttgttcagaggcagggccggggtcgagggggaccccaccactgccatctgcctacttgccatgtggccagggcttaggtttctctgtgcatgcccacctcgcagaatttctgataattaaataaattaggacatgcacacactgagcccgagacagtgttttaaagccttcaataaattttggccagttgtcctattagtattgaaa

SEQ ID NO: 186426 - DNA, 859 bp, Homo sapiens
  Payload ID: 16719
  Gene Symbol: ST20-MTHFS
  Gene Name: ST20-MTHFS readthrough
  ENST ID: ENST00000479961
  CDS Start-End: 305-844
ggagggaagatggctgcagagaccggatattggcgctgcctccccgaatcccggacctgcgctgaggaggcggttcatctgtggccagcggtgcttcgggacccgcgctgggggaaccctggcgacggggcctggccctgctatatgcgggggcctcggctggagtgagcggcgtggacgcctctttcctccggctcttcccttgttgctgcgagagcgagagggccgcgggcggcggaggcagcggggccgggatggaggacgttaactctaacgtgaacgcggaccaggaggctggagtgcaatggcgcgatctcggctcactgcaacctctgtctcccaggttcaggtgattgcccacagtgagtatcaaaagtccaaaagaatttccatctttctgagcatgcaagatgaaattgagacagaagagatcatcaaggacattttccaacgaggcaaaatctgcttcatccctcggtaccggttccagagcaatcacatggatatggtgagaatagaatcaccagaggaaatttctttacttcccaaaacatcctggaatatccctcagcctggtgagggtgatgttcgggaggaggccttgtccacagggggacttgatctcatcttcatgccaggccttgggtttgacaaacatggcaaccgactggggaggggcaagggctactatgatgcctatctgaagcgctgtttgcagcatcaggaagtgaagccctacaccctggcgttggctttcaaagaacagatttgcctccaggtcccagtgaatgaaaacgacatgaaggtagatgaagtcctttacgaagactcgtcaacagcttaaatctggattactaca

SEQ ID NO: 186427 - DNA, 632 bp, Homo sapiens
  Payload ID: 16719
  Gene Symbol: ST20-MTHFS
  Gene Name: ST20-MTHFS readthrough
  ENST ID: ENST00000494999
  CDS Start-End: 265-632
gcggagggacggagggaagatggctgcagagaccggatattggcgctgcctccccgaatcccggacctgcgctgaggaggcggttcatctgtggccagcggtgcttcgggacccgcgctgggggaaccctggcgacggggcctggccctgctatatgcgggggcctcggctggagtgagcggcgtggacgcctctttcctccggctcttcccttgttgctgcgagagcgagagggccgcgggcggcggaggcagcggggccgggatggaggacgttaactctaacgtgaacgcggaccaggaggtgattgcccacagtgagtatcaaaagtccaaaagaatttccatctttctgagcatgcaagatgaaattgagacagaagagatcatcaaggacattttccaacgaggcaaaatctgcttcatccctcggtaccggttccagagcaatcacatggatatggtgagaatagaatcaccagaggaaatttctttacttcccaaaacatcctggaatatccctcagcctggtgagggtgatgttcgggaggaggccttgtccacagggggacttgatctcatcttcatgccaggccttgggtttgacaaacatggcaaccgactggggagggg

SEQ ID NO: 186428 - DNA, 679 bp, Homo sapiens
  Payload ID: 16719
  Gene Symbol: ST20-MTHFS
  Gene Name: ST20-MTHFS readthrough
  ENST ID: ENST00000615374
  CDS Start-End: 80-619
gccccggtggcggaggacgtcccggaggatccctctggtcgggcgcctggctttgtgtagccagccaggctggagtgcaatggcgcgatctcggctcactgcaacctctgtctcccaggttcaggtgattgcccacagtgagtatcaaaagtccaaaagaatttccatctttctgagcatgcaagatgaaattgagacagaagagatcatcaaggacattttccaacgaggcaaaatctgcttcatccctcggtaccggttccagagcaatcacatggatatggtgagaatagaatcaccagaggaaatttctttacttcccaaaacatcctggaatatccctcagcctggtgagggtgatgttcgggaggaggccttgtccacagggggacttgatctcatcttcatgccaggccttgggtttgacaaacatggcaaccgactggggaggggcaagggctactatgatgcctatctgaagcgctgtttgcagcatcaggaagtgaagccctacaccctggcgttggctttcaaagaacagatttgcctccaggtcccagtgaatgaaaacgacatgaaggtagatgaagtcctttacgaagactcgtcaacagcttaaatctggattactacagccaaataatcagtgttttatatgagagtaaagcaaagtatgtgt

SEQ ID NO: 186429 - DNA, 6764 bp, Homo sapiens
  Payload ID: 16720
  Gene Symbol: ST3GAL1
  Gene Name: ST3 beta-galactoside alpha-2,3-sialyltransferase 1
  Uniprot ID: Q11201
  ENST ID: ENST00000399640
  CDS Start-End: 826-1848
cccgcctcctcgcttcctcggctccagcctccgccggcggagcccactatgccagacagtttcgacactttgcaaagacaaagagccctagaccggagggaggaggaggaggaagaagagcggagagagaaggaagaggcgatgtgagctgggaagggggcaagtgtccgggacacccacacccctgtattctcctccgaaccccttcatgcccaaatcccggaaactccagcgtgtctccagccgtgttggtaccattttcagatttcatcttcctaaactggaaatgtcaatgagaggaaattaacacccccaagagctgcagtgagcaaatgcattgagcttgggtcaggacaattccatttggggaccagagatggacggtcactcagcctatggaggtaaagtgactaatctgaacaaagcagagactccactgatgagaaaagcagatgacagacaaccttctgtgccttcatcaagctggttgtgtacccaccatgtccctggcgacaggatgggaaagaaaaagccctaattaaggatcgtcagaaaccacagttggaggaggacggcagagacagtttccctccccgctataccaacacccttccttcgaggtcctcgctcctgagggaccctggactgtcacagagattaatgaccccttatcttctttggatgtgaaaggaaatcactggttaaagcttgatcgagagacattatcagctctttaaggattgcagaagaataggctactttattttctgaaaaggagggagttcctgctacccatcgtgggaggccaccatcaggactgcgaagatggtgaccctgcggaagaggaccctgaaagtgctcaccttcctcgtgctcttcatcttcctcacctccttcttcctgaactactcccacaccatggtggccaccacctggttccccaagcagatggtcctggagctctccgagaacctgaagagactgatcaagcacaggccttgcacctgcacccactgcatcgggcagcgcaagctctcggcctggttcgatgagaggttcaaccagaccatgcagccgctgctgaccgcccagaacgcgctcttggaggacgacacctaccgatggtggctgaggctccagcgggagaagaagcccaataacttgaatgacaccatcaaggagctgttcagagtggtgcctgggaatgtggaccctatgctggagaagaggtcggtgggctgccggcgctgcgccgttgtgggcaactcgggcaacctgagggagtcttcttatgggcctgagatagacagtcacgactttgtcctcaggatgaacaaggcgcccacggcagggtttgaagctgatgttgggaccaagaccacccaccatctggtgtaccctgagagcttccgggagctgggagataatgtcagcatgatcctggtgcccttcaagaccatcgacttggagtgggtggtgagcgccatcaccacgggcaccatttcccacacctacatcccggttcctgcaaagatcagagtgaaacaggataagatcctgatctaccacccagccttcatcaagtatgtctttgacaactggctgcaagggcacgggcgatacccatctaccggcatcctctcggtcatcttctcaatgcatgtctgcgatgaggtggacttgtacggcttcggggcagacagcaaagggaactggcaccactactgggagaacaacccatccgcgggggcttttcgcaagacgggggtgcacgatgcagactttgagtctaacgtgacggccaccttggcctccatcaataaaatccggatcttcaaggggagatgacgcagtgaagggctgaggatggacgcactgtcacacctctgcatttccagccccagcatcttgctggagccgttccatcccggagcttggaggggcagcctcaggtgtgtgcctgggcaccgctcacagcctcttgcacccagccgttggcagcatctactcagcaaggtcactaagctctgccagcgtggcagagcatgtcttggaacctgtcttgagtggggacaacgtccccccactgctgccctagagctggggagacgctgggaaaggttcaacctccacacactaaaatcattttggctcctggggcaagcttggggaatgaatgtggaagatgcctatattctgagagacaggacagtttcccaggaagatgggcagagacttgagtggcgattacctccagcacagagacgtgccaggcggtgttggcgctcggggcgagatgctgcccttctttgcacgaagcctggcctcttgcttggcgtgataaccctgtcatcttcccaaagctcatttatgagccaccagaggctcctaccccaaagattttcacagaaacttgaggccaggtgccgtggctcacacctgtaatctgaacactttgggaggccgaggcgggaggatcacttgagcccaggagttcaagaccagcctgggcaacatagtgagactcctgtctctacaaaaataaaagatttaaaaaaattagccaggcacggtggcacacacttgtagccccagctactagggaggctgaggagggaggatctcttgtgcctaggagttcgaggctgcagtgggctgtgatcacaccactgcactccagcctgggcaacagagtgagaccctgtctctgaaaaaaaaaaaaaaagaaaagaaaaaaaaccccaaacttggcaccgtgtttctgactcctgcagatgcctcttcccaagcagttgttcctttgagtagtcagtctcatggttctaatcgtggcgagagcggatctgaccacttccatgtgcctttgtatttgggaaagaaaagcatgcattggctgaaatgaaacaaaagcccttacttgggaaaagggacccccaccagcggccctgcttgctccgtagctgggaacatcttttctggtttcctgagccagcacctgaattgcaacgaagctctgaggatactcaacaccacccagcagtgcgtcagaatggaacgtacattctcattctcagactgttcaatatggtgcccgtaacctccaaagccacacaggaggctgccagcagcattttccccaagggcctgagctcagggtcaagtccctgctggccatcttggggctgtcactgggggtctgggtcaaggacatcccaggaatggtaactgccacatacctcatcttcttactccccagctactctcttttcctcattagccttcctgattatttattgatttcttttttttattcaactgacattgtttgcaccctggctctgttggtggtcctggtgttttaatgaagcttgcctcacccagtagctgggaaattaggtgggggtgcttaagggaggtttgtaggagtcctcggacgtgggatattgggggtatctagggcttggatggtttgtggaatgtcctcagcatcctcccgtcccaacccaaccttccttcttcctcattgtggacttggatttattctcaggctaggagtctccaaaactccgtgaaaccttattgctgctgggtgtggagtggagagtgacaggaatgtgggggacggtgattgttggctccagttactaatgtttaagcagaaaaaccactttcttgttgaaaatatccctgaaaaggtcgctgctgctttgaggaggcgtgactttttcctggtggagtgtgacggaggcatggggcctgtgctcccaggctcgggggagccccctctgcacacggggagggaggaacttggggacatcagtcatgggtcacaggtggcttcaggccattcacaagagtccccggaagttgcgtgccaagtttggttttttccctgaatctctgcatatgagcatttttctggagaaaggaccatagcttttattagattctcaaaggttcagaatggggaatgtgttaaacaaaccgaaaacctgtttcagctttaaaatcctccaaaactttaaagacttttcttttttctgagaaaggctggtaaatcactgagtcatcattcagaacatacagcctcgaagggcagagctcacacccatatatgacgttaagagctcaacaaatgtttgttgagtgactgagtgaccccaggggcagactccagatcatcagacactgatacagagagcgatgctatctcctcaactctccctcttctcctaaaagctgagtctatatagggatgacaggctcaggctgagcagtcgacttctctgggttttgctgtgtaagaataggtccctcaacatgaagatgtgtctgcgtctgagccagatgctgcctgggtcggttgcctggcctccgtctggtctccctccctcctactagggtggtcaagctgtgagatctcttccagcctccaaatccagctttcccattttactgatgagaaaatcaaggccacattgcagctgggtggggagtggagcgtgacaggcacgggagaggacagcgattgttgactctagttcctgatgtttaatcagaaaaaccacttttcctgtagagcacatttcctaaaaggctgctgctgtgtagggaggtgtggccttttcctggtgcagtgtgaaggagggaagtgacgggcagtcgtgaactgtctgggacagatagcacaagtcagagtttgagcaaaactagggtgttaccggcgctatgttgaaattgtctggaggcgggctttcccagcgagtctccattcagcatctggaaaaagtgtaaccagaatggaggtgtctgactctcctgtgctctctcagcgccgagctctagctgcaggctgcctgggtggccttctcacaccctcccgtgcaggagactgcatttctctttcccacagcccagcagatagctcattggcttagcaatgggcacttaacagaatccagttgttgcagccagaattaaatgcaccagtctggcttaaaccaactggaactcatccctggggtgaaggtggctgggaattagacaagagtgtgtgttagccaaaaggcacatgcatgctgtcagcaggagaatgaggagcactggttctgggcaggcagtggcaggggctccctcaggcccctgattcccagcccacagctctttctactctgcagacagagttccttggagactggccctgcattcaggcagggagcagaggggtccctgcctgcagcacccagagctgaacctgaagctacaaagatgggctgatgaggtggcccatgaggtgtcagcaacatcccaaccccctgggtctccccagtgagtcagggcactgatttgctatagctggagctacatgcacctctcctcccctcagccaccttttaggggagaaaggagggcagatttgtaacctctggttctctgcagggatcctgggctggaagaaagttcataaatggatgaatgccttttaaaactccagcttttccaagcatcattcaccaaagcatttggttaggcttagagagaaaagctggatatgagaaaatagaatgtaaaataggagggaaaaaaaaaaagaaggtggagagggcagttaagatctgggtgattctttagggaaacggctggttgagaggctttgatggaatcccattctctgctgtggccagaaggtggtgctagaggccagtcccacttggatgtgaccctggcctctgccaggattcaaaccacaaagaacatttggaactgggatgtttgctttgaagcagcccgaaaacaagtgaaaggaaaccaagataactctctctccctccgctggcaaggatcaaaaataccttgtgcagggaagcccgagcctcgaggggccactgcccagctaaagatgactggacaccagccatgcaccatcaggaaccagcacctgtcctcacccctgagaagagccccgggggtatcattatatccatcgcagacatctggtttgcagcaaatgtggctacacgccatcaggattatcctgccctgtggactgggctagctagttttgagatagagtcaacctccccatttttgtttgtcatgaaaacaccagctcctgcacccctggggtgctacctgacacctgtgcaaagaaaaggaggaaaacttagaagaaaaggcagagacaggcaagacagcatctcacagcttgtcaggatcagggcattaccgactattttttcttaccaaaagagcactgaatttcctaggggaaggtgagccacctttacacctcctgtcctccctcccagcccgtcaagcgatcccatcacccagcctcatcactcagcttcttcctagtacaaaactgccatcggttgtacgtcctgagctgtgggacgtcagctttaaccctagcctgtctcagggcctcgccctccagccccccgccccttagggtgatcgtgggtttcttcccttcctcctgcacaatcgcttcccttcactgaattcccttcaaagccaaagtttcttgagcactttttcttgtgtgcagtcttgtgtgtttgggtgttggtgtttttaaatttgctttctattcccccctgcctctctccatgtcgttacgcagctgagcactggttgggatgcattcgaatgacttcagcaagatcctgctttcctcagcccccgctctgttttatttattgtttaatatttccaatgatccaaatcaaagtgaataaacaaagagctattttattgtt

SEQ ID NO: 186430 - DNA, 665 bp, Homo sapiens
  Payload ID: 16720
  Gene Symbol: ST3GAL1
  Gene Name: ST3 beta-galactoside alpha-2,3-sialyltransferase 1
  ENST ID: ENST00000517668
  CDS Start-End: 526-665
cctcggctccagcctccgccggcggagcccactatgccagacagtttcgacactttgcaaagacaaagagccctagaccggagggaggaggaggaggaagaagagcggagagagaaggaagaggcgatgtgagctgggaagggggcaagtgtccgggacacccacacccctgtattctcctccgaaccccttcatgcccaaatcccggaaactccagcgtgtctccagccgtgttggtaccattttcagatttcatcttcctaaactggaaatgtcaatgagaggaaattaacacccccaagagctgcagtgagcaaatgcattgagcttgggtcaggacaattccatttggggaccagagatggacggtcactcagcctatggagatgaagaaactgaggttcagagaggttaagagactccactgaggtcacacagccgaggctccagcgggagaagaagcccaataacttgaatgacaccatcaaggagctgttcagagtggtgcctgggaatgtggaccctatgctggagaagaggtcggtgggctgccggcgctgcgccgttgtgggcaactcgggcaacctgagggagtcttcttatgggcctgagatagacagtcacgactttgtcctcaggatgaacaaggcgcccacggcagggtt

SEQ ID NO: 186431 - DNA, 741 bp, Homo sapiens
  Payload ID: 16720
  Gene Symbol: ST3GAL1
  Gene Name: ST3 beta-galactoside alpha-2,3-sialyltransferase 1
  ENST ID: ENST00000523855
  CDS Start-End: 601-741
ggtgactctcttctctccccacactgagtggcttgaaagggctcagaggcttcacatgagcacttaacatttactgtgtatatctgagccaagtagggaaagaaactgtctcaccaatcctcacgccctctccccatgctaagtctcccgagtattttcttctgtttttcagatgaagaaactgaggttcagagaggttaagagactccactgaggtcacacagccgatgacagacaaccttctgtgccttcatcaagctggttgtgtacccaccatgtccctggcgacaggatgggaaagaaaaagccctaattaaggatcgtcagaaaccacagttggaggaggacggcagagacagtttccctccccgctataccaacacccttccttcgaggtcctcgctcctgagggaccctggactgtcacagagattaatgaccccttatcttctttggatgtgaaaggaaatcactggttaaagcttgatcgagagacattatcagctctttaaggattgcagaagaataggctactttattttctgaaaaggagggagttcctgctacccatcgtgggaggccaccatcaggactgcgaagatggtgaccctgcggaagaggaccctgaaagtgctcaccttcctcgtgctcttcatcttcctcacctccttcttcctgaactactcccacaccatggtggccaccacctggttccccaagcagatggtcctggagctctcc

SEQ ID NO: 186432 - DNA, 6951 bp, Homo sapiens
  Payload ID: 16720
  Gene Symbol: ST3GAL1
  Gene Name: ST3 beta-galactoside alpha-2,3-sialyltransferase 1
  Uniprot ID: Q11201
  ENST ID: ENST00000521180
  CDS Start-End: 1018-2040
cctcggctccagcctccgccggcggagcccactatgccagacagtttcgacactttgcaaagacaaagagccctagaccggagggaggaggaggaggaagaagagcggagagagaaggaagaggcgatgtgagctgggaagggggcaagtgtccgggacacccacacccctgtattctcctccgaaccccttcatgcccaaatcccggaaactccagcgtgtctccagccgtgttggtaccattttcagatttcatcttcctaaactggaaatgtcaatgagaggaaattaacacccccaagagctgcagtgagcaaatgcattgagcttgggtcaggacaattccatttggggaccagagatggacggtcactcagcctatggagatgaagaaactgaggttcagagaggttaagagactccactgaggtcacacagccgatgacagacaaccttctgtgccttcatcaagctggttgtgtacccaccatgtccctggcgacaggatgggaaagaaaaagccctaattaaggatcgtcagaaaccacagttggaggaggacggcagagacagtttccctccccgctataccaacacccttccttcgaggtcctcgctcctgagggaccctggactgtcacagagattaatgaccccttatcttctttggatgtgaaaggaaatcactggttaaagcttgatcgagagacattatcagctctttaaggattgcagaagaataggctactttattttctgaaaaggtaaatatatgcaagcaaagccaacatgccacgaatggcgttggtctaccacacagccgtgtctgggacacagttgggggtcatcccccagcaggagtgaagtcgagcttagcggcccttgtgtcctcccttggaattcctgccatcccttttgattgagcctccacctctgggatttttcttccatttttctcctctcttaggagggagttcctgctacccatcgtgggaggccaccatcaggactgcgaagatggtgaccctgcggaagaggaccctgaaagtgctcaccttcctcgtgctcttcatcttcctcacctccttcttcctgaactactcccacaccatggtggccaccacctggttccccaagcagatggtcctggagctctccgagaacctgaagagactgatcaagcacaggccttgcacctgcacccactgcatcgggcagcgcaagctctcggcctggttcgatgagaggttcaaccagaccatgcagccgctgctgaccgcccagaacgcgctcttggaggacgacacctaccgatggtggctgaggctccagcgggagaagaagcccaataacttgaatgacaccatcaaggagctgttcagagtggtgcctgggaatgtggaccctatgctggagaagaggtcggtgggctgccggcgctgcgccgttgtgggcaactcgggcaacctgagggagtcttcttatgggcctgagatagacagtcacgactttgtcctcaggatgaacaaggcgcccacggcagggtttgaagctgatgttgggaccaagaccacccaccatctggtgtaccctgagagcttccgggagctgggagataatgtcagcatgatcctggtgcccttcaagaccatcgacttggagtgggtggtgagcgccatcaccacgggcaccatttcccacacctacatcccggttcctgcaaagatcagagtgaaacaggataagatcctgatctaccacccagccttcatcaagtatgtctttgacaactggctgcaagggcacgggcgatacccatctaccggcatcctctcggtcatcttctcaatgcatgtctgcgatgaggtggacttgtacggcttcggggcagacagcaaagggaactggcaccactactgggagaacaacccatccgcgggggcttttcgcaagacgggggtgcacgatgcagactttgagtctaacgtgacggccaccttggcctccatcaataaaatccggatcttcaaggggagatgacgcagtgaagggctgaggatggacgcactgtcacacctctgcatttccagccccagcatcttgctggagccgttccatcccggagcttggaggggcagcctcaggtgtgtgcctgggcaccgctcacagcctcttgcacccagccgttggcagcatctactcagcaaggtcactaagctctgccagcgtggcagagcatgtcttggaacctgtcttgagtggggacaacgtccccccactgctgccctagagctggggagacgctgggaaaggttcaacctccacacactaaaatcattttggctcctggggcaagcttggggaatgaatgtggaagatgcctatattctgagagacaggacagtttcccaggaagatgggcagagacttgagtggcgattacctccagcacagagacgtgccaggcggtgttggcgctcggggcgagatgctgcccttctttgcacgaagcctggcctcttgcttggcgtgataaccctgtcatcttcccaaagctcatttatgagccaccagaggctcctaccccaaagattttcacagaaacttgaggccaggtgccgtggctcacacctgtaatctgaacactttgggaggccgaggcgggaggatcacttgagcccaggagttcaagaccagcctgggcaacatagtgagactcctgtctctacaaaaataaaagatttaaaaaaattagccaggcacggtggcacacacttgtagccccagctactagggaggctgaggagggaggatctcttgtgcctaggagttcgaggctgcagtgggctgtgatcacaccactgcactccagcctgggcaacagagtgagaccctgtctctgaaaaaaaaaaaaaaagaaaagaaaaaaaaccccaaacttggcaccgtgtttctgactcctgcagatgcctcttcccaagcagttgttcctttgagtagtcagtctcatggttctaatcgtggcgagagcggatctgaccacttccatgtgcctttgtatttgggaaagaaaagcatgcattggctgaaatgaaacaaaagcccttacttgggaaaagggacccccaccagcggccctgcttgctccgtagctgggaacatcttttctggtttcctgagccagcacctgaattgcaacgaagctctgaggatactcaacaccacccagcagtgcgtcagaatggaacgtacattctcattctcagactgttcaatatggtgcccgtaacctccaaagccacacaggaggctgccagcagcattttccccaagggcctgagctcagggtcaagtccctgctggccatcttggggctgtcactgggggtctgggtcaaggacatcccaggaatggtaactgccacatacctcatcttcttactccccagctactctcttttcctcattagccttcctgattatttattgatttcttttttttattcaactgacattgtttgcaccctggctctgttggtggtcctggtgttttaatgaagcttgcctcacccagtagctgggaaattaggtgggggtgcttaagggaggtttgtaggagtcctcggacgtgggatattgggggtatctagggcttggatggtttgtggaatgtcctcagcatcctcccgtcccaacccaaccttccttcttcctcattgtggacttggatttattctcaggctaggagtctccaaaactccgtgaaaccttattgctgctgggtgtggagtggagagtgacaggaatgtgggggacggtgattgttggctccagttactaatgtttaagcagaaaaaccactttcttgttgaaaatatccctgaaaaggtcgctgctgctttgaggaggcgtgactttttcctggtggagtgtgacggaggcatggggcctgtgctcccaggctcgggggagccccctctgcacacggggagggaggaacttggggacatcagtcatgggtcacaggtggcttcaggccattcacaagagtccccggaagttgcgtgccaagtttggttttttccctgaatctctgcatatgagcatttttctggagaaaggaccatagcttttattagattctcaaaggttcagaatggggaatgtgttaaacaaaccgaaaacctgtttcagctttaaaatcctccaaaactttaaagacttttcttttttctgagaaaggctggtaaatcactgagtcatcattcagaacatacagcctcgaagggcagagctcacacccatatatgacgttaagagctcaacaaatgtttgttgagtgactgagtgaccccaggggcagactccagatcatcagacactgatacagagagcgatgctatctcctcaactctccctcttctcctaaaagctgagtctatatagggatgacaggctcaggctgagcagtcgacttctctgggttttgctgtgtaagaataggtccctcaacatgaagatgtgtctgcgtctgagccagatgctgcctgggtcggttgcctggcctccgtctggtctccctccctcctactagggtggtcaagctgtgagatctcttccagcctccaaatccagctttcccattttactgatgagaaaatcaaggccacattgcagctgggtggggagtggagcgtgacaggcacgggagaggacagcgattgttgactctagttcctgatgtttaatcagaaaaaccacttttcctgtagagcacatttcctaaaaggctgctgctgtgtagggaggtgtggccttttcctggtgcagtgtgaaggagggaagtgacgggcagtcgtgaactgtctgggacagatagcacaagtcagagtttgagcaaaactagggtgttaccggcgctatgttgaaattgtctggaggcgggctttcccagcgagtctccattcagcatctggaaaaagtgtaaccagaatggaggtgtctgactctcctgtgctctctcagcgccgagctctagctgcaggctgcctgggtggccttctcacaccctcccgtgcaggagactgcatttctctttcccacagcccagcagatagctcattggcttagcaatgggcacttaacagaatccagttgttgcagccagaattaaatgcaccagtctggcttaaaccaactggaactcatccctggggtgaaggtggctgggaattagacaagagtgtgtgttagccaaaaggcacatgcatgctgtcagcaggagaatgaggagcactggttctgggcaggcagtggcaggggctccctcaggcccctgattcccagcccacagctctttctactctgcagacagagttccttggagactggccctgcattcaggcagggagcagaggggtccctgcctgcagcacccagagctgaacctgaagctacaaagatgggctgatgaggtggcccatgaggtgtcagcaacatcccaaccccctgggtctccccagtgagtcagggcactgatttgctatagctggagctacatgcacctctcctcccctcagccaccttttaggggagaaaggagggcagatttgtaacctctggttctctgcagggatcctgggctggaagaaagttcataaatggatgaatgccttttaaaactccagcttttccaagcatcattcaccaaagcatttggttaggcttagagagaaaagctggatatgagaaaatagaatgtaaaataggagggaaaaaaaaaaagaaggtggagagggcagttaagatctgggtgattctttagggaaacggctggttgagaggctttgatggaatcccattctctgctgtggccagaaggtggtgctagaggccagtcccacttggatgtgaccctggcctctgccaggattcaaaccacaaagaacatttggaactgggatgtttgctttgaagcagcccgaaaacaagtgaaaggaaaccaagataactctctctccctccgctggcaaggatcaaaaataccttgtgcagggaagcccgagcctcgaggggccactgcccagctaaagatgactggacaccagccatgcaccatcaggaaccagcacctgtcctcacccctgagaagagccccgggggtatcattatatccatcgcagacatctggtttgcagcaaatgtggctacacgccatcaggattatcctgccctgtggactgggctagctagttttgagatagagtcaacctccccatttttgtttgtcatgaaaacaccagctcctgcacccctggggtgctacctgacacctgtgcaaagaaaaggaggaaaacttagaagaaaaggcagagacaggcaagacagcatctcacagcttgtcaggatcagggcattaccgactattttttcttaccaaaagagcactgaatttcctaggggaaggtgagccacctttacacctcctgtcctccctcccagcccgtcaagcgatcccatcacccagcctcatcactcagcttcttcctagtacaaaactgccatcggttgtacgtcctgagctgtgggacgtcagctttaaccctagcctgtctcagggcctcgccctccagccccccgccccttagggtgatcgtgggtttcttcccttcctcctgcacaatcgcttcccttcactgaattcccttcaaagccaaagtttcttgagcactttttcttgtgtgcagtcttgtgtgtttgggtgttggtgtttttaaatttgctttctattcccccctgcctctctccatgtcgttacgcagctgagcactggttgggatgcattcgaatgacttcagcaagatcctgctttcctcagcccccgctctgttttatttattgtttaatatttccaatgatccaaatcaaagtgaataaacaaagagctatttta

SEQ ID NO: 186433 - DNA, 626 bp, Homo sapiens
  Payload ID: 16720
  Gene Symbol: ST3GAL1
  Gene Name: ST3 beta-galactoside alpha-2,3-sialyltransferase 1
  ENST ID: ENST00000523854
  CDS Start-End: 334-626
ggctcccatccagtgctctttaggtgactctcttctctccccacactgagtggcttgaaagggctcagaggcttcacatgagcacttaacatttactgtgtatatctgagccaagtagggaaagaaactgtctcaccaatcctcacgccctctccccatgctaagtctcccgagtattttcttctgtttttcagatgaagaaactgaggttcagagaggttaagagactccactgaggtcacacagccgaggctccagcgggagaagaagcccaataacttgaatgacaccatcaaggagctgttcagagtggtgcctgggaatgtggaccctatgctggagaagaggtcggtgggctgccggcgctgcgccgttgtgggcaactcgggcaacctgagggagtcttcttatgggcctgagatagacagtcacgactttgtcctcaggatgaacaaggcgcccacggcagggtttgaagctgatgttgggaccaagaccacccaccatctggtgtaccctgagagcttccgggagctgggagataatgtcagcatgatcctggtgcccttcaagaccatcgacttggagtgggtggtgagcgccatcaccacgggcaccatttccca

SEQ ID NO: 186434 - DNA, 895 bp, Homo sapiens
  Payload ID: 16720
  Gene Symbol: ST3GAL1
  Gene Name: ST3 beta-galactoside alpha-2,3-sialyltransferase 1
  ENST ID: ENST00000523634
  CDS Start-End: 680-895
ggaatgtgttgaacttggctgagtggtgcaagggatcccctggtgccatccctgccaaagaccctatcagtgtcatgagcctgaggatgaaatctcccgatggatgacagacaaccttctgtgccttcatcaagctggttgtgtacccaccatgtccctggcgacaggatgggaaagaaaaagccctaattaaggatcgtcagaaaccacagttggaggaggacggcagagacagtttccctccccgctataccaacacccttccttcgaggtcctcgctcctgagggaccctggactgtcacagagattaatgaccccttatcttctttggatgtgaaaggaaatcactggttaaagcttgatcgagagacattatcagctctttaaggattgcagaagaataggctactttattttctgaaaaggtaaatatatgcaagcaaagccaacatgccacgaatggcgttggtctaccacacagccgtgtctgggacacagttgggggtcatcccccagcaggagtgaagtcgagcttagcggcccttgtgtcctcccttggaattcctgccatcccttttgattgagcctccacctctgggatttttcttccatttttctcctctcttaggagggagttcctgctacccatcgtgggaggccaccatcaggactgcgaagatggtgaccctgcggaagaggaccctgaaagtgctcaccttcctcgtgctcttcatcttcctcacctccttcttcctgaactactcccacaccatggtggccaccacctggttccccaagcagatggtcctggagctctccgagaacctgaagagactgatcaagcacaggccttgcacctgcacccactgcatcgggcagcgcaagctctcggcc

SEQ ID NO: 186435 - DNA, 684 bp, Homo sapiens
  Payload ID: 16720
  Gene Symbol: ST3GAL1
  Gene Name: ST3 beta-galactoside alpha-2,3-sialyltransferase 1
  ENST ID: ENST00000519924
  CDS Start-End: 537-684
gatgctgtcatcagggagcttgggggacaggcttcttggagtgtccccctggtgggacctggaatgtgttgaacttggctgagtggtgcaagggatcccctggtgccatccctgccaaagaccctatcagtgtcatgagcctgaggatgaaatctcccgatggatgacagacaaccttctgtgccttcatcaagctggttgtgtacccaccatgtccctggcgacaggatgggaaagaaaaagccctaattaaggatcgtcagaaaccacagttggaggaggacggcagagacagtttccctccccgctataccaacacccttccttcgaggtcctcgctcctgagggaccctggactgtcacagagattaatgaccccttatcttctttggatgtgaaaggaaatcactggttaaagcttgatcgagagacattatcagctctttaaggattgcagaagaataggctactttattttctgaaaaggagggagttcctgctacccatcgtgggaggccaccatcaggactgcgaagatggtgaccctgcggaagaggaccctgaaagtgctcaccttcctcgtgctcttcatcttcctcacctccttcttcctgaactactcccacaccatggtggccaccacctggttccccaagcagatggtcctggagctctccgagaacc

SEQ ID NO: 186436 - DNA, 2580 bp, Homo sapiens
  Payload ID: 16720
  Gene Symbol: ST3GAL1
  Gene Name: ST3 beta-galactoside alpha-2,3-sialyltransferase 1
  Uniprot ID: Q11201
  ENST ID: ENST00000522652
  CDS Start-End: 739-1761
accggagggaggaggaggaggaagaagagcggagagagaaggaagaggcgatgtgagctgggaagggggcaagtgtccgggacacccacacccctgtattctcctccgaaccccttcatgcccaaatcccggaaactccagcgtgtctccagccgtgttggtaccattttcagatttcatcttcctaaactggaaatgtcaatgagaggaaattaacacccccaagagctgcagtgagcaaatgcattgagcttgggtcaggacaattccatttggggaccagagatggacggtcactcagcctatggagatgaagaaactgaggttcagagaggttaagagactccactgaggtcacacagccgatgacagacaaccttctgtgccttcatcaagctggttgtgtacccaccatgtccctggcgacaggatgggaaagaaaaagccctaattaaggatcgtcagaaaccacagttggaggaggacggcagagacagtttccctccccgctataccaacacccttccttcgaggtcctcgctcctgagggaccctggactgtcacagagattaatgaccccttatcttctttggatgtgaaaggaaatcactggttaaagcttgatcgagagacattatcagctctttaaggattgcagaagaataggctactttattttctgaaaaggagggagttcctgctacccatcgtgggaggccaccatcaggactgcgaagatggtgaccctgcggaagaggaccctgaaagtgctcaccttcctcgtgctcttcatcttcctcacctccttcttcctgaactactcccacaccatggtggccaccacctggttccccaagcagatggtcctggagctctccgagaacctgaagagactgatcaagcacaggccttgcacctgcacccactgcatcgggcagcgcaagctctcggcctggttcgatgagaggttcaaccagaccatgcagccgctgctgaccgcccagaacgcgctcttggaggacgacacctaccgatggtggctgaggctccagcgggagaagaagcccaataacttgaatgacaccatcaaggagctgttcagagtggtgcctgggaatgtggaccctatgctggagaagaggtcggtgggctgccggcgctgcgccgttgtgggcaactcgggcaacctgagggagtcttcttatgggcctgagatagacagtcacgactttgtcctcaggatgaacaaggcgcccacggcagggtttgaagctgatgttgggaccaagaccacccaccatctggtgtaccctgagagcttccgggagctgggagataatgtcagcatgatcctggtgcccttcaagaccatcgacttggagtgggtggtgagcgccatcaccacgggcaccatttcccacacctacatcccggttcctgcaaagatcagagtgaaacaggataagatcctgatctaccacccagccttcatcaagtatgtctttgacaactggctgcaagggcacgggcgatacccatctaccggcatcctctcggtcatcttctcaatgcatgtctgcgatgaggtggacttgtacggcttcggggcagacagcaaagggaactggcaccactactgggagaacaacccatccgcgggggcttttcgcaagacgggggtgcacgatgcagactttgagtctaacgtgacggccaccttggcctccatcaataaaatccggatcttcaaggggagatgacgcagtgaagggctgaggatggacgcactgtcacacctctgcatttccagccccagcatcttgctggagccgttccatcccggagcttggaggggcagcctcaggtgtgtgcctgggcaccgctcacagcctcttgcacccagccgttggcagcatctactcagcaaggtcactaagctctgccagcgtggcagagcatgtcttggaacctgtcttgagtggggacaacgtccccccactgctgccctagagctggggagacgctgggaaaggttcaacctccacacactaaaatcattttggctcctggggcaagcttggggaatgaatgtggaagatgcctatattctgagagacaggacagtttcccaggaagatgggcagagacttgagtggcgattacctccagcacagagacgtgccaggcggtgttggcgctcggggcgagatgctgcccttctttgcacgaagcctggcctcttgcttggcgtgataaccctgtcatcttcccaaagctcatttatgagccaccagaggctcctaccccaaagattttcacagaaacttgaggccaggtgccgtggctcacacctgtaatctgaacactttgggaggccgaggcgggaggatcacttgagcccaggagttcaagaccagcctgggcaacatagtgagactcctgtctctacaaaaataaaagatttaaaaaaattagccaggcacggtggcacacacttgtagccccagctactagggaggctgaggagggaggatctcttgtgcctaggagttcgaggctgcagtgggctgtgatcacac

SEQ ID NO: 186437 - DNA, 4450 bp, Homo sapiens
  Payload ID: 16721
  Gene Symbol: ST3GAL2
  Gene Name: ST3 beta-galactoside alpha-2,3-sialyltransferase 2
  Uniprot ID: Q16842
  ENST ID: ENST00000342907
  CDS Start-End: 1144-2196
cgggcggacgagagagctgcgagctaacgggtccggacgacggcggcggcggcggcggcggcggcgacggctttctgcgcgggcggcggcggcggccggagcggcgagcatggcccgcgcggcgccgggcgctgactgagggtcgtgctgcggcagcctggcgcccgacatgtgaaggggaacctgccaggggattactgtgagctcacagcaggataggctggccccgggggagtggggatgggcagaacctgggccaggagtattaggaaggagacctggaccctggtagggagctcagcacaagctcgcctgacccagatggtattggacacagtgccccgctgaacagcagctgttcccagcgccagaggaccccacagccacagtaggagctttgcgacccctacgcaactgcagctggggctggggccaccaggagaagggaccagcacctcagatgggaagcagaagggcaagacctactgcggaaaggatctcgatctctgcagcggagttttcccacactcacagagcttcctgtttttgtcctctcagggttggggtctggctcccctcctctggcagaggttttgggccaggaggtgggacaacacttgcatggaacccaagtcccctgaagcccctgtgctctctgttgtgattggagttctagggcttccccgctgccgggaacgaggggccgcctcattgtctgctcatgaaccacaaggaccccgactgctccagactggattatttcaagccgccaaagagggggacccctagagctggcagccagcaatcccaagggactagagggctgcaatggactgacctccccctcaccagggtggcaggagaggcagagcctctgtggcctagctagtgacggagagacccgatgaagccctaagcaggggccccgcctgactcagggacaggacagccactcctgccaacgtgtgttctccctacatgagggagggcgtggcaagggacccctgccactgtcccctgctgcagcacgtgcccctatgccctttgcatgtggtgccagaataggcaggctacgccgtggctggcccctcagcgggctgggaaaagagtggccacggtgaccgtcacccgcctgccggcaccatgaagtgctccctgcgggtgtggttcctctccgtggccttcctgctggtgttcatcatgtccctgctcttcacctactcgcaccacagcatggccacgctcccctacctggactcaggggccctggatgggacgcaccgggtgaagctggtgcccggctatgccggcctgcagcgcctcagcaaggagaggctctcgggcaagagctgtgcctgtcgccgctgcatgggcgatgccggtgcctccgactggtttgacagccactttgacggtaacatttcccccgtctggacccgagagaacatggatcttccaccggacgtccagaggtggtggatgatgctgcagccccagttcaagtcacacaacaccaatgaggtgctggagaagctgttccagatagtgcctggcgagaacccctaccgcttccgggacccccaccagtgccggcgctgtgccgtggtggggaactcgggcaacctgcggggctctggctatgggcaggacgtggacgggcacaacttcatcatgaggatgaatcaggcgccaaccgtgggctttgagcaggatgttggcagccgaaccacccaccatttcatgtaccctgagagtgccaagaacctgcccgccaacgtcagcttcgtgctggtgcccttcaaggtcctggaccttctgtggatcgccagcgccttgtccacggggcagatccgattcacctacgccccagtgaagtccttccttcgagtggataaagaaaaggtccagatctacaacccagccttcttcaagtatatccacgacaggtggacagagcatcacgggcggtacccttccacggggatgctggtgcttttctttgccctgcatgtgtgtgatgaggtgaacgtgtacgggttcggggccgacagccggggcaactggcaccactactgggagaacaaccggtacgcgggcgagttccggaagactggcgtgcacgacgcggacttcgaggcccacatcatcgacatgctggccaaggccagcaagatcgaagtctaccggggcaactgagccgggcctcgccgcgacccttccggcccatctatcgggcaccggggctccggcccgggacccaggaccagcaacccgcgaccaatcatgctgcagcccaggggcgtctgctgtgccccgccaatcacgagactgggggaccggccgggcctggcaccaatctgcgctgcggtcgggcggagcttctgtttctcccagccaatcatgtgactcaaggaaaacttccggcgctgtgtccagtctcctccaatcaatggccttcgggggcgggccagcggccgctcaatccccactccctcatgctttgggttagggttttctttcacgctttctgaggaggagagcatggcgcgggcctcggcgaagcacttccgtcagcctcgggcggaggatcgtcttagtagctggccagacctggaggagagcgggcggtctttgcgggcctcaggagataggtggccgcccggcccctttccccgcctgcccggataggtgcgtgcagacccaccaaagaaaagcggtcgctgcgggacccccagtcccacctcggccgcgctgtgggatggctgcgcccccagggcttcctgcgtctccaggaagccgggagtggcgccctctgcggggtggggtgctcccgggccgaactccggacaggtggaggggacagggcagagctcgaggaagccctgtccccttcagtgcaaggtgctgtcactcacgtgtgccctcgaccctcccgttcacccgcagccttctcagcgcctctccctgggccggaggcctcctcaccagcctacctgttgctctggaaaaaaatcccgtcccccgactccgtccctacccccagtcttcggccggctctggcccctggggagggggctgcacggcggaaggaggctggctatgggcccggctgcccgctgcatgtacctcctcctccacccatcgcctcttgcctgggggtaactttgcctggggctcattctttggttaagctgaagctgccgtgggtggccaaaccgcagattctttgcaaattctgagctggcagagctcgcagccgggagccggccggggaagaggagacttgcgcgccgcaagccgcctgcctccaccctgctctccatctcccgctctagaagggctgggaagctcgcggccggggttccacctggaagctgcttgcatggctgaacccagcttaggtccctgacggggctgctggtggaattctcccccttcgaagctggggaggtttaggagggggaaggcttctgtgaagctctcaaaccactaatagagccccctccccaacagtgacggcgcagatgctcccccttttcttagttgacaccaccaggcagcttcctggccgttggtaggttcctgcagctggctgagggaacagggaccggcaggggactttgttaggggagggttgggatgggcagtgggcccctgaaagttaatatattggaacctagctcgagtgtcgttctttccaattccgaaagtagaaagagtaaaaataggggtgattggggtggggttagtagaatgcctctctcagggcgctcccccctcccccaccgttttagagagctaggcctcagccagtcttgccactcccatctcagtgcttcctgaagaggctgttttgagtgttgatgaaaagcaatgcaattatgccaaacagtattgagcagaataatttatttcttttttttcttttgctttaaatcatgaatcccgccaggtacggtggctcacacctgtcatcccagcactttgggaggccaaggcgggcggattacttaatacttaaggtcaggagttcgagaccagcctggccaatatggtgaaacctcgtctctaccaaaaaaaaaaaaaaatacaaaaattagccaggcgcagtggtgcgcacctgtaatcccagctacttggaaggctgaggcaggagaatcccttgaaccgaggaggcgaaggttgcagtgagccgagattgtgccactgcactccagcctgggcgacagagcaagaccctgtctcaaaaaaattaaatcatgaatccccatcctggaagaggtaggtcccagcatccagccagattttctgcaatagtaatttaaacacacttttttatttccttccctttctgaattaaaaggaacaaaaaactgtctagtccttcattgttctgaaatgggcatgatggaagaaggcgggtctggtaggatagctgtgactgataatg

SEQ ID NO: 186438 - DNA, 8872 bp, Homo sapiens
  Payload ID: 16721
  Gene Symbol: ST3GAL2
  Gene Name: ST3 beta-galactoside alpha-2,3-sialyltransferase 2
  Uniprot ID: Q16842
  ENST ID: ENST00000393640
  CDS Start-End: 2109-3161
aatatgctcgttccattccctgctggctttgtggccacaaatggaggggcagctacgtttcttgaacacagagcctgagaggccttgtatgcagctgctggaagcagccaggagaccccaaaagtgggctggagacttcaacaaggacagggaacagggctgcactgagaggcccaggggctaggtcagcagcaccgctaggcagatttggaggggagctggggagaggcgaggcagccagctttgcaagattcccacggcacacagccagtgctcaggggttcccttctcagcgttcctctcacctggtgtggctccctcacgcttggcatggatctgagctcctttccttatggctgagacccaaactgcctacaagtggccttttctccctgttcttgcctgcaagggcagcatggggcctcaggctgtcagtgctaccagggacgctggcattcactttgtccataatgtacagatggatgtagacaactgccctcagggctgtccgggggcaggaccaagcccagcaaccacacctcctgacacagccaggttctcccccaacggcggagctgacaggactgttcatggttcattgagtggacccagcaatacctcatcgataatccacagtcgagagaagaggggcggtcagagaccggccagccctcccttctgattgggagaggcctctgcaggcactgacaggctccagagagtgctgtggggggcagtcagtgtccatagtcccctggaatcttctctgggctgttttctctgacttttcacctgaaattaactgtacatagctgggctaggaactctctaaatctgaaagcatgtggcttagggaaaatcacttgactcgtttaccttctggctaagaagtgaagactctgggctaatctagtcctccaggccctggagtcccacacagtgatgctatctgtgcagctagagggcagagcccttggtcatgtccaccctctgattaagtgggcatctcctctcctgctagctttggggcttggggtggggctgggacaaagcctggtgcccgtgtgattcatccgcacattatttctcctctctgccattctagggtcgtgctgcggcagcctggcgcccgacatgtgaaggggaacctgccaggggattactgtgagctcacagcaggataggctggccccgggggagtggggatgggcagaacctgggccaggagtattaggaaggagacctggaccctggtagggagctcagcacaagctcgcctgacccagatggtattggacacagtgccccgctgaacagcagctgttcccagcgccagaggaccccacagccacagtaggagctttgcgacccctacgcaactgcagctggggctggggccaccaggagaagggaccagcacctcagatgggaagcagaagggcaagacctactgcggaaaggatctcgatctctgcagcggagttttcccacactcacagagcttcctgtttttgtcctctcagggttggggtctggctcccctcctctggcagaggttttgggccaggaggtgggacaacacttgcatggaacccaagtcccctgaagcccctgtgctctctgttgtgattggagttctagggcttccccgctgccgggaacgaggggccgcctcattgtctgctcatgaaccacaaggaccccgactgctccagactggattatttcaagccgccaaagagggggacccctagagctggcagccagcaatcccaagggactagagggctgcaatggactgacctccccctcaccagggtggcaggagaggcagagcctctgtggcctagctagtgacggagagacccgatgaagccctaagcaggggccccgcctgactcagggacaggacagccactcctgccaacgtgtgttctccctacatgagggagggcgtggcaagggacccctgccactgtcccctgctgcagcacgtgcccctatgccctttgcatgtggtgccagaataggcaggctacgccgtggctggcccctcagcgggctgggaaaagagtggccacggtgaccgtcacccgcctgccggcaccatgaagtgctccctgcgggtgtggttcctctccgtggccttcctgctggtgttcatcatgtccctgctcttcacctactcgcaccacagcatggccacgctcccctacctggactcaggggccctggatgggacgcaccgggtgaagctggtgcccggctatgccggcctgcagcgcctcagcaaggagaggctctcgggcaagagctgtgcctgtcgccgctgcatgggcgatgccggtgcctccgactggtttgacagccactttgacggtaacatttcccccgtctggacccgagagaacatggatcttccaccggacgtccagaggtggtggatgatgctgcagccccagttcaagtcacacaacaccaatgaggtgctggagaagctgttccagatagtgcctggcgagaacccctaccgcttccgggacccccaccagtgccggcgctgtgccgtggtggggaactcgggcaacctgcggggctctggctatgggcaggacgtggacgggcacaacttcatcatgaggatgaatcaggcgccaaccgtgggctttgagcaggatgttggcagccgaaccacccaccatttcatgtaccctgagagtgccaagaacctgcccgccaacgtcagcttcgtgctggtgcccttcaaggtcctggaccttctgtggatcgccagcgccttgtccacggggcagatccgattcacctacgccccagtgaagtccttccttcgagtggataaagaaaaggtccagatctacaacccagccttcttcaagtatatccacgacaggtggacagagcatcacgggcggtacccttccacggggatgctggtgcttttctttgccctgcatgtgtgtgatgaggtgaacgtgtacgggttcggggccgacagccggggcaactggcaccactactgggagaacaaccggtacgcgggcgagttccggaagactggcgtgcacgacgcggacttcgaggcccacatcatcgacatgctggccaaggccagcaagatcgaagtctaccggggcaactgagccgggcctcgccgcgacccttccggcccatctatcgggcaccggggctccggcccgggacccaggaccagcaacccgcgaccaatcatgctgcagcccaggggcgtctgctgtgccccgccaatcacgagactgggggaccggccgggcctggcaccaatctgcgctgcggtcgggcggagcttctgtttctcccagccaatcatgtgactcaaggaaaacttccggcgctgtgtccagtctcctccaatcaatggccttcgggggcgggccagcggccgctcaatccccactccctcatgctttgggttagggttttctttcacgctttctgaggaggagagcatggcgcgggcctcggcgaagcacttccgtcagcctcgggcggaggatcgtcttagtagctggccagacctggaggagagcgggcggtctttgcgggcctcaggagataggtggccgcccggcccctttccccgcctgcccggataggtgcgtgcagacccaccaaagaaaagcggtcgctgcgggacccccagtcccacctcggccgcgctgtgggatggctgcgcccccagggcttcctgcgtctccaggaagccgggagtggcgccctctgcggggtggggtgctcccgggccgaactccggacaggtggaggggacagggcagagctcgaggaagccctgtccccttcagtgcaaggtgctgtcactcacgtgtgccctcgaccctcccgttcacccgcagccttctcagcgcctctccctgggccggaggcctcctcaccagcctacctgttgctctggaaaaaaatcccgtcccccgactccgtccctacccccagtcttcggccggctctggcccctggggagggggctgcacggcggaaggaggctggctatgggcccggctgcccgctgcatgtacctcctcctccacccatcgcctcttgcctgggggtaactttgcctggggctcattctttggttaagctgaagctgccgtgggtggccaaaccgcagattctttgcaaattctgagctggcagagctcgcagccgggagccggccggggaagaggagacttgcgcgccgcaagccgcctgcctccaccctgctctccatctcccgctctagaagggctgggaagctcgcggccggggttccacctggaagctgcttgcatggctgaacccagcttaggtccctgacggggctgctggtggaattctcccccttcgaagctggggaggtttaggagggggaaggcttctgtgaagctctcaaaccactaatagagccccctccccaacagtgacggcgcagatgctcccccttttcttagttgacaccaccaggcagcttcctggccgttggtaggttcctgcagctggctgagggaacagggaccggcaggggactttgttaggggagggttgggatgggcagtgggcccctgaaagttaatatattggaacctagctcgagtgtcgttctttccaattccgaaagtagaaagagtaaaaataggggtgattggggtggggttagtagaatgcctctctcagggcgctcccccctcccccaccgttttagagagctaggcctcagccagtcttgccactcccatctcagtgcttcctgaagaggctgttttgagtgttgatgaaaagcaatgcaattatgccaaacagtattgagcagaataatttatttcttttttttcttttgctttaaatcatgaatcccgccaggtacggtggctcacacctgtcatcccagcactttgggaggccaaggcgggcggattacttaatacttaaggtcaggagttcgagaccagcctggccaatatggtgaaacctcgtctctaccaaaaaaaaaaaaaaatacaaaaattagccaggcgcagtggtgcgcacctgtaatcccagctacttggaaggctgaggcaggagaatcccttgaaccgaggaggcgaaggttgcagtgagccgagattgtgccactgcactccagcctgggcgacagagcaagaccctgtctcaaaaaaattaaatcatgaatccccatcctggaagaggtaggtcccagcatccagccagattttctgcaatagtaatttaaacacacttttttatttccttccctttctgaattaaaaggaacaaaaaactgtctagtccttcattgttctgaaatgggcatgatggaagaaggcgggtctggtaggatagctgtgactgataatggctgagaacgttgggggatatgggaggggcgagatgactcccagataccctcccccacctatacaggaggcacctcattcctggactctgcgctccaagacactgaaatctgagcgggtacaagcattttggttaaaaatcagctcgttgtcgcctcttgagtttcctccaggagaggagttcattggagaggattcctggtagcagctcctcgcagtggctgtcctgtaaccactttggcctctgtcaacatgatgtctccaggtatccatcaggctccgatacatttgggtggccacaggctgggctgtccccacctctcagggaagtgcatctaagtcaggttttcccctctggcacagccctgcctccacagcccaatttccaccatgccacaggcaacccgcatttttatttatttaatttatttatttattgagacagagtcttgttctgttacccaggctggagtgcaatggcccgatgtcggctcatcccaacctccacctcctgggttcaagcgattcttctgcctcaggagagtagggagtagctgggattacaggcatgcaccaccactcccggataattttatatttttagtagagacgggttttctccatgttggtcaggctagtcttgaactccagacctcaggtgatctgcccgcctcggcctcccaaagtgctgggattacaggcgtgagccagtgtgcctggccgattttttttttttgagactgattctcactctcgcccaggctggagtgcagtggtgggatctcggctcattgcaagctccgcctcccgggttcacgccattctcctgcctcagtctcccgagtagctgagactacaggtgaccgccacgatgcccggcagtttttttgtatttttagtagagacggggtttcactgttagccaggatggtctccatctcctgacctcgtgatctccccgcctcagcctcccaaagtgctgggattacaggcgtgagccaccgcgcctggcttttttttttttttttttttgagatggagtcttgctctgtcacccaggctggagtgcagtggcgcgatcttggctcactgcaacctccgcctcccaagttcacccacctcaacctcccgagtagctggaattacaggggtgtgccaccacacccagctaatttttgtatttttagtagagacggggtttcaccatgttggccaggctggtctcgaactcctgaccacaggtcatccaccccctttggcctcccaatgtttgaccacacccagcccataatagatttttaaaactcctataaatatcattctacttccctttattgctaaaatgggagctttttcatccagttttttgggtgtgttccaaatattttgttaaatttcccgtctattgctgttattgtttccatttatttgcccatgtgagttgatacctttttcattcctttcccatagctttagtgacgttgtgggaagggaagttaggtaagtgatgtttcatcttgtacttactagacacctttttcttccttgatttcctgagttccctgcctccacaggtgtgtttcactcctggttgcttatatttttttatttttgagatggagttttgctctgttgaccaggctggagtgcagtggcatgatctcggctcactgcaacctgtgcctcctgggttcaagcgattctcctgcctcagccacccaaatagctgggattacagatgcgcaccaccatgcccagctaatttttgtatttttagtagagacggggtttcaccatgttggccaggctggtcttgaactcctgacctcgtgatctgcccaccttggcctcccaaggtgctggcattacaggtgtgagccaccgtgcccggcctctggttgcttatttaacccctttgtcacgatggaggcttttctcttttttttttttttttttcagatggagtctctctccattgcccaggctggaatgcagtggtgctatgtccgctcactgcaagctccgcctcccgggttcacaccattctcctgtctcagcctcctgagtagctgggattacaggcatgcactaccacgcccggctaattttgtatttttagtagagacggggtttctccatgttggtcaggctggtcttgaactcctgacgtcaggtgatccgcctgccttggcctcccaaatggtaggattacaggcgtgagccaccagaccctttttttttttttttttttttttttaagagacagggtctcctgtcgcccagactggtgcagagctcactgcagcctcaaaaactcctggattcaagtgatcctcccacctcagcctccagagcagctagagcctagctaaaaaattttttaaaaacattttatggccaggcacggtggctcatgcctataatcccagcattttgggaggctgaggcaggtgaatcacgaggtcaggagttcaagaccagcctggccaagatggtgaaaccccgtctctactaaaaatacaaaaaattggccaggcttagtggcagacggctgtgatcccagctactcgggagaccgaggcagagaattgcttgaacctgggaggtggaagttgtggtgagccgagattgagccactgcactccagcctgagcgacagagtaagactccgtctcaaaaaaaaaaaagtattttacccatccacaggcagcagacaaggaagtaccttctgtgactgtctggcaaggtcagaggcatcagggaaggtaaaatactgaaactatatttttaaaaataaaagtattcccttttgagtgtgaattaggaatcaatgccccttctcactacttttgtgaaaaaaatcacagctcctgcagcaagtctatgcctgggtaacaaccaacccacaaaatccaagaggaggtccccctctcccgcctctgtgaggcttgaggagcagtatgtatctgggccagcctggtcctcagagtgtggaattaacacctttcctctagcaactgtttgtgctgctgagaacagcacagactctctggcagcctggttctctccagagggaagcctgtgaagcagaagaaacatatggcatctgcactcagggcgcccagttccatccggccttgctataaaatgactttgcctttccttttttaaaattacaaaaataattcaaccaatacataaacatatgaagtgaatcacggagggccttcctgcgatatctttttttgcctaccatttgtcatggaatgggtaaaggggaccacagagggaagagacgctgccccttcgcagggccatggcagtcccctgggctgcgtctccacggtgcttcctgtgaaacgctgttaccacgggcaccgcactggagaccatgaaagggaagagtttgacatctcagctgtctttgctataaatagaaataaataaaccttaactaa

SEQ ID NO: 186439 - DNA, 2470 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000262915
  CDS Start-End: 192-1526
gccgctgcgtccccactatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccagtaagtatagtcactctagctcaccccaggagaagcctgttgcagattcagtggttctttcctttgactccgctggacaaacactaggctcagagtatgatcggttgggcttcctcctgaatctggactctaaactctcaccgaggactctctgcacggtggtttttggccttgactgcatattggaatcacctggagagcctaaaaaattactgatgcctgcatcccaccctctagagattttgaagtcactgagcgaggacacagcctttgcattaggatttttaaagctgcccaggcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatccataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctgagcctgg

SEQ ID NO: 186440 - DNA, 2377 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000351035
  CDS Start-End: 192-1433
gccgctgcgtccccactatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaagtatgatcggttgggcttcctcctgaatctggactctaaactctcaccgaggactctctgcacggtggtttttggccttgactgcatattggaatcacctggagagcctaaaaaattactgatgcctgcatcccaccctctagagattttgaagtcactgagcgaggacacagcctttgcattaggatttttaaagctgcccaggcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatccataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctgagcctgg

SEQ ID NO: 186441 - DNA, 1324 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000347631
  CDS Start-End: 152-1324
cgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccagtaagtatagtcactctagctcaccccaggagaagcctgttgcagattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctga

SEQ ID NO: 186442 - DNA, 1035 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000332628
  CDS Start-End: 1-1035
atgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactgttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctga

SEQ ID NO: 186443 - DNA, 1969 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000353126
  CDS Start-End: 192-1025
gccgctgcgtccccactatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatccataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctgagcctgg

SEQ ID NO: 186444 - DNA, 1479 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000330208
  CDS Start-End: 192-497
gccgctgcgtccccactatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaagtatgatcggttgggcttcctcctgaatctggactctaaactgcctgctgaattagccaccaagtacgcaaacttttcagagggagcttgcaagcctggctatgcttcagccttgatgacggccatcttcccccgtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatccataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctgagcctgg

SEQ ID NO: 186445 - DNA, 1805 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000335430
  CDS Start-End: 192-749
gccgctgcgtccccactatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccagtaagtatagtcactctagctcaccccaggagaagcctgttgcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgaggtgagctccccaaaatggcacctcggtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatccataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctgagcctgg

SEQ ID NO: 186446 - DNA, 1335 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000361746
  CDS Start-End: 1-1335
atgggactcttggtatttgtgcgcaatctgctgctagccctctgcctctttctggtactgggatttttgtattattctgcgtggaagctacacttactccagtgggaggaggactccagtaagtatagtcactctagctcaccccaggagaagcctgttgcagattcagtggttctttcctttgactccgctggacaaacactaggctcagagtatgatcggttgggcttcctcctgaatctggactctaaactctcaccgaggactctctgcacggtggtttttggccttgactgcatattggaatcacctggagagcctaaaaaattactgatgcctgcatcccaccctctagagattttgaagtcactgagcgaggacacagcctttgcattaggatttttaaagctgcccaggcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctga

SEQ ID NO: 186447 - DNA, 2195 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000361400
  CDS Start-End: 178-1257
actatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatccataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctga

SEQ ID NO: 186448 - DNA, 513 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000361812
  CDS Start-End: 1-513
atgggactcttggtatttgtgcgcaatctgctgctagccctctgcctctttctggtactgggatttttgtattattctgcgtggaagctacacttactccagtgggaggaggactccagtaagtatagtcactctagctcaccccaggagaagcctgttgcagattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagtcctggacgcacaatatccagcgagagaaagagtttctgcggaagctggtgaaagctcgcgtcatcactga

SEQ ID NO: 186449 - DNA, 2243 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000361392
  CDS Start-End: 178-1305
actatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatccataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctga

SEQ ID NO: 186450 - DNA, 468 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000372362
  CDS Start-End: 1-468
atgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagtcctggacgcacaatatccagcgagagaaagagtttctgcggaagctggtgaaagctcgcgtcatcactga

SEQ ID NO: 186451 - DNA, 673 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000372365
  CDS Start-End: 1-561
atgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgaggtgagctccccaaaatggcacctcggtcctggacgcacaatatccagcgagagaaagagtttctgcggaagctggtgaaagctcgcgtcatcactgatctaagcagtggcatctga

SEQ ID NO: 186452 - DNA, 670 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000372366
  CDS Start-End: 1-558
atgggactcttggtatttgtgcgcaatctgctgctagccctctgcctctttctggtactgggatttttgtattattctgcgtggaagctacacttactccagtgggaggaggactccagtaagtatagtcactctagctcaccccaggagaagcctgttgcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgaggtgagctccccaaaatggcacctcggtcctggacgcacaatatccagcgagagaaagagtttctgcggaagctggtgaaagctcgcgtcatcactgatctaagcagtggcatctga

SEQ ID NO: 186453 - DNA, 644 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000372367
  CDS Start-End: 1-606
atgggactcttggtatttgtgcgcaatctgctgctagccctctgcctctttctggtactgggatttttgtattattctgcgtggaagctacacttactccagtgggaggaggactccagtaagtatagtcactctagctcaccccaggagaagcctgttgcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagtcctggacgcacaatatccagcgagagaaagagtttctgcggaagctggtgaaagctcgcgtcatcactgatctaagcagtggcatctga

SEQ ID NO: 186454 - DNA, 1290 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000372368
  CDS Start-End: 1-1290
atgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactctcaccgaggactctctgcacggtggtttttggccttgactgcatattggaatcacctggagagcctaaaaaattactgatgcctgcatcccaccctctagagattttgaagtcactgagcgaggacacagcctttgcattaggatttttaaagctgcccaggcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctga

SEQ ID NO: 186455 - DNA, 1038 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000372369
  CDS Start-End: 1-1038
atgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctga

SEQ ID NO: 186456 - DNA, 1242 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000372372
  CDS Start-End: 1-1242
atgggactcttggtatttgtgcgcaatctgctgctagccctctgcctctttctggtactgggatttttgtattattctgcgtggaagctacacttactccagtgggaggaggactccaagtatgatcggttgggcttcctcctgaatctggactctaaactctcaccgaggactctctgcacggtggtttttggccttgactgcatattggaatcacctggagagcctaaaaaattactgatgcctgcatcccaccctctagagattttgaagtcactgagcgaggacacagcctttgcattaggatttttaaagctgcccaggcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctga

SEQ ID NO: 186457 - DNA, 2170 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000372374
  CDS Start-End: 192-1226
gccgctgcgtccccactatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactgttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatccataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctgagcctgg

SEQ ID NO: 186458 - DNA, 1160 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000469715
  CDS Start-End: 1-570
atgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgaggcccaggctctgagtgggcctgctctctgtagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctga

SEQ ID NO: 186459 - DNA, 700 bp, Homo sapiens
  Payload ID: 16722
  Gene Symbol: ST3GAL3
  Gene Name: ST3 beta-galactoside alpha-2,3-sialyltransferase 3
  ENST ID: ENST00000532911
  CDS Start-End: 204-461
actgctgccccatttgatacatctttgttgaactggcctaagttcatgccagcatctgtgctctatacaaattgtggaaccagtgggaaggatgggtgcattttaggtgcttgaaaagcaagggactcaacctccagtgggatcctcagattgctctccgagctgtctagttggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcaggtacagtgacagctgattggaatttgtggtggttcattacaatgaaaaaaggaagtgggtcactcacaacggaaatgccagtagcatgttaggctcatcatgtacaaccgtattccttgaaattccattctggggctcagtagcctgaaggtgaggctacagtaggacacctggcttcaggaaccttcaagaagctctctcttttgtcctggaacaggatgtgactgcacagcctggtgctcccaactgcacgtcagaatagtatgatcggttgggcttcctcctgaatctggactctaaactgcctgctgaattagccaccaagtacgca

SEQ ID NO: 186460 - DNA, 1007 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000533997
  CDS Start-End: 1-348
atgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccgtgagaaggttcgaaccttcatggcatggttggcatggtatggttgatgatttatcatcctggcctcctcgagagaatggactctgagagaaagacaagagcagaagctgcacattgaccatcatagtggtccagaaatgattatttggactagggccgtagcagtggagagaggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgtcctggacgcacaatatccagcgagagaaagagtttctgcggaagctggtgaaagctcgcgtcatcactgatctaagcagtggcatctga

SEQ ID NO: 186461 - DNA, 873 bp, Homo sapiens
  Payload ID: 16722
  Gene Symbol: ST3GAL3
  Gene Name: ST3 beta-galactoside alpha-2,3-sialyltransferase 3
  ENST ID: ENST00000479383
  CDS Start-End: 167-424
gcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcaggtacagtgacagctgattggaatttgtggtggttcattacaatgaaaaaaggaagtgggtcactcacaacggaaatgccagtagcatgttaggctcatcatgtacaaccgtattccttgaaattccattctggggctcagtagcctgaaggtgaggctacagtaggacacctggcttcaggaaccttcaagaagctctctcttttgtcctggaacaggatgtgactgcacagcctggtgctcccaactgcacgtcagaatgtagagtatgatcggttgggcttcctcctgaatctggactctaaactagattttgaagtcactgagcgaggacacagcctttgcattaggatttttaaagctgcccagtaccattcagctcatgctggatacatcatttcatgaggctgcgctatccttcctgagacctgggagtatctcaaagatgggactgctttgttggtcatgaacacacaccagtgtcagagagtgcagggaaagtgtaaatggcctgctgaattagccaccaagtacgcaaactt

SEQ ID NO: 186462 - DNA, 786 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000531993
  CDS Start-End: 1-786
atgggactcttggtatttgtgcgcaatctgctgctagccctctgcctctttctggtactgggatttttgtattattctgcgtggaagctacacttactccagtgggaggaggactccaagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgtcctggacgcacaatatccagcgagagaaagagtttctgcggaagctggtgaaagctcgcgtcatcactgatctaagcagtggcatctga

SEQ ID NO: 186463 - DNA, 834 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000533933
  CDS Start-End: 1-834
atgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgtcctggacgcacaatatccagcgagagaaagagtttctgcggaagctggtgaaagctcgcgtcatcactgatctaagcagtggcatctga

SEQ ID NO: 186464 - DNA, 692 bp, Homo sapiens
  Payload ID: 16722
  Gene Symbol: ST3GAL3
  Gene Name: ST3 beta-galactoside alpha-2,3-sialyltransferase 3
  ENST ID: ENST00000461066
  CDS Start-End: 82-384
gccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccagtaagtatagtcactctagctcaccccaggagaagcctgttgcagattcagtggttctttcctttgactccgctggacaaacactaggctcaggtacagtgacagctgattggaatttgtggtggttcattacaatgaaaaaaggaagtgggtcactcacaacggaaatgccagtagcatgttaggctcatcatgtacaaccgtattccttgaaattccattctggggctcagtagcctgaaggtgaggctacagtaggacacctggcttcaggaaccttcaagaagctctctcttttgtcctggaacaggatgtgactgcacagcctggtgctcccaactgcacgtcagaatgtagagtatgatcggttgggcttcctcctgaatctggactctaaactgcctgctgaattagccaccaagtacgcaaacttttcagagggagcttgcaagcctggctatgcttcagccttgatgacggccatcttcccccg

SEQ ID NO: 186465 - DNA, 344 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000531816
  CDS Start-End: 1-306
atgggactcttggtatttgtgcgcaatctgctgctagccctctgcctctttctggtactgggatttttgtattattctgcgtggaagctacacttactccagtgggaggaggactccaagtatgatcggttgggcttcctcctgaatctggactctaaactgcctgctgaattagccaccaagtacgcaaacttttcagagggagcttgcaagcctggctatgcttcagccttgatgacggccatcttcccccgtcctggacgcacaatatccagcgagagaaagagtttctgcggaagctggtgaaagctcgcgtcatcactgatctaagcagtggcatctga

SEQ ID NO: 186466 - DNA, 1670 bp, Homo sapiens
  Payload ID: 16722
  Gene Symbol: ST3GAL3
  Gene Name: ST3 beta-galactoside alpha-2,3-sialyltransferase 3
  ENST ID: ENST00000530154
  CDS Start-End: 178-498
actatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccgagaaaacaagagaagatgacatgttagagaatgactgcggcaggaaacccactttagacagaagagtcagagaagacgtccctgaggaggtgacatttcaacagaaatctgaatgaaaacatagaaccagccttggaaagatgcagagccgttgtggaaaggtccagactcagaaaaaggcttgtatttaaggactggacagaagtgagaaggttcgaaccttcatggcatggttggcatggtatggttgatgatttatcatcctggcctcctcgagagaatggactctgagagaaagacaagagcagaagctgcacattgaccatcatagtggtccagaaatgattatttggactagggccgtagcagtggagagaggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgctctttcccaagcaaggccaagtacaggcagtgtcaagtaggtagcaagcaagagagaagacagaagtcaggtccagaaattcaggtccactctagaacagtcgatggagagagccaggagagagcagcaagggaagtgggagcacaggagggcagacaggagagagggcaggcacctcccagcccctcagctgctgcagatagggaggcagggcagctgcactgctgggtcttcttattggcccaggagccccctcaggccacagcagcacacccacagcatcccacatcctgtgcctgcccgacgactcccttcgtatcctcctctgttacacactggagccccaccacacgctctcttcaccatcatt

SEQ ID NO: 186467 - DNA, 599 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000528371
  CDS Start-End: 1-561
atgggactcttggtatttgtgcgcaatctgctgctagccctctgcctctttctggtactgggatttttgtattattctgcgtggaagctacacttactccagtgggaggaggactccaagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagtcctggacgcacaatatccagcgagagaaagagtttctgcggaagctggtgaaagctcgcgtcatcactgatctaagcagtggcatctga

SEQ ID NO: 186468 - DNA, 976 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000490541
  CDS Start-End: 1-222
atgggactcttggtatttgtgcgcaatctgctgctagccctctgcctctttctggtactgggatttttgtattattctgcgtggaagctacacttactccagtgggaggaggactccagttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgaggcccaggctctgagtgggcctgctctctgtagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctga

SEQ ID NO: 186469 - DNA, 420 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000531451
  CDS Start-End: 1-420
atgggactcttggtatttgtgcgcaatctgctgctagccctctgcctctttctggtactgggatttttgtattattctgcgtggaagctacacttactccagtgggaggaggactccaagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagtcctggacgcacaatatccagcgagagaaagagtttctgcggaagctggtgaaagctcgcgtcatcactga

SEQ ID NO: 186470 - DNA, 781 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000533212
  CDS Start-End: 1-456
atgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctga

SEQ ID NO: 186471 - DNA, 592 bp, Homo sapiens
  Payload ID: 16722
  Gene Symbol: ST3GAL3
  Gene Name: ST3 beta-galactoside alpha-2,3-sialyltransferase 3
  ENST ID: ENST00000490502
  CDS Start-End: 1-592
aaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagaggtttccacagtcacggagtattggagagtggtgacgaagaaggcaccgagccctggaaggggcagtaaaggtttgagcaaaggcccaactgatcacttcatctctcctttcagtcctggacgcacaatatccagcgagagaaagagtttctgcggaag

SEQ ID NO: 186472 - DNA, 998 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000489897
  CDS Start-End: 180-545
ccactatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccgagctaagagaaatggtgcatggagacaaaaacatatccaggcatatgtgctccgccagaggtgaagacagaggattgtggggacacagagaaggcccttcagctggaggagtgatgagagattgactggggagacgtcctggtgaagtctgatgcctgaactatgctgggaaaggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagtcctggacgcacaatatccagcgagagaaagagtttctgcggaagctggtgaaagctcgcgtcatcactgatctaagcagtggcatct

SEQ ID NO: 186473 - DNA, 893 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000530581
  CDS Start-End: 1-687
atgggactcttggtatttgtgcgcaatctgctgctagccctctgcctctttctggtactgggatttttgtattattctgcgtggaagctacacttactccagtgggaggaggactccaagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctga

SEQ ID NO: 186474 - DNA, 1667 bp, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENST ID: ENST00000545417
  CDS Start-End: 192-704
gccgctgcgtccccactatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccagtaagtatagtcactctagctcaccccaggagaagcctgttgcagattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatccataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctgagcctgg

SEQ ID NO: 186475 - DNA, 1790 bp, Homo sapiens
  Payload ID: 16723
  Gene Symbol: ST3GAL4
  Gene Name: ST3 beta-galactoside alpha-2,3-sialyltransferase 4
  Uniprot ID: Q11206
  ENST ID: ENST00000227495
  CDS Start-End: 244-1233
cccgggcccgggtccccgcctcccctgcaggcggactcgcccgctcccaggccggacccgcgcccgggacagggacccggccgagtcgagccgtcgcgccagcgctgcgccgccggtcggtgcgcctagcggatcggagctgcgcgcggaaccgtgctgccccgccccgctccacccgtgagggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacagtttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttaca

SEQ ID NO: 186476 - DNA, 1745 bp, Homo sapiens
  Payload ID: 16723
  Gene Symbol: ST3GAL4
  Gene Name: ST3 beta-galactoside alpha-2,3-sialyltransferase 4
  Uniprot ID: Q11206
  ENST ID: ENST00000356132
  CDS Start-End: 132-1151
ctttcacaaaaggtgaaatgagctctttgtagtgtttcccgcccaggctgcattttagaatcacagaggaggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaagctttcacctctgtgcagctactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaagca

SEQ ID NO: 186477 - DNA, 1724 bp, Homo sapiens
  Payload ID: 16723
  Gene Symbol: ST3GAL4
  Gene Name: ST3 beta-galactoside alpha-2,3-sialyltransferase 4
  Uniprot ID: Q11206
  ENST ID: ENST00000392669
  CDS Start-End: 132-1133
ctttcacaaaaggtgaaatgagctctttgtagtgtttcccgcccaggctgcattttagaatcacagaggaggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaa

SEQ ID NO: 186478 - DNA, 1812 bp, Homo sapiens
  Payload ID: 16723
  Gene Symbol: ST3GAL4
  Gene Name: ST3 beta-galactoside alpha-2,3-sialyltransferase 4
  Uniprot ID: Q11206
  ENST ID: ENST00000444328
  CDS Start-End: 220-1221
ctgcaggcggactcgcccgctcccaggccggacccgcgcccgggacagggacccggccgagtcgagccgtcgcgccagcgctgcgccgccggtcggtgcgcctagcggatcggagctgcgcgcggaaccgtgctgccccgccccgctccacccgtgagggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaa

SEQ ID NO: 186479 - DNA, 1669 bp, Homo sapiens
  Payload ID: 16723
  Gene Symbol: ST3GAL4
  Gene Name: ST3 beta-galactoside alpha-2,3-sialyltransferase 4
  Uniprot ID: Q11206
  ENST ID: ENST00000449406
  CDS Start-End: 142-1110
gggctcccccaccctggaggacaggcctcagaagccgtcttcagcaggatcctgggacctctgggggctgtggagggacagacagggagccaggggcccttctcttcatcttgaaggacagtgggctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaa

SEQ ID NO: 186480 - DNA, 1012 bp, Homo sapiens
  Payload ID: 16723
  Gene Symbol: ST3GAL4
  Gene Name: ST3 beta-galactoside alpha-2,3-sialyltransferase 4
  ENST ID: ENST00000524860
  CDS Start-End: 553-1012
ctggatcctcaaggacttgggttccaagtggaacttaacttgagatgattcctccccggcaccttgggaccttcatgccgtgggagaaggcttaggctgcctggaacatgggtccctgggtctgactggggcttctgcctcctgtccttttttctctccagtttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggcca

SEQ ID NO: 186481 - DNA, 763 bp, Homo sapiens
  Payload ID: 16723
  Gene Symbol: ST3GAL4
  Gene Name: ST3 beta-galactoside alpha-2,3-sialyltransferase 4
  ENST ID: ENST00000528858
  CDS Start-End: 137-763
aaggctcaggtgaaccagtttcatctgacctgcttgctaactcaaacatggctgcccaactgcgtgggctggcaaggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgg

SEQ ID NO: 186482 - DNA, 574 bp, Homo sapiens
  Payload ID: 16723
  Gene Symbol: ST3GAL4
  Gene Name: ST3 beta-galactoside alpha-2,3-sialyltransferase 4
  ENST ID: ENST00000526311
  CDS Start-End: 241-574
cgcttcctggggcttggtcctggggtttcatctcaggttgacccccgttaggaggaagtaagtaggaaggaaggagatttcctgggtattagggtgtcctcaagcctgcagctctcctgggactgcacagagtttactgtcggacatcagttctgatatggtgcagcagacatggagctggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaaca

SEQ ID NO: 186483 - DNA, 1745 bp, Homo sapiens
  Payload ID: 16723
  Gene Symbol: ST3GAL4
  Gene Name: ST3 beta-galactoside alpha-2,3-sialyltransferase 4
  ENST ID: ENST00000531217
  CDS Start-End: 244-624
cccgggcccgggtccccgcctcccctgcaggcggactcgcccgctcccaggccggacccgcgcccgggacagggacccggccgagtcgagccgtcgcgccagcgctgcgccgccggtcggtgcgcctagcggatcggagctgcgcgcggaaccgtgctgccccgccccgctccacccgtgagggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacc

SEQ ID NO: 186484 - DNA, 1919 bp, Homo sapiens
  Payload ID: 16723
  Gene Symbol: ST3GAL4
  Gene Name: ST3 beta-galactoside alpha-2,3-sialyltransferase 4
  Uniprot ID: Q11206
  ENST ID: ENST00000534083
  CDS Start-End: 390-1391
cgcgggtcggggtggggctgccacagccctgcggagctgctttccggggtccctttccctggaccagattttcgcgggaagccggatcctctccgttcccttggagtgagcaagcgggacagttctgcggaaagtttccgcccccaatcccccagccctgcgcccggactgaagcggcggcccccacctccagcatcctcgagcgatggtttctcccacaactaccccggtcaggtccagcacttgggagctgactgtgctggaggtgacaggctttgcggggtccgcctgtgtgcaggagtcgcaaggtcgctgagcaggacccaaaggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgaga

SEQ ID NO: 186485 - DNA, 545 bp, Homo sapiens
  Payload ID: 16723
  Gene Symbol: ST3GAL4
  Gene Name: ST3 beta-galactoside alpha-2,3-sialyltransferase 4
  ENST ID: ENST00000534733
  CDS Start-End: 214-355
agccccttccccgcccccaacccgggcccgggtccccgcctcccctgcaggcggactcgcccgctcccaggccggacccgcgcccgggacagggacccggccgagtcgagccgtcgcgccagcgctgcgccgccggtcggtgcgcctagcggatcggagctgcgcgcggaaccgtgctgccccgccccgctccacccgtgaggaggcttctgtatgagtgtcctgagtggccctggatggactactggctgtccctggcctcagaatcaccccaacccctgccacatttcggggagggaggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaagta

SEQ ID NO: 186486 - DNA, 1459 bp, Homo sapiens
  Payload ID: 16723
  Gene Symbol: ST3GAL4
  Gene Name: ST3 beta-galactoside alpha-2,3-sialyltransferase 4
  Uniprot ID: Q11206
  ENST ID: ENST00000530591
  CDS Start-End: 470-1459
gagccgcggggtcctcggccgcctgaccccagccggcgccgcgcctcccggagggggtcgggccctgcacgtgggcgcagcgcgggtcggggtggggctgccacagccctgcggagctgctttccggggtccctttccctggaccagattttcgcgggaagccggatcctctccgttcccttggagtgagcaagcgggacagttctgcggaaagtttccgcccccaatcccccagccctgcgcccggactgaagcggcggcccccacctccagcatcctcgagcgatggtttctcccacaactaccccggtcaggtccagcacttgggagctgactgtgctggaggtgacaggctttgcggggtccgcctgtgtgcaggagtcgcaaggtcgctgagcaggacccaaaggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacagtttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctga

SEQ ID NO: 186487 - DNA, 1825 bp, Homo sapiens
  Payload ID: 16723
  Gene Symbol: ST3GAL4
  Gene Name: ST3 beta-galactoside alpha-2,3-sialyltransferase 4
  Uniprot ID: Q11206
  ENST ID: ENST00000532243
  CDS Start-End: 266-1264
ccaccctggaggacaggcctcagaagccgtcttcagcaggatcctgggacctctgggggctgtggagggacagacagggagccaggggcccttctcttcatcttgaaggacagtgggtacaatcagggtcaagccctcagccagggccaggagagggccagagactgcttctgttgagttaggggtcggagggactcagaagggggcaggtgggaaggtggacgggggttgtacctgcctgttgctgcctctagctcctctctgcatgtgtcctgcaggctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacc

SEQ ID NO: 186488 - DNA, 987 bp, Homo sapiens
  Payload ID: 16723
  Gene Symbol: ST3GAL4
  Gene Name: ST3 beta-galactoside alpha-2,3-sialyltransferase 4
  Uniprot ID: Q11206
  ENST ID: ENST00000534457
  CDS Start-End: 1-987
atgtgtcctgcaggctggaagctcctggccatgttggctctggtcctggtcgtcatggtgtggtattccatctcccgggaagacagtttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctga

SEQ ID NO: 186489 - DNA, 550 bp, Homo sapiens
  Payload ID: 16723
  Gene Symbol: ST3GAL4
  Gene Name: ST3 beta-galactoside alpha-2,3-sialyltransferase 4
  ENST ID: ENST00000534452
  CDS Start-End: 271-550
agtttgcttagcgcaacactgacgctgttttggaatgaagacaagacaatgtagaactttactggggaagaggtcgaagaagggctaattgtcttgttgttcaagactggttagcgctgctcacctctgacgctgctcacctctgacgccaaaggtttttccctggaaggcagccctggaggatacctgtgtatctgtctttcacaaaaggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtg

SEQ ID NO: 186490 - DNA, 1967 bp, Homo sapiens
  Payload ID: 16723
  Gene Symbol: ST3GAL4
  Gene Name: ST3 beta-galactoside alpha-2,3-sialyltransferase 4
  Uniprot ID: Q11206
  ENST ID: ENST00000526727
  CDS Start-End: 375-1376
cagaaggagatggtgagaagaaccacaccagagaggctggagtaggccagcctggcttgggaccgagtcccgagtccctggctggaccctcggttttcccttccgtggcagggctcacctggatccttaatgccgcccttggaggagttaggaggatcctggatgagaaaactcaccctcaggatgattgccccagggagcagcttcctgctttctggtggaagggaggggcagacagtgggtgtgtcctgctccagtgtctaggcaggagagtttgtgaagctgaccggacacctgtggctcttatttcctaggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaa

SEQ ID NO: 186491 - DNA, 915 bp, Homo sapiens
  Payload ID: 16724
  Gene Symbol: ST3GAL5
  Gene Name: ST3 beta-galactoside alpha-2,3-sialyltransferase 5
  ENST ID: ENST00000306262
  CDS Start-End: 7-345
attagtatgcggacgaaggcggcgggctgcgcggagcggcgtcccctgcagccgcggaccgaggcagcggcggcacctgccggccgagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaaggttgtttcttcaagtttctgagccaaacttaactctaaaaagcaaatattctgtgttaaaagacagtaatcaacacgggagctacatcagacatcataggacaaattgtcatctagaagagtatatttttaatgcaggagagtttttaaaacccagattggtgtgatttcattccagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttat

SEQ ID NO: 186492 - DNA, 2366 bp, Homo sapiens
  Payload ID: 16724
  Gene Symbol: ST3GAL5
  Gene Name: ST3 beta-galactoside alpha-2,3-sialyltransferase 5
  Uniprot ID: Q9UNP4
  ENST ID: ENST00000377332
  CDS Start-End: 110-1366
ctgagcgggggagcggcggcccccagctgaatgggcgcgagagcggcgctgggggcgggtgggggcgcggggtaccgggctggcggccggccggcgccccctcattagtatgcggacgaaggcggcgggctgcgcggagcggcgtcccctgcagccgcggaccgaggcagcggcggcacctgccggccgagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaactctc

SEQ ID NO: 186493 - DNA, 2318 bp, Homo sapiens
  Payload ID: 16724
  Gene Symbol: ST3GAL5
  Gene Name: ST3 beta-galactoside alpha-2,3-sialyltransferase 5
  Uniprot ID: Q9UNP4
  ENST ID: ENST00000393805
  CDS Start-End: 146-1318
tgcgagagcatataaccagcatgtcttgagtcttttacccatgtgcctgttatatggatgctgctgtttttgtaagatgaaatgacccttggatattctgggttatgatcagcatttcttcgtctaggcgagaaaagaaacagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaactctc

SEQ ID NO: 186494 - DNA, 2225 bp, Homo sapiens
  Payload ID: 16724
  Gene Symbol: ST3GAL5
  Gene Name: ST3 beta-galactoside alpha-2,3-sialyltransferase 5
  Uniprot ID: Q9UNP4
  ENST ID: ENST00000393808
  CDS Start-End: 38-1225
tgggcaaccattatcctgtctcgccgccacccaggacatggcttctgttccaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaactctc

SEQ ID NO: 186495 - DNA, 530 bp, Homo sapiens
  Payload ID: 16724
  Gene Symbol: ST3GAL5
  Gene Name: ST3 beta-galactoside alpha-2,3-sialyltransferase 5
  ENST ID: ENST00000455892
  CDS Start-End: 113-530
gtgatgtggggccgctggtagaaatttgccggtgaccttccctgcaccctctctgcagccagccttgcggagaagacaggttttggcgaccttttgatttcttctgaattcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttct

SEQ ID NO: 186496 - DNA, 640 bp, Homo sapiens
  Payload ID: 16724
  Gene Symbol: ST3GAL5
  Gene Name: ST3 beta-galactoside alpha-2,3-sialyltransferase 5
  ENST ID: ENST00000433665
  CDS Start-End: 82-225
gaatgggcgcgagagcggcgctgggggcgggtgggggcgcggggtaccgggctggcggccggccggcgccccctcattagtatgcggacgaaggcggcgggctgcgcggagcggcgtcccctgcagccgcggaccgaggcagcggcggcacctgccggccgaggcactgtgaagacagtggtgtgcaaagcagagacccctgcttgcatggaatctgcattctagtgggggagacaagacaaacgtgtaattcaaaagtaaaaaacttatgaagaatcacatgtctcatgattagtgttataaagaaaaaagaaagcatgcatacaggaatatccacataagcaattttgcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagttt

SEQ ID NO: 186497 - DNA, 3362 bp, Homo sapiens
  Payload ID: 16725
  Gene Symbol: ST3GAL6
  Gene Name: ST3 beta-galactoside alpha-2,3-sialyltransferase 6
  Uniprot ID: Q9Y274
  ENST ID: ENST00000265261
  CDS Start-End: 637-1278
aaaccttctgctgagccttgtgtcacagtcagtccgcggcgccacaagcctcagtgtttacttctgccgcctgccagccgggcggggaaggggagtacccggccacccctcactttagctcctgcagctttccaaacaaaccagggcgggatgggagtgtcttcttggctgtggaaatcgatcctcctaccttgtcctgaagccacccgccgcctttcctcgtccctcccttcgcggtgattttccggtcccggcgcccggcgagggcgcgcggctggtgtccgccccgcccgaaaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgagtcagagctctgcatatattttaagaaaaggcattgaggaactcaatcaaaccagtattcttttcacacaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaaaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatgaactgcttcattttccaaaagtgtttcccaaaaatcagaaacctaaacacccaacaacaggaattattgccatcacattggcgttttacatatgtcacgaagttcacctagctggttttaaatacaacttttctgacctcaagagtcctttgcactactatgggaatgccaccatgtctttgatgaataagaacgcgtatcacaatgtgactgcagagcagctctttttgaaggacattatagaaaaaaacctcgtaatcaacttgactcaagattgactctacagactcagaagatgatgctaacagtgttagttttatttttgtactgcaatttttagtttaaaatatgttggatgcactcgtcaaataattatgtatactgtctgttgctgcctggtgattcataaccaccagcttaatttctgtgaatactgtatatttaacttatgaaaaccaagaaatgtaaagataacaggaaaataagttttgattgcattgtttttaaaataagctagttttctgaggtgttttcacacgtctttttatagttacttcatcttagatttttgaagggatatgacttcctactaaggatttagtttaccacaacaattctgactacaataagacattttgaggaggatatttggctactgtaaacatggctggtggaaaatcacgattgtggcttgatgtggcaagccgaaaccacttggctctggaaatctaagttcatactggtttaattaagctctctcctgacaacccccagaattaaatgaaccatgattgtgaagagtaatttggtacaatgaaggcagtgtttgtttttaagttaaaggaaatgggctaaacataaagttcttattagataagtaaataactaaagaaagaatacaattactaaactctgatggctttgtattattttaaagaaatgaagtttaactttatacagtgaagctaagctaggcaagctcaagaaggaaaaaaaaatcttgaacattatttttttttgcctgacttacttattcattaaattttgaaggttttccacttgaagtaaattaggaaaggtaaagaagataacagaacaagtaaacacttaagaaaagtcaagctgaggccgggcagggtggctcacacctgtaatcctaacaaacactttgggaggccgagggaggcagctggattgcctgaactcaggagttcaagaccagcctggccaacatggtgaaacctcatctctactaaaatacaaaataattagctgggcgtggtggtatgcgctgtagtcccaggtactcgggaggctgaggcacgagaattgcttgagcccgggaggcagaggttgcagtgagccaagatcgcgccactgcacttcagcctgggtgacagagtgaggctgtcttctaaaaaatataaaaagtgaagttgggatttttggatttaaatggtacaaaaagaatatctcattttcccatgattaaagctaatcttcagatggaaagcttgcctggctacctagggtgcaccagagaatctgatccaatgcaagccagtcaatcctacaaatgtggtgagctagtcttccttcctatattttaataaatgtaaccaaaggccatctggaggtaggggaatgagaggtgaagaaacagaaaaatagaggttataaggatggaactaaaagttgtcagaagaggtatgagctgaagaaagaattactctcttttgaccaataaatacaattgggaaacactggaaaaccatggcttgattactgacaaccaacctgcctctctaaagagggtgtataaagggtgaaatacattagatttggctcagaaacagaatgcggtacttataaagcagaataaaggggagaacagtagtagttgatctaacccagattagacatgaataccagcatatgtttgcagagtcccacagttttgattcctcttataactttttgaggtgcaaaaggaaggtaccagaactggaatcacatgtaatcaatcagtgtgattttcccctcataccacacagccataggctgcagtgtggctgctgaagttcaattgatataaagtaaatcaggcttcaaaaagaatggtgctgtgggtacacaaggacataaagatgggaacgatagacactgaggactgcggcggggggagcgaggggagcggggagggcaagggctgaaagactatgtattgggtactatgctcacaacctggatgatgggatcattcataccacaaacctcagtatcacacaatatacccatgtaacaacctgcactctgcacatgtacccttagaatctaaaataaaagttgaaattattttttt

SEQ ID NO: 186498 - DNA, 3571 bp, Homo sapiens
  Payload ID: 16725
  Gene Symbol: ST3GAL6
  Gene Name: ST3 beta-galactoside alpha-2,3-sialyltransferase 6
  Uniprot ID: Q9Y274
  ENST ID: ENST00000394162
  CDS Start-End: 492-1487
gtcgcccgggattggggctggcgggagcctgagactccgggcagggctgctccctcctctgctcccccgccagatccgcggggaaggaatcgtgcccgcgccgcccctggcccgcgccaccttcctttggtttctgccggcctcgggcttctgcggcccgatgtggcaggcgccgcgagagaggcagcagccggctggagcagcggcccctcaggtctcggagcccggtgcgcctctgcggtcgtcgctcctgggcctcggcgggtcactcttgccggccggcttcgctgcgggtttgcactgcccggcatttgcaagtgaggaagcagcacaaccctgggttttagataatttctaacagagaggccccagcaattcagcaggcagcgtcctgagtctttggcagcctggtccctctttcgcaaattctccacctttgcgaacagagggtctttaggacacagattcttaaaagtgcaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaacataccctgtaaaaagtgtgtggtggttggtaatggaggagttttgaagaataagacattaggagaaaaaatcgactcctatgatgtaataataagaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatgaactgcttcattttccaaaagtgtttcccaaaaatcagaaacctaaacacccaacaacaggaattattgccatcacattggcgttttacatatgtcacgaagttcacctagctggttttaaatacaacttttctgacctcaagagtcctttgcactactatgggaatgccaccatgtctttgatgaataagaacgcgtatcacaatgtgactgcagagcagctctttttgaaggacattatagaaaaaaacctcgtaatcaacttgactcaagattgactctacagactcagaagatgatgctaacagtgttagttttatttttgtactgcaatttttagtttaaaatatgttggatgcactcgtcaaataattatgtatactgtctgttgctgcctggtgattcataaccaccagcttaatttctgtgaatactgtatatttaacttatgaaaaccaagaaatgtaaagataacaggaaaataagttttgattgcattgtttttaaaataagctagttttctgaggtgttttcacacgtctttttatagttacttcatcttagatttttgaagggatatgacttcctactaaggatttagtttaccacaacaattctgactacaataagacattttgaggaggatatttggctactgtaaacatggctggtggaaaatcacgattgtggcttgatgtggcaagccgaaaccacttggctctggaaatctaagttcatactggtttaattaagctctctcctgacaacccccagaattaaatgaaccatgattgtgaagagtaatttggtacaatgaaggcagtgtttgtttttaagttaaaggaaatgggctaaacataaagttcttattagataagtaaataactaaagaaagaatacaattactaaactctgatggctttgtattattttaaagaaatgaagtttaactttatacagtgaagctaagctaggcaagctcaagaaggaaaaaaaaatcttgaacattatttttttttgcctgacttacttattcattaaattttgaaggttttccacttgaagtaaattaggaaaggtaaagaagataacagaacaagtaaacacttaagaaaagtcaagctgaggccgggcagggtggctcacacctgtaatcctaacaaacactttgggaggccgagggaggcagctggattgcctgaactcaggagttcaagaccagcctggccaacatggtgaaacctcatctctactaaaatacaaaataattagctgggcgtggtggtatgcgctgtagtcccaggtactcgggaggctgaggcacgagaattgcttgagcccgggaggcagaggttgcagtgagccaagatcgcgccactgcacttcagcctgggtgacagagtgaggctgtcttctaaaaaatataaaaagtgaagttgggatttttggatttaaatggtacaaaaagaatatctcattttcccatgattaaagctaatcttcagatggaaagcttgcctggctacctagggtgcaccagagaatctgatccaatgcaagccagtcaatcctacaaatgtggtgagctagtcttccttcctatattttaataaatgtaaccaaaggccatctggaggtaggggaatgagaggtgaagaaacagaaaaatagaggttataaggatggaactaaaagttgtcagaagaggtatgagctgaagaaagaattactctcttttgaccaataaatacaattgggaaacactggaaaaccatggcttgattactgacaaccaacctgcctctctaaagagggtgtataaagggtgaaatacattagatttggctcagaaacagaatgcggtacttataaagcagaataaaggggagaacagtagtagttgatctaacccagattagacatgaataccagcatatgtttgcagagtcccacagttttgattcctcttataactttttgaggtgcaaaaggaaggtaccagaactggaatcacatgtaatcaatcagtgtgattttcccctcataccacacagccataggctgcagtgtggctgctgaagttcaattgatataaagtaaatcaggcttcaaaaagaatggtgctgtgggtacacaaggacataaagatgggaacgatagacactgaggactgcggcggggggagcgaggggagcggggagggcaagggctgaaagactatgtattgggtactatgctcacaacctggatgatgggatcattcataccacaaacctcagtatcacacaatatacccatgtaacaacctgcactctgcacatgtacccttagaatctaaaataaaagttgaaattattttttt

SEQ ID NO: 186499 - DNA, 833 bp, Homo sapiens
  Payload ID: 16725
  Gene Symbol: ST3GAL6
  Gene Name: ST3 beta-galactoside alpha-2,3-sialyltransferase 6
  ENST ID: ENST00000476833
  CDS Start-End: 135-407
gccatgttccacacagtctggagtgtatgtcagtgtgagctgaagaccagcagagactaggatggatgacggcctgtccaggggctgaatggacacaggtgtcagcagggccacctggtaaaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgagtcagagctctgcatatattttaagaaaaggcattgaggaactcaatcaaaccagtattcttttcacacaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaaaaacagagagcccaggaccatgaggcttccgcctgctggacagcaaggacttccagtagcttctcagctgttttcccagtcactttcagaagcaaggctgctatagctaattgatgtatgcaagatgtaattacagccattgatagggaaaatatcagcaatatgatgcccttggaagctcagaaaaaagtcaaaaggctgtaccatgactctcacaatagccagatctgaatataaaatctagtctcttctggtgatggagaaaaggaagtgtcatccatacaagatgaattt

SEQ ID NO: 186500 - DNA, 809 bp, Homo sapiens
  Payload ID: 16725
  Gene Symbol: ST3GAL6
  Gene Name: ST3 beta-galactoside alpha-2,3-sialyltransferase 6
  ENST ID: ENST00000492254
  CDS Start-End: 22-809
gaccagcagagactaggatggatgacggcctgtccaggggctgaatggacacaggtgtcagcagggccacctggtaaaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaacataccctgtaaaaagtgtgtggtggttggtaatggaggagttttgaagaataagacattaggagaaaaaatcgactcctatgatgtaataataagaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatga

SEQ ID NO: 186501 - DNA, 1886 bp, Homo sapiens
  Payload ID: 16725
  Gene Symbol: ST3GAL6
  Gene Name: ST3 beta-galactoside alpha-2,3-sialyltransferase 6
  Uniprot ID: Q9Y274
  ENST ID: ENST00000483910
  CDS Start-End: 290-1285
gtgtcacagtcagtccgcggcgccacaagcctcagtgtttacttctgccgcctgccagccgggcggggaaggggagtacccggccacccctcactttagctcctgcagctttccaaacaaaccagggcgggatgggagtgtcttcttggctgtggaaatcgatcctcctaccttgtcctgaagccacccgccgcctttcctcgtccctcccttcgcggtgattttccggtcccggcgcccggcgagggcgcgcggctggtgtccgccccgcccgaaaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaacataccctgtaaaaagtgtgtggtggttggtaatggaggagttttgaagaataagacattaggagaaaaaatcgactcctatgatgtaataataagaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatgaactgcttcattttccaaaagtgtttcccaaaaatcagaaacctaaacacccaacaacaggaattattgccatcacattggcgttttacatatgtcacgaagttcacctagctggttttaaatacaacttttctgacctcaagagtcctttgcactactatgggaatgccaccatgtctttgatgaataagaacgcgtatcacaatgtgactgcagagcagctctttttgaaggacattatagaaaaaaacctcgtaatcaacttgactcaagattgactctacagactcagaagatgatgctaacagtgttagttttatttttgtactgcaatttttagtttaaaatatgttggatgcactcgtcaaataattatgtatactgtctgttgctgcctggtgattcataaccaccagcttaatttctgtgaatactgtatatttaacttatgaaaaccaagaaatgtaaagataacaggaaaataagttttgattgcattgtttttaaaataagctagttttctgaggtgttttcacacgtctttttatagttacttcatcttagatttttgaagggatatgacttcctactaaggatttagtttaccacaacaattctgactacaataagacattttgaggaggatatttggctactgtaaacatggctggtggaaaatcacgattgtggcttgatgtggcaagccgaaaccacttggctctggaaatctaagttcatactggtttaattaagctctctcctgacaacccccagaattaaatgaaccatgattgtgaagagtaatttggtacaatgaaggcagtgtttgtttttaagttaaaggaaatgggctaaacataaagttcttattagataagt

SEQ ID NO: 186502 - DNA, 564 bp, Homo sapiens
  Payload ID: 16725
  Gene Symbol: ST3GAL6
  Gene Name: ST3 beta-galactoside alpha-2,3-sialyltransferase 6
  ENST ID: ENST00000497008
  CDS Start-End: 70-564
attttccggtcccggcgcccggcgagggcgcgcggctggtgtccgccccgcccgaaaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaaaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctg

SEQ ID NO: 186503 - DNA, 2109 bp, Homo sapiens
  Payload ID: 16725
  Gene Symbol: ST3GAL6
  Gene Name: ST3 beta-galactoside alpha-2,3-sialyltransferase 6
  ENST ID: ENST00000497621
  CDS Start-End: 151-348
attggggctggcgggagcctgagactccgggcagggctgctccctcctctgctcccccgccagatccgcggggaaggaatcgtgcccgcgccgcccctggcccgcgccaccttcctttggtttctgccggcctcgggcttctgcggcccgatgtggcaggcgccgcgagagaggcagcagccggctggagcagcggcccctcaggtctcggagcccggtgcgcctctgcggtcgtcgctcctgggcctcggcgggtcactcttgccggccggcttcgctgcgggtttgcactgcccggcatttgcaagtgaggaagcagcacaaccctgggttttagataatttctaacagagaggccccagcaattcagcaggcagcgtcctgagtctttggcagcctggtccctctttcgcaaattctccacctttgcgaacagagggtctttaggacacagattcttaaaagtgcaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaacataccctgtaaaaagtgtgtggtggttggtaatggaggagttttgaagaataagacattaggagaaaaaatcgactcctatgatgtaataataagaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatgaactgcttcattttccaaaagtgtttcccaaaaatcagaaacctaaacacccaacaacaggaattattgccatcacattggcgttttacatatgtcacgaagttcacctagctggttttaaatacaacttttctgacctcaagagtcctttgcactactatgggaatgccaccatgtctttgatgaataagaacgcgtatcacaatgtgactgcagagcagctctttttgaaggacattatagaaaaaaacctcgtaatcaacttgactcaagattgactctacagactcagaagatgatgctaacagtgttagttttatttttgtactgcaatttttagtttaaaatatgttggatgcactcgtcaaataattatgtatactgtctgttgctgcctggtgattcataaccaccagcttaatttctgtgaatactgtatatttaacttatgaaaaccaagaaatgtaaagataacaggaaaataagttttgattgcattgtttttaaaataagctagttttctgaggtgttttcacacgtctttttatagttacttcatcttagatttttgaagggatatgacttcctactaaggatttagtttaccacaacaattctgactacaataagacattttgaggaggatatttggctactgtaaacatggctggtggaaaatcacgattgtggcttgatgtggcaagccgaaaccacttggctctggaaatctaagttcatactggtttaattaagctctctcctgacaacccccagaattaaatgaaccatgattgtgaagagtaatttggtacaatgaaggcagtgtttgtttttaagttaaaggaaatgggctaaacataaagttcttattagataagtaaataactaaagaaagaatacaattactaaa

SEQ ID NO: 186504 - DNA, 767 bp, Homo sapiens
  Payload ID: 16725
  Gene Symbol: ST3GAL6
  Gene Name: ST3 beta-galactoside alpha-2,3-sialyltransferase 6
  ENST ID: ENST00000485391
  CDS Start-End: 112-767
agtgtgagctgaagaccagcagagactaggatggatgacggcctgtccaggggctgaatggacacaggtgtcagcagggccacctggtaaaggtatggaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaaaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatgaactgcttcattttccaaaagtgtttcccaaaaa

SEQ ID NO: 186505 - DNA, 750 bp, Homo sapiens
  Payload ID: 16725
  Gene Symbol: ST3GAL6
  Gene Name: ST3 beta-galactoside alpha-2,3-sialyltransferase 6
  ENST ID: ENST00000486334
  CDS Start-End: 56-750
ggcgctcggcgcagtcgcccgggattggggctggcgggagcctgagactccggccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaacataccctgtaaaaagtgtgtggtggttggtaatggaggagttttgaagaataagacattaggagaaaaaatcgactcctatgatgtaataataagaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatccttt

SEQ ID NO: 186506 - DNA, 700 bp, Homo sapiens
  Payload ID: 16725
  Gene Symbol: ST3GAL6
  Gene Name: ST3 beta-galactoside alpha-2,3-sialyltransferase 6
  ENST ID: ENST00000485145
  CDS Start-End: 228-700
agtataaagtggacaccccatatttaaggaagagcttgaatatcctgtctctttttgtgcttttagtcagagctctgcatatattttaagaaaaggcattgaggaactcaatcaaaccagtattcttttcacacaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaacataccctgtaaaaagtgtgtggtggttggtaatggaggagttttgaagaataagacattaggagaaaaaatcgactcctatgatgtaataataagaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatgaactgcttcattt

SEQ ID NO: 186507 - DNA, 582 bp, Homo sapiens
  Payload ID: 16725
  Gene Symbol: ST3GAL6
  Gene Name: ST3 beta-galactoside alpha-2,3-sialyltransferase 6
  ENST ID: ENST00000460774
  CDS Start-End: 280-582
cagtccgcggcgccacaagcctcagtgtttacttctgccgcctgccagccgggcggggaaggggagtacccggccacccctcactttagctcctgcagctttccaaacaaaccagggcgggatgggagtgtcttcttggctgtggaaatcgatcctcctaccttgtcctgaagccacccgccgcctttcctcgtccctcccttcgcggtgattttccggtcccggcgcccggcgagggcgcgcggctggtgtccgccccgcccgaaaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgaggtttcatcagtttcacccttttctgtgtgcggctgattttagaaagattgcttccttgtatggtagcgataagtttgatttgccctatgggatgagaacatcagcataccctgtaaaaagtgtgtggtggttggta

SEQ ID NO: 186508 - DNA, 2837 bp, Homo sapiens
  Payload ID: 16725
  Gene Symbol: ST3GAL6
  Gene Name: ST3 beta-galactoside alpha-2,3-sialyltransferase 6
  ENST ID: ENST00000469105
  CDS Start-End: 279-551
agtccgcggcgccacaagcctcagtgtttacttctgccgcctgccagccgggcggggaaggggagtacccggccacccctcactttagctcctgcagctttccaaacaaaccagggcgggatgggagtgtcttcttggctgtggaaatcgatcctcctaccttgtcctgaagccacccgccgcctttcctcgtccctcccttcgcggtgattttccggtcccggcgcccggcgagggcgcgcggctggtgtccgccccgcccgaaaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgagtcagagctctgcatatattttaagaaaaggcattgaggaactcaatcaaaccagtattcttttcacacaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaacataccctgtaaaaagtgtgtggtggttggtaatggaggagttttgaagaataagacattaggagaaaaaatcgactcctatgatgtaataataagaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatgaactgcttcattttccaaaagtgtttcccaaaaatcagaaacctaaacacccaacaacaggaattattgccatcacattggcgttttacatatgtcacgaagttcacctagctggttttaaatacaacttttctgacctcaagagtcctttgcactactatgggaatgccaccatgtctttgatgaataagaacgcgtatcacaatgtgactgcagagcagctctttttgaaggacattatagaaaaaaacctcgtaatcaacttgactcaagattgactctacagactcagaagatgatgctaacagtgttagttttatttttgtactgcaatttttagtttaaaatatgttggatgcactcgtcaaataattatgtatactgtctgttgctgcctggtgattcataaccaccagcttaatttctgtgaatactgtatatttaacttatgaaaaccaagaaatgtaaagataacaggaaaataagttttgattgcattgtttttaaaataagctagttttctgaggtgttttcacacgtctttttatagttacttcatcttagatttttgaagggatatgacttcctactaaggatttagtttaccacaacaattctgactacaataagacattttgaggaggatatttggctactgtaaacatggctggtggaaaatcacgattgtggcttgatgtggcaagccgaaaccacttggctctggaaatctaagttcatactggtttaattaagctctctcctgacaacccccagaattaaatgaaccatgattgtgaagagtaatttggtacaatgaaggcagtgtttgtttttaagttaaaggaaatgggctaaacataaagttcttattagataagtaaataactaaagaaagaatacaattactaaactctgatggctttgtattattttaaagaaatgaagtttaactttatacagtgaagctaagctaggcaagctcaagaaggaaaaaaaaatcttgaacattatttttttttgcctgacttacttattcattaaattttgaaggttttccacttgaagtaaattaggaaaggtaaagaagataacagaacaagtaaacacttaagaaaagtcaagctgaggccgggcagggtggctcacacctgtaatcctaacaaacactttgggaggccgagggaggcagctggattgcctgaactcaggagttcaagaccagcctggccaacatggtgaaacctcatctctactaaaatacaaaataattagctgggcgtggtggtatgcgctgtagtcccaggtactcgggaggctgaggcacgagaattgcttgagcccgggaggcagaggttgcagtgagccaagatcgcgccactgcacttcagcctgggtgacagagtgaggctgtcttctaaaaaatataaaaagtgaagttgggatttttggatttaaatggtacaaaaagaatatctcattttcccatgattaaagctaatcttcagatggaaagcttgcctggctacctagggtgcaccagagaatctgatccaatgcaagccagtcaatcctacaaatgtggtgagctagtcttccttcctatattttaataaatgtaaccaaaggccatctggaggtaggggaatgagaggtgaagaaacagaaaaatagaggttataaggatggaactaaaagttgtcagaagaggtatgagctgaagaaagaattactctcttttgaccaataaatacaattgggaaacactggaaaa

SEQ ID NO: 186509 - DNA, 489 bp, Homo sapiens
  Payload ID: 16725
  Gene Symbol: ST3GAL6
  Gene Name: ST3 beta-galactoside alpha-2,3-sialyltransferase 6
  ENST ID: ENST00000477574
  CDS Start-End: 127-489
gatttgtagagtcccccggatcccaaggcaagggtctatggaacctgttcaggtcaggtgtttctgtggtgttcgctgccggtgtgcgtcagcagatgtggcaggaggagggtggcacctgtggaaatgaaacggagaaataagatccagccttgtttatcaaagccagcttttgcctctctgctgaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaacataccctgtaaaaagtgtgtggtggttggtaatggaggagttttgaagaataagacattaggagaaaaaatcgactcctatgatgtaataataagaatgaataatggtcctgttttaggacatgaagaagaa

SEQ ID NO: 186510 - DNA, 3148 bp, Homo sapiens
  Payload ID: 16725
  Gene Symbol: ST3GAL6
  Gene Name: ST3 beta-galactoside alpha-2,3-sialyltransferase 6
  ENST ID: ENST00000486249
  CDS Start-End: 95-367
tttcctcgtccctcccttcgcggtgattttccggtcccggcgcccggcgagggcgcgcggctggtgtccgccccgcccgaaaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgagtcagagctctgcatatattttaagaaaaggcattgaggaactcaatcaaaccagtattcttttcacacaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaaaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatgaactgcttcattttccaaaagtgtttcccaaaaatcagaaacctaaacacccaacaacaggaattattgccatcacattggcgttttacatatgtcacgaagttcacctagctggttttaaatacaacttttctgacctcaagagtcctttgcactactatgggaatgccaccatgtctttgatgaataagaacgcgtatcacaatgtgactgcagagcagctctttttgaaggacattatagaaaaaaacctcgtaatcaacttgactcaagattgactctacagactcagaagatgatgctaacagtgttagttttatttttgtactgcaatttttagtttaaaatatgttggatgcactcgtcaaataattatgtatactgtctgttgctgcctggtgattcataaccaccagcttaatttctgtgaatactgtatatttaacttatgaaaaccaagaaatgtaaagataacaggaaaataagttttgattgcattgtttttaaaataagctagttttctgaggtgttttcacacgtctttttatagttacttcatcttagatttttgaagggatatgacttcctactaaggatttagtttaccacaacaattctgactacaataagacattttgaggaggatatttggctactgtaaacatggctggtggaaaatcacgattgtggcttgatgtggcaagccgaaaccacttggctctggaaatctaagttcatactggtttaattaagctctctcctgacaacccccagaattaaatgaaccatgattgtgaagagtaatttggtacaatgaaggcagtgtttgtttttaagttaaaggaaatgggctaaacataaagttcttattagataagtaaataactaaagaaagaatacaattactaaactctgatggctttgtattattttaaagaaatgaagtttaactttatacagtgaagctaagctaggcaagctcaagaaggaaaaaaaaatcttgaacattatttttttttgcctgacttacttattcattaaattttgaaggttttccacttgaagtaaattaggaaaggtaaagaagataacagaacaagtaaacacttaagaaaagtcaagctgaggccgggcagggtggctcacacctgtaatcctaacaaacactttgggaggccgagggaggcagctggattgcctgaactcaggagttcaagaccagcctggccaacatggtgaaacctcatctctactaaaatacaaaataattagctgggcgtggtggtatgcgctgtagtcccaggtactcgggaggctgaggcacgagaattgcttgagcccgggaggcagaggttgcagtgagccaagatcgcgccactgcacttcagcctgggtgacagagtgaggctgtcttctaaaaaatataaaaagtgaagttgggatttttggatttaaatggtacaaaaagaatatctcattttcccatgattaaagctaatcttcagatggaaagcttgcctggctacctagggtgcaccagagaatctgatccaatgcaagccagtcaatcctacaaatgtggtgagctagtcttccttcctatattttaataaatgtaaccaaaggccatctggaggtaggggaatgagaggtgaagaaacagaaaaatagaggttataaggatggaactaaaagttgtcagaagaggtatgagctgaagaaagaattactctcttttgaccaataaatacaattgggaaacactggaaaaccatggcttgattactgacaaccaacctgcctctctaaagagggtgtataaagggtgaaatacattagatttggctcagaaacagaatgcggtacttataaagcagaataaaggggagaacagtagtagttgatctaacccagattagacatgaataccagcatatgtttgcagagtcccacagttttgattcctcttataactttttgaggtgcaaaaggaaggtaccagaactggaatcacatgtaatcaatcagtgtgattttcccctcataccacacagccataggctgcagtgtggctgctgaagttcaattgatataaagtaaatcaggcttcaaaaagaatggtgctgtgggtacacaaggacataaagatgggaacgatagacactgaggactgcggcggggggagcgaggggagcggggagggcaagggctgaaagactatgtattgggtactatgctcacaacctggatgatgggatcattcataccacaaacctcagtatcacacaatatacccatgtaacaacctgcactctgcacatgtacccttagaatctaaaataaaagttgaaattattttttt

SEQ ID NO: 186511 - DNA, 715 bp, Homo sapiens
  Payload ID: 16725
  Gene Symbol: ST3GAL6
  Gene Name: ST3 beta-galactoside alpha-2,3-sialyltransferase 6
  ENST ID: ENST00000468553
  CDS Start-End: 127-567
ccacacagtctggagtgtatgtcagtgtgagctgaagaccagcagagactaggatggatgacggcctgtccaggggctgaatggacacaggtgtcagcagggccacctggtaaaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaaaaacagagagcccaggaccatgaggcttccgcctgctggacagcaaggacttccagtagcttctcagctgttttcccagtcactttcagaagcaaggctgctatagctaattgatgtatgcaagatgtaattacagccattgatagggaaaatatcagcaatatgatgcccttggaagctcagaaaaaagtcaaaaggctgtaccatgactctcacaatagccagatctgaatataaaatctagtctcttctgg

SEQ ID NO: 186512 - DNA, 685 bp, Homo sapiens
  Payload ID: 16725
  Gene Symbol: ST3GAL6
  Gene Name: ST3 beta-galactoside alpha-2,3-sialyltransferase 6
  ENST ID: ENST00000495376
  CDS Start-End: 104-376
ctgaagaccagcagagactaggatggatgacggcctgtccaggggctgaatggacacaggtgtcagcagggccacctggtaaaggtatggaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgagtcagagctctgcatatattttaagaaaaggcattgaggaactcaatcaaaccagtattcttttcacacaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaaactcccagaaaaaagaaataaaaaaaatgcaaagaaaatttaaatgaacaaacagacccttctggaacctactgtgacatgagatgtgtccacaaggcgaggtttcaggcacacactgaaggagcatctgctggacagccctccccgcccccaagtccttaccaacctgtgccactg

SEQ ID NO: 186513 - DNA, 3399 bp, Homo sapiens
  Payload ID: 16725
  Gene Symbol: ST3GAL6
  Gene Name: ST3 beta-galactoside alpha-2,3-sialyltransferase 6
  ENST ID: ENST00000613264
  CDS Start-End: 161-1315
gtcgcccgggattggggctggcgggagcctgagactccgggcagggctgctccctcctctgctcccccgccagatccgcggggaaggaatcgtgcccgcgccgcccctggcccgcgccaccttcctttggtttctgccggcctcgggcttctgcggcccgatgtggcaggcgccgcgagagaggcagcagccggctggagcagcggcccctcaggtctcggagcccggtgcgcctctgcggtcgtcgctcctgggcctcggcgggtcactcttgccggccggcttcgctgcgggtttgcactgcccgggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaacataccctgtaaaaagtgtgtggtggttggtaatggaggagttttgaagaataagacattaggagaaaaaatcgactcctatgatgtaataataagaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatgaactgcttcattttccaaaagtgtttcccaaaaatcagaaacctaaacacccaacaacaggaattattgccatcacattggcgttttacatatgtcacgaagttcacctagctggttttaaatacaacttttctgacctcaagagtcctttgcactactatgggaatgccaccatgtctttgatgaataagaacgcgtatcacaatgtgactgcagagcagctctttttgaaggacattatagaaaaaaacctcgtaatcaacttgactcaagattgactctacagactcagaagatgatgctaacagtgttagttttatttttgtactgcaatttttagtttaaaatatgttggatgcactcgtcaaataattatgtatactgtctgttgctgcctggtgattcataaccaccagcttaatttctgtgaatactgtatatttaacttatgaaaaccaagaaatgtaaagataacaggaaaataagttttgattgcattgtttttaaaataagctagttttctgaggtgttttcacacgtctttttatagttacttcatcttagatttttgaagggatatgacttcctactaaggatttagtttaccacaacaattctgactacaataagacattttgaggaggatatttggctactgtaaacatggctggtggaaaatcacgattgtggcttgatgtggcaagccgaaaccacttggctctggaaatctaagttcatactggtttaattaagctctctcctgacaacccccagaattaaatgaaccatgattgtgaagagtaatttggtacaatgaaggcagtgtttgtttttaagttaaaggaaatgggctaaacataaagttcttattagataagtaaataactaaagaaagaatacaattactaaactctgatggctttgtattattttaaagaaatgaagtttaactttatacagtgaagctaagctaggcaagctcaagaaggaaaaaaaaatcttgaacattatttttttttgcctgacttacttattcattaaattttgaaggttttccacttgaagtaaattaggaaaggtaaagaagataacagaacaagtaaacacttaagaaaagtcaagctgaggccgggcagggtggctcacacctgtaatcctaacaaacactttgggaggccgagggaggcagctggattgcctgaactcaggagttcaagaccagcctggccaacatggtgaaacctcatctctactaaaatacaaaataattagctgggcgtggtggtatgcgctgtagtcccaggtactcgggaggctgaggcacgagaattgcttgagcccgggaggcagaggttgcagtgagccaagatcgcgccactgcacttcagcctgggtgacagagtgaggctgtcttctaaaaaatataaaaagtgaagttgggatttttggatttaaatggtacaaaaagaatatctcattttcccatgattaaagctaatcttcagatggaaagcttgcctggctacctagggtgcaccagagaatctgatccaatgcaagccagtcaatcctacaaatgtggtgagctagtcttccttcctatattttaataaatgtaaccaaaggccatctggaggtaggggaatgagaggtgaagaaacagaaaaatagaggttataaggatggaactaaaagttgtcagaagaggtatgagctgaagaaagaattactctcttttgaccaataaatacaattgggaaacactggaaaaccatggcttgattactgacaaccaacctgcctctctaaagagggtgtataaagggtgaaatacattagatttggctcagaaacagaatgcggtacttataaagcagaataaaggggagaacagtagtagttgatctaacccagattagacatgaataccagcatatgtttgcagagtcccacagttttgattcctcttataactttttgaggtgcaaaaggaaggtaccagaactggaatcacatgtaatcaatcagtgtgattttcccctcataccacacagccataggctgcagtgtggctgctgaagttcaattgatataaagtaaatcaggcttcaaaaagaatggtgctgtgggtacacaaggacataaagatgggaacgatagacactgaggactgcggcggggggagcgaggggagcggggagggcaagggctgaaagactatgtattgggtactatgctcacaacctggatgatgggatcattcataccacaaacctcagtatcacacaatatacccatgtaacaacctgcactctgcacatgtacccttagaatctaaaataaaagttgaaattattttttt

SEQ ID NO: 186514 - DNA, 2570 bp, Homo sapiens
  Payload ID: 16726
  Gene Symbol: ST6GALNAC1
  Gene Name: ST6 (alpha-N-acetyl-neuraminyl-2,3-beta-galactosyl-1,3)-N-acetylgalactosaminide alpha-2,6-sialyltransferase 1
  Uniprot ID: Q9NSC7
  ENST ID: ENST00000156626
  CDS Start-End: 201-2003
ataagccttcatacagcagtgaaggcggttcctcccttcccaggcagagactgataaactcagcacttgccggagtggctcattgttaagacaaagggtgtgcacttcctggccaggaaacctgagcggtgagactcccagctgcctacatcaaggccccaggacatgcagaaccttcctctagaacccgacccaccaccatgaggtcctgcctgtggagatgcaggcacctgagccaaggcgtccagtggtccttgcttctggctgtcctggtcttctttctcttcgccttgccctcttttattaaggagcctcaaacaaagccttccaggcatcaacgcacagagaacattaaagaaaggtctctacagtccctggcaaagcctaagtcccaggcacccacaagggcaaggaggacaaccatctatgcagagccagtgccagagaacaatgccctcaacacacaaacccagcccaaggcccacaccaccggagacagaggaaaggaggccaaccaggcaccgccggaggagcaggacaaggtgccccacacagcacagagggcagcatggaagagcccagaaaaagagaaaaccatggtgaacacactgtcacccagagggcaagatgcagggatggcctctggcaggacagaggcacaatcatggaagagccaggacacaaagacgacccaaggaaatgggggccagaccaggaagctgacggcctccaggacggtgtcagagaagcaccagggcaaagcggcaaccacagccaagacgctcattcccaaaagtcagcacagaatgctggctcccacaggagcagtgtcaacaaggacgagacagaaaggagtgaccacagcagtcatcccacctaaggagaagaaacctcaggccaccccaccccctgcccctttccagagccccacgacgcagagaaaccaaagactgaaggccgccaacttcaaatctgagcctcggtgggattttgaggaaaaatacagcttcgaaataggaggccttcagacgacttgccctgactctgtgaagatcaaagcctccaagtcgctgtggctccagaaactctttctgcccaacctcactctcttcctggactccagacacttcaaccagagtgagtgggaccgcctggaacactttgcaccaccctttggcttcatggagctcaactactccttggtgcagaaggtcgtgacacgcttccctccagtgccccagcagcagctgctcctggccagcctccccgctgggagcctccggtgcatcacctgtgccgtggtgggcaacgggggcatcctgaacaactcccacatgggccaggagatagacagtcacgactacgtgttccgattgagcggagctctcattaaaggctacgaacaggatgtggggactcggacatccttctacggctttaccgccttctccctgacccagtcactccttatattgggcaatcggggtttcaagaacgtgcctcttgggaaggacgtccgctacttgcacttcctggaaggcacccgggactatgagtggctggaagcactgcttatgaatcagacggtgatgtcaaaaaaccttttctggttcaggcacagaccccaggaagcttttcgggaagccctgcacatggacaggtacctgttgctgcacccagactttctccgatacatgaagaacaggtttctgaggtctaagaccctggatggtgcccactggaggatataccgccccaccactggggccctcctgctgctcactgcccttcagctctgtgaccaggtgagtgcttatggcttcatcactgagggccatgagcgcttttctgatcactactatgatacatcatggaagcggctgatcttttacataaaccatgacttcaagctggagagagaagtctggaagcggctacacgatgaagggataatccggctgtaccagcgtcctggtcccggaactgccaaagccaagaactgaccggggccagggctgccatggtctccttgcctgctccaaggcacaggatacagtgggaatcttgagactctttggccatttcccatggctcagactaagctccaagcccttcaggagttccaagggaacacttgaaccatggacaagactctctcaagatggcaaatggctaattgaggttctgaagttcttcagtacattgctgtaggtcctgaggccagggatttttaattaaatggggtgatgggtggccaataccacaattcctgctgaaaaacactcttccagtccaaaagcttcttgatacagaaaaaagagcctggatttacagaaacatatagatctggtttgaattccagatcgagtttacagttgtgaaatcttgaaggtattacttaacttcactacagattgtctagaagacctttctaggagttatctgattctagaagggtctatacttgtccttgtctttaagctatttgacaactctacgtgttgtagaaaactgataataatacaaatgattgttgtccatggaaaggcaaataaattttctacagtgaa

SEQ ID NO: 186515 - DNA, 2321 bp, Homo sapiens
  Payload ID: 16726
  Gene Symbol: ST6GALNAC1
  Gene Name: ST6 (alpha-N-acetyl-neuraminyl-2,3-beta-galactosyl-1,3)-N-acetylgalactosaminide alpha-2,6-sialyltransferase 1
  ENST ID: ENST00000359088
  CDS Start-End: 56-1471
ctacatcaaggccccaggacatgcagaaccttcctctagaacccgacccaccaccatgaggtcctgcctgtggagatgcaggcacctgagccaaggcgtccagtggtccttgcttctggctgtcctggtcttctttctcttcgccttgccctcttttattaaggagcctcaaacaaagccttccaggcatcaacgcacagagaacattaaagaaaggtctctacagtccctggcaaagcctaagtcccaggcacccacaagggcaaggaggacaaccatctatgcagagccagtgccagagaacaatgccctcaacacacaaacccagcccaaggcccacaccaccggagacagaggaaaggaggccaaccaggcaccgccggaggagcaggacaaggtgccccacacagcacagagggcagcatggaagagcccagaaaaagagaaaaccatggtgaacacactgtcacccagagggcaagatgcagggatggcctctggcaggacagaggcacaatcatggaagagccaggacacaaagacgacccaaggaaatgggggccagaccaggaagctgacggcctccaggacggtgtcagagaagcaccagggcaaagcggcaaccacagccaagacgctcattcccaaaagtcagcacagaatgctggctcccacaggagcagtgtcaacaaggacgagacagaaaggagtgaccacagcagtcatcccacctaaggagaagaaacctcaggccaccccaccccctgcccctttccagagccccacgacgcagagaaaccaaagactgaaggccgccaacttcaaatctgagcctcggtgggattttgaggaaaaatacagcttcgaaataggaggccttcagacgacttgccctgactctgtgaagatcaaagcctccaagtcgctgtggctccagaaactctttctgcccaacctcactctcttcctggactccagacacttcaaccagagtgagtgggaccgcctggaacactttgcaccaccctttggcttcatggagctcaactactccttggtgcagaaggtcgtgacacgcttccctccagtgccccagcagcagctgctcctggccagcctccccgctgggagcctccggtgcatcacctgtgccgtggtgggcaacgggggcatcctgaacaactcccacatgggccaggagatagacagtcacgactacgtgttccgattgagcggagctctcattaaaggctacgaacaggatgtggggactcggacatccttctacggctttaccgccttctccctgacccagtcactccttatattgggcaatcggggtttcaagaacgtgcctcttgggaaggcacagaccccaggaagcttttcgggaagccctgcacatggacaggtacctgttgctgcacccagactttctccgatacatgaagaacaggtttctgaggtctaagaccctggatggtgcccactggaggatataccgccccaccactggggccctcctgctgctcactgcccttcagctctgtgaccaggtgagtgcttatggcttcatcactgagggccatgagcgcttttctgatcactactatgatacatcatggaagcggctgatcttttacataaaccatgacttcaagctggagagagaagtctggaagcggctacacgatgaagggataatccggctgtaccagcgtcctggtcccggaactgccaaagccaagaactgaccggggccagggctgccatggtctccttgcctgctccaaggcacaggatacagtgggaatcttgagactctttggccatttcccatggctcagactaagctccaagcccttcaggagttccaagggaacacttgaaccatggacaagactctctcaagatggcaaatggctaattgaggttctgaagttcttcagtacattgctgtaggtcctgaggccagggatttttaattaaatggggtgatgggtggccaataccacaattcctgctgaaaaacactcttccagtccaaaagcttcttgatacagaaaaaagagcctggatttacagaaacatatagatctggtttgaattccagatcgagtttacagttgtgaaatcttgaaggtattacttaacttcactacagattgtctagaagacctttctaggagttatctgattctagaagggtctatacttgtccttgtctttaagctatttgacaactctacgtgttgtagaaaactgataataatacaaatgattgttgtccatggaaaggcaaataaattttctacagtgaa

SEQ ID NO: 186516 - DNA, 2657 bp, Homo sapiens
  Payload ID: 16726
  Gene Symbol: ST6GALNAC1
  Gene Name: ST6 (alpha-N-acetyl-neuraminyl-2,3-beta-galactosyl-1,3)-N-acetylgalactosaminide alpha-2,6-sialyltransferase 1
  ENST ID: ENST00000592042
  CDS Start-End: 149-340
gataaactcagcacttgccggagtggctcattgttaagacaaagggtgtgcacttcctggccaggaaacctgagcggtgagactcccagctgcctacatcaaggccccaggacatgcagaaccttcctctagaacccgacccaccaccatgaggtcctgcctgtggagatgcaggcacctgagccaaggcgtccagtggtccttgcttctggctgtcctggtcttctttctcttcgccttgccctcttttattaaggagcctcaaacaaagccttccaggatggtatcaagggctccaggacatctgatgcggtgccaaggcatgggagtgggacgctgacccttcgctattgagtagctgctgaaacagccattgttcctgccccttggctctttcaggtccacctggcttatgtgcatcaacgcacagagaacattaaagaaaggtctctacagtccctggcaaagcctaagtcccaggcacccacaagggcaaggaggacaaccatctatgcagagccagtgccagagaacaatgccctcaacacacaaacccagcccaaggcccacaccaccggagacagaggaaaggaggccaaccaggcaccgccggaggagcaggacaaggtgccccacacagcacagagggcagcatggaagagcccagaaaaagagaaaaccatggtgaacacactgtcacccagagggcaagatgcagggatggcctctggcaggacagaggcacaatcatggaagagccaggacacaaagacgacccaaggaaatgggggccagaccaggaagctgacggcctccaggacggtgtcagagaagcaccagggcaaagcggcaaccacagccaagacgctcattcccaaaagtcagcacagaatgctggctcccacaggagcagtgtcaacaaggacgagacagaaaggagtgaccacagcagtcatcccacctaaggagaagaaacctcaggccaccccaccccctgcccctttccagagccccacgacgcagagaaaccaaagactgaaggccgccaacttcaaatctgagcctcggtgggattttgaggaaaaatacagcttcgaaataggaggccttcagacgacttgccctgactctgtgaagatcaaagcctccaagtcgctgtggctccagaaactctttctgcccaacctcactctcttcctggactccagacacttcaaccagagtgagtgggaccgcctggaacactttgcaccaccctttggcttcatggagctcaactactccttggtgcagaaggtcgtgacacgcttccctccagtgccccagcagcagctgctcctggccagcctccccgctgggagcctccggtgcatcacctgtgccgtggtgggcaacgggggcatcctgaacaactcccacatgggccaggagatagacagtcacgactacgtgttccgattgagcggagctctcattaaaggctacgaacaggatgtggggactcggacatccttctacggctttaccgccttctccctgacccagtcactccttatattgggcaatcggggtttcaagaacgtgcctcttgggaaggacgtccgctacttgcacttcctggaaggcacccgggactatgagtggctggaagcactgcttatgaatcagacggtgatgtcaaaaaaccttttctggttcaggcacagaccccaggaagcttttcgggaagccctgcacatggacaggtacctgttgctgcacccagactttctccgatacatgaagaacaggtttctgaggtctaagaccctggatggtgcccactggaggatataccgccccaccactggggccctcctgctgctcactgcccttcagctctgtgaccaggtgagtgcttatggcttcatcactgagggccatgagcgcttttctgatcactactatgatacatcatggaagcggctgatcttttacataaaccatgacttcaagctggagagagaagtctggaagcggctacacgatgaagggataatccggctgtaccagcgtcctggtcccggaactgccaaagccaagaactgaccggggccagggctgccatggtctccttgcctgctccaaggcacaggatacagtgggaatcttgagactctttggccatttcccatggctcagactaagctccaagcccttcaggagttccaagggaacacttgaaccatggacaagactctctcaagatggcaaatggctaattgaggttctgaagttcttcagtacattgctgtaggtcctgaggccagggatttttaattaaatggggtgatgggtggccaataccacaattcctgctgaaaaacactcttccagtccaaaagcttcttgatacagaaaaaagagcctggatttacagaaacatatagatctggtttgaattccagatcgagtttacagttgtgaaatcttgaaggtattacttaacttcactacagattgtctagaagacctttctaggagttatctgattctagaagggtctatacttgtccttgtctttaagctatttgacaactctacgtgttgtagaaaactgataataatacaaatgattgttgtccatggaaaggcaaataaattttctacagtgaaga

SEQ ID NO: 186517 - DNA, 567 bp, Homo sapiens
  Payload ID: 16726
  Gene Symbol: ST6GALNAC1
  Gene Name: ST6 (alpha-N-acetyl-neuraminyl-2,3-beta-galactosyl-1,3)-N-acetylgalactosaminide alpha-2,6-sialyltransferase 1
  ENST ID: ENST00000589813
  CDS Start-End: 23-166
ctctagaacccgacccaccaccatgaggtcctgcctgtggagatgcaggcacctgagccaaggcgtccagtggtccttgcttctggctgtcctggtcttctttctcttcgccttgccctcttttattaaggagcctcaaacaaagccttccaggttgaccttgtaagtcacactatatcatggacatctttccatgtcgggacatacaggtccactcccttctttcaacagttgcttagcattccacagggcatcaacgcacagagaacattaaagaaaggtctctacagtccctggcaaagcctaagtcccaggcacccacaagggcaaggaggacaaccatctatgcagagccagtgccagagaacaatgccctcaacacacaaacccagcccaaggcccacaccaccggagacagaggaaaggaggccaaccaggcaccgccggaggagcaggacaaggtgccccacacagcacagagggcagcatggaagagcccagaaaaagagaaaaccatggtgaacacactgtcacccagagggcaagatgcagggatggcctctggca

SEQ ID NO: 186518 - DNA, 667 bp, Homo sapiens
  Payload ID: 16726
  Gene Symbol: ST6GALNAC1
  Gene Name: ST6 (alpha-N-acetyl-neuraminyl-2,3-beta-galactosyl-1,3)-N-acetylgalactosaminide alpha-2,6-sialyltransferase 1
  ENST ID: ENST00000585633
  CDS Start-End: 1-179
acgtccgctacttgcacttcctggaaggcacccgggactatgagtggctggaagcactgcttatgaatcagacggcacagaccccaggaagcttttcgggaagccctgcacatggacaggtacctgttgctgcacccagactttctccgatacatgaagaacaggtttctgaggtctaagaccctggatggtgcccactggaggatataccgccccaccactggggccctcctgctgctcactgcccttcagctctgtgaccaggtgagtgcttatggcttcatcactgagggccatgagcgcttttctgatcactactatgatacatcatggaagcggctgatcttttacataaaccatgacttcaagctggagagagaagtctggaagcggctacacgatgaagggataatccggctgtaccagcgtcctggtcccggaactgccaaagccaagaactgaccggggccagggctgccatggtctccttgcctgctccaaggcacaggatacagtgggaatcttgagactctttggccatttcccatggctcagactaagctccaagcccttcaggagttccaagggaacacttgaaccatggacaagactctctcaagatggcaaatggctaattgaggttctgaagttcttcagtacattgctg

SEQ ID NO: 186519 - DNA, 458 bp, Homo sapiens
  Payload ID: 16726
  Gene Symbol: ST6GALNAC1
  Gene Name: ST6 (alpha-N-acetyl-neuraminyl-2,3-beta-galactosyl-1,3)-N-acetylgalactosaminide alpha-2,6-sialyltransferase 1
  ENST ID: ENST00000590784
  CDS Start-End: 1-458
gggagcctccggtgcatcacctgtgccgtggtgggcaacgggggcatcctgaacaactcccacatgggccaggagatagacagtcacgactacgtgttccgattgagcggagctctcattaaaggctacgaacaggatgtggggactcggacatccttctacggctttaccgccttctccctgacccagtcactccttatattgggcaatcggggtttcaagaacgtgcctcttgggaaggacgtccgctacttgcacttcctggaaggcacccgggactatgagtggctggaagcactgcttatgaatcagacggtgatgtcaaaaaaccttttctggttcaggcacagaccccaggaagcttttcgggaagccctgcacatggacaggtttctgaggtctaagaccctggatggtgcccactggaggatataccgccccaccactggggccctcct

SEQ ID NO: 186520 - DNA, 419 bp, Homo sapiens
  Payload ID: 16726
  Gene Symbol: ST6GALNAC1
  Gene Name: ST6 (alpha-N-acetyl-neuraminyl-2,3-beta-galactosyl-1,3)-N-acetylgalactosaminide alpha-2,6-sialyltransferase 1
  ENST ID: ENST00000589992
  CDS Start-End: 23-214
ctctagaacccgacccaccaccatgaggtcctgcctgtggagatgcaggcacctgagccaaggcgtccagtggtccttgcttctggctgtcctggtcttctttctcttcgccttgccctcttttattaaggagcctcaaacaaagccttccaggatggtatcaagggctccaggacatctgatgcggtgccaaggcatgggagtgggacgctgacccttcgctattgagtagctgctgaaacagccattgttcctgccccttggctctttcaggtccacctggcttatgtgtgagagactttttttgggttttttttgttctgtttttttgaaaagccagtaccaaaagcttacataattgtatgattgcattcaaataacattcttgaaatgataaaattataaaaatacagaacaga

SEQ ID NO: 186521 - DNA, 2170 bp, Homo sapiens
  Payload ID: 16727
  Gene Symbol: ST6GALNAC2
  Gene Name: ST6 (alpha-N-acetyl-neuraminyl-2,3-beta-galactosyl-1,3)-N-acetylgalactosaminide alpha-2,6-sialyltransferase 2
  Uniprot ID: Q9UJ37
  ENST ID: ENST00000225276
  CDS Start-End: 321-1445
ctggagagagcgcagtggcaggagtggccgctgccgaagtcccccgggcagggggcagggccaaaggagcgcgcgctctgggcgccgggacgacactccagccccgggggacccgccgcccagctcccgagggtgcggcagcctctggccactcagccggggccgagagggagctgccgggcgggcaggcgccgcaggcacccggcgggcagggcggggcagggcaagacggccgcctccgcaagtgccacccggcccacccggttctctcccttctgcctgggacgtcagcggacggggcgctcgcgggccggggctgtatggggctcccgcgcgggtcgttcttctggctgctgctcctgctcacggctgcctgctcggggctcctctttgccctgtacttctcggcggtgcagcggtacccggggccagcggccggagccagggacaccacatcatttgaagcattctttcaatccaaggcatcgaattcttggacaggaaagggccaggcctgccgacacctgcttcacctggccattcagcggcacccccacttccgtggcctgttcaatctctccattccagtgctgctgtggggggacctcttcaccccagcgctctgggaccgcctgagccaacacaaagccccgtatggctggcgggggctctctcaccaagtcatcgcctccaccctgagccttctgaacggctcagagagtgccaagctgtttgccccgcccagggacacccctccaaagtgtatccggtgtgccgtggtgggcaacggaggcattctgaatgggtcccgccagggtcccaacatcgatgcccatgactatgtattcagactcaatggagctgtgatcaaaggcttcgagcgcgatgtgggcaccaagacttccttctatggtttcactgtgaacacgatgaagaactccctcgtctcctactggaatctgggcttcacctccgtgccacaaggacaggacctgcagtatatcttcatcccctcagacatccgcgactatgtgatgctgagatcggccattctgggcgtgcctgtccctgagggcctagataaaggggacaggccgcacgcctattttggaccagaagcctctgccagtaaattcaagctgctacatccggacttcatcagctacctgacagaaaggttcttgaaatcaaagttgattaacacacattttggagacctatatatgcctagtaccggggctctcatgctgctgacagctttgcatacctgtgaccaggtcagtgcctatggattcatcacaagcaactactggaaattttccgaccactatttcgaacgaaaaatgaagccattgatattttatgcaaaccacgatctgtccctggaagctgccctgtggagggacctgcacaaggccggcatccttcagctgtaccagcgctgaccccaatgcactgagccctttgcttcttcaagagttgcggccctgatcctctcaagtggccaaaagcttttttaacttttcaatcttcaccttcccttgccaacagagggcactggggtgaattcaagattttcatcgaggtctgttcaatataggacaccccagcttgtccttggctcatccaagaactcttctgtatctaaaacaatacatctcaatcttggccaagggaaaatggactgctttgctggattggcactgagcaactttaggaaatgtcggtggagtgttcagcaagatcagacagcagtccaggtcaaaggcaaacacacacgctccagcccaaatcctcctggtggcacatcctaccccagatgctaaagtgattcaaggactccaggacacctcttaagagcctttctaagaacatgataggcttacttctgctccataataaagtgggagaaaaaagccagaatataacttaagactagataactgcgtacatgatggaccatttttttttttttggctgggtagagaaatcatataaaacgcaggctgtttagcatggagatgactctcagaacactgggagggtctggcacttgatgggggttagttgcttggcagcctgcctgccactgagggaagtcccattagagatgtatcaccaccttgtcaccaacaggatgatgtcaccaggtaataaaccttcatcctca

SEQ ID NO: 186522 - DNA, 536 bp, Homo sapiens
  Payload ID: 16727
  Gene Symbol: ST6GALNAC2
  Gene Name: ST6 (alpha-N-acetyl-neuraminyl-2,3-beta-galactosyl-1,3)-N-acetylgalactosaminide alpha-2,6-sialyltransferase 2
  ENST ID: ENST00000585390
  CDS Start-End: 1-115
cgactatgtgatgctgagatcggccattctgggcgtgcctgtccctgagggcctagataaaggggacagccccgctcctaccgctcagggtaccgcggctactccggcgccctgaccctcccctccatctcccccttgcaatacgacggctctgggcgctctgtccacttctatcatgggtcctaggccgcacgcctattttggaccagaagcctctgccagtaaattcaagctgctacatccggacttcatcagctacctgacagaaaggttcttgaaatcaaagttgattaacacacattttggagacctatatatgcctagtaccggggctctcatgctgctgacagctttgcatacctgtgaccaggtcagtgcctatggattcatcacaagcaactactggaaattttccgaccactatttcgaacgaaaaatgaagccattgatattttatgcaaaccacgatctgtccctggaagctgccctgtggagggacctgcacaaggccggcatccttcagctgtaccagcgct

SEQ ID NO: 186523 - DNA, 746 bp, Homo sapiens
  Payload ID: 16727
  Gene Symbol: ST6GALNAC2
  Gene Name: ST6 (alpha-N-acetyl-neuraminyl-2,3-beta-galactosyl-1,3)-N-acetylgalactosaminide alpha-2,6-sialyltransferase 2
  ENST ID: ENST00000588120
  CDS Start-End: 49-303
cttctgcctgggacgtcagcggacggggcgctcgcgggccggggctgtatggggctcccgcgcgggtcgttcttctggctgctgctcctgctcacggctgcctgctcggggctcctctttgccctgtacttctcggcggtgcagcggtacccggggccagcggccggagccagggccaggcctgccgacacctgcttcacctggccattcagcggcacccccacttccgtggcctgttcaatctctccattccagtgctgctgtggggggacctcttcaccccagcgctctgggaccgcctgagccaacacaaagccccgtatggctggcgggggctctctcaccaagtcatcgcctccaccctgagccttctgaacggctcagagagtgccaagctgtttgccccgcccagggacacccctccaaagtgtatccggtgtgccgtggtgggcaacggaggcattctgaatgggtcccgccagggtcccaacatcgatgcccatgactatgtattcagactcaatggagctgtgatcaaaggcttcgagcgcgatgtgggcaccaagacttccttctatggtttcactgtgaacacgatgaagaactccctcgtctcctactggaatctgggcttcacctccgtgccacaaggacaggacctgcagtatatcttcatcccctcagacatccgcgactatgtgatgctgagatcggccattctgggcgtgcctgtccctgagggccta

SEQ ID NO: 186524 - DNA, 687 bp, Homo sapiens
  Payload ID: 16727
  Gene Symbol: ST6GALNAC2
  Gene Name: ST6 (alpha-N-acetyl-neuraminyl-2,3-beta-galactosyl-1,3)-N-acetylgalactosaminide alpha-2,6-sialyltransferase 2
  ENST ID: ENST00000585736
  CDS Start-End: 223-447
cagccccgggggacccgccgcccagctcccgagggtgcggcagcctctggccactcagccggggccgagagggagctgccgggcgggcaggcgccgcaggcacccggcgggcagggcggggcagggcaagacggccgcctccgcaagtgccacccggcccacccggttctctcccttctgcctgggacgtcagcggacggggcgctcgcgggccggggctgtatggggctcccgcgcgggtcgttcttctggctgctgctcctgctcacggctgcctgctcggggctcctctttgccctgtacttctcggcggtgcagcggtacccggggccagcggccggagccagctgccaacccagagtcccctccacctgtggctgctggggtgaagggaggggtctgagagaagcctggccaccttttgaaaggggacaccacatcatttgaagcattctttcaatccaaggcatcgaattcttggacaggaaagggccaggcctgccgacacctgcttcacctggccattcagcggcacccccacttccgtggcctgttcaatctctccattccagtgctgctgtggggggacctcttcaccccagcgctctgggaccgcctgagccaacacaaagccccgtatggctggcgggggctctctcaccaagtcatcgcctccaccctgagcct

SEQ ID NO: 186525 - DNA, 637 bp, Homo sapiens
  Payload ID: 16727
  Gene Symbol: ST6GALNAC2
  Gene Name: ST6 (alpha-N-acetyl-neuraminyl-2,3-beta-galactosyl-1,3)-N-acetylgalactosaminide alpha-2,6-sialyltransferase 2
  ENST ID: ENST00000588920
  CDS Start-End: 1-637
ctgagccttctgaacggctcagagagtgccaagctgtttgccccgcccagggacacccctccaaagtgtatccggtgtgccgtggtgggcaacggaggcattctgaatgggtcccgccagggtcccaacatcgatgcccatgactatgtattcagactcaatggagctgtgatcaaaggcttcgagcgcgatgtgggcaccaagacttccttctatggtttcactgtgaacacgatgaagaactccctcgtctcctactggaatctgggcttcacctccgtgccacaaggacaggacctgcagtatatcttcatcccctcagacatccgcgactatgtgatgctgagatcggccattctgggcgtgcctgtccctgagggcctagataaaggggacaggttcttgaaatcaaagttgattaacacacattttggagacctatatatgcctagtaccggggctctcatgctgctgacagctttgcatacctgtgaccaggtcagtgcctatggattcatcacaagcaactactggaaattttccgaccactatttcgaacgaaaaatgaagccattgatattttatgcaaaccacgatctgtccctggaagctgccctgtggagggacctgcacaagg

SEQ ID NO: 186526 - DNA, 5654 bp, Homo sapiens
  Payload ID: 16727
  Gene Symbol: ST6GALNAC2
  Gene Name: ST6 (alpha-N-acetyl-neuraminyl-2,3-beta-galactosyl-1,3)-N-acetylgalactosaminide alpha-2,6-sialyltransferase 2
  ENST ID: ENST00000589997
  CDS Start-End: 897-1748
ggtgtggggcgtggcagaggggcaagggacactgtggttatctcctttttgctcccagggcccatcatggggtaagaggaggtgggtgaagggcagtaagaacagccctaagaattcaatcatccccaattattcacataacagcactgggaaattctactttttgtctacccctggaaagcccaggtgaccctccgggttcccagtagccctctgggggcagtgggctgggggtgggagaggcagctcttctgaatggggtgagcaggtctggcttctcggctttgggctgcactctccctgcccagcccagccgccagcggctccgggtcacagactgggctgggtccgctgtcccactgagcacactgtgctggaaacaagagttggggccagtctgggccactcctcctgctgggcatccttcccagggtcatgcccatgaaacgggagagcagactcgaggcccagtgtcctgagaggcggaaacaatgggccctttgtcttctttcccaccttcctgcacagcaggcctgggtccagctctcttgagccacgacctgaccctcatctgaacctcctcccgggggttctgagacaatttcttgtccctgagatcaggtccctaaaaatcgacgccactgctgtggcccagacaaccagccctcctatctcggcgtctcgctgaggacatcttccccaccccccacagagcagctttacaggtggtccttatgggttaagggttctaaagccaggcccaccccacccccgcttggtgattacccaacaattgcttccactgctggtctgagctgggctttgtgacacgctgggcttgggcccttaggggctgcctcagagacatcgggtggacctaagcctccccaacaccaatgagctccccttcccacacccctaatccatcccctacccagtctccctcccagtcccgttccaacaacattgtcacccctccaggccagcagcctgccccttccccctcccccactcggggctcttcctcccggcccccctcccaccctcccaccccaaatgcctcacagccctcttcccggacttcgtccctgaaccccagtcctcaggtccaacacgtgccccgcggggctgcccaaacccccaccccacccacctccaaatctccctcccagtctggtttcaaatccctctctcgaaacccttccctaacccccgctgtgccccccaagtcctccttctacagccctgccacctcatcttcctatatcgggccaattcagaacatcccgtcctatatcaccccctatgtgccccgctttctgaaggagcccccctttttccagccccccacagcaccacttccccaaaacccatgctttgcctgtccctctccctgccctgcccggaagcccccaccccctcctgactcactctacttacctctccttcccccgcccccccaccacccccagtttaactgccccttcccaactccccccggtctgttcatgcccccctcctctctctcctacaccccgcccgtggaggtcctggtgagcgggaagccgcacgtggtccccaacgtactgcctgccaccttctacacccccttctcccgctactactcccagccccgctcctaccgctcagggtaccgcggctactccggcgccctgaccctcccctccatctcccccttgcaatacgacggctctgggcgctctgtccacttctatcatgggtcctaggccgcacgcctattttggaccagaagcctctgccagtaaattcaagctgctacatccggacttcatcagctacctgacagaaaggtacggagtggggtgcctgaagaacagcgtccccttccttcccccttttacacacccacccacatccagtcagcgccctcgcacgagccccacgcactgaccgataaccagagctccactgtcccgagtgctgtgtgcaaagcactgtcacttcatttactgttttatttagcaccttgatagagggagggtgatatatgtcagtcaccaggaaatggacaggaaactcaggataactcaaggaggtttatacaaaggcacagactgggagctgggaccataaggtgcacagcagcagtggcgccgtcagcagcagggcatcagaaccttcaggcccaaacacagccaacacaaggtgccggaaggaacccggggaccagcctcaacccccttccctccctcctgccaggggttctcaatgtggatgtgcatatggtcctcgtctggggttgtcacaagggtggtggcggcaagtgccatcagtgggtagaggccagggatgctgctgaacatcacaagaagcacctggccccaagtgtcaacagcactgagactgagaaaccctgctgtggaccagaggctcgaatcccagggcagggagcagttggagaggggtgtgtggatgtggggaggcaaatgaagcccctctaattagtcccgtgctacagaggaagacaggctctgagaggtcaggtgatcggcctggcacagctcgatgtgaactcaggcctgagggcagagcccgtggtcacaccctggcctcactcttggactgtgtgggtccggtcacagggtctgagctccctgtccctcacacgtgattcctacttaatcaagatgtggagtagagagaaactgcagtctcaggctaaataaacaggccacctatgcccttggcagtgtggttacttagtagcttggggtgaaaacaagctgttgccaaaagggggaacctgtggttcctttctcaccaccccctcccccaaccttacctaaggtctcaaagatctttgtatttagtccacttggaccgaataaagaactgactggagtagaaggccctcagtttttgaagttttcccacctatttgaatgtgtagttgtgaagtgtgatgatagccatcaagctagtgagctgaaatgtctctttttgcttccaggttcttgaaatcaaagttgattaacacacattttggagacctatatatgcctagtaccggggctctcatgctgctgacagctttgcatacctgtgaccaggtcagtgcctatggattcatcacaagcaactactggaaattttccgaccactatttcgaacgaaaaatgaagccattgatattttatgcaaaccacgatctgtccctggaagctgccctgtggagggacctgcacaaggccggcatccttcagctgtaccagcgctgaccccaatgcactgagccctttgcttcttcaagagttgcggccctgatcctctcaagtggccaaaagcttttttaacttttcaatcttcaccttcccttgccaacagagggcactggggtgaattcaagattttcatcgaggtctgttcaatataggacaccccagcttgtccttggctcatccaagaactcttctgtatctaaaacaatacatctcaatcttggccaagggaaaatggactgctttgctggattggcactgagcaactttaggaaatgtcggtggagtgttcagcaagatcagacagcagtccaggtcaaaggcaaacacacacgctccagcccaaatcctcctggtggcacatcctaccccagatgctaaagtgattcaaggactccaggacacctcttaagagcctttctaagaacatgataggcttacttctgctccataataaagtgggagaaaaaagccagaatataacttaagactagataactgcgtacatgatggaccatttttttttttttggctgggtagagaaatcatataaaacgcaggctgtttagcatggagatgactctcagaacactgggagggtctggcacttgatgggggttagttgcttggcagcctgcctgccactgagggaagtcccattagagatgtatcaccaccttgtcaccaacaggatgatgtcaccaggtaataaaccttcatcctcatatcatggcgtcagtaaatttgaactcagctgacggtagtttcccaagtttattgtaagtggttttaagttaagtctcatccaaacaagttatcacacagcacttaaccaagccctgggatttactgtcttgatgactacacggctttgcacagtctgagatgcttcagtgtgcaaggcagcagctgggggggaggaggggggtcttcacagggacagctggcaagagacttcctgaggcacatcagttacgttggtcaatttagggcacggtctggttctgcagctttgaaaggtggattctttctattagcacactttacaagagggattgtaaaggattaactcagtcaccagaaacgaaacaccacttcagaaattcagagacctctgatcaacagaacagacatttgggctttaactgctaaagcagctacctacttggggaaaccatggcattctgctgcctggacagcaggaattaagagagatttcagagttactggcacgaggacaaagcctctcagctcgcttcaccttggcaaccttaaacagtccctccttggtctctatgatagcagtatgttcctttggatggaatacttggtttggaaataatgtagtcaaatgtaggatatgtaagtactcctcaacagtcacaatccatcctagtatcttaaatagtgattttttttttttaatttacaaaagaggtttattggacttacagttctacatggctgggaaggcctcacaatcatggcggaaggtgaaagccacatctcacatggcagcagataagagaaaaaaaggtagtgatcttttagtaaagaaacctgagactggtagtgggcttggagccagaggatcgcttaagtccgggagttcgagaccagccagggtaacaaattgagacccccccccaactttaaaattaaaaaacgaaagaaaaaatagctgggtgtggtggctcacacctgtaatcctagcactttgggaggccaaggcgggtggattgcctgagctcaggagtttgagaccaacctgggcaacatggttgaaaccctgtctctactaaaacaaaaaaaatcagccaggtgtggtagcgtgcacctgtagtcccagttacttgggaggctgaggcacaagaattgcttgaacctgggaggtagaggttgcagagatcatgccactgcactcccagcctgggtgacagagcaagactgtctcaaaaacaacaacaacaacaacaacaaaacaaaacaaaaaaaacctctcaaaaaaatgaaaaaaaatttaaatttaaattaaaaaaaaaaatgctgggtctgatggctcacacctgtcatctcagcactttgggaagctgaggcaggcagatcacaaggtcaggagatagagaccatcctggccaacatggtgaaacccagtctctactaaagaaggtacgcgcctgtagtcccagcactcaggaggctgagccaggagaattgcttgaacccgggaggtggaggttgcagtgagccaagattgtaccacttcactccagcctggcgacagagtggaactccgtctcaaaaaataaaataaaataaaataaaataaaataaaataaaataaaataaagcaaaaatataaaatgttaaaaaaaaaacaaaaaaagggaaaaa

SEQ ID NO: 186527 - DNA, 6861 bp, Homo sapiens
  Payload ID: 16728
  Gene Symbol: ST6GALNAC3
  Gene Name: ST6 (alpha-N-acetyl-neuraminyl-2,3-beta-galactosyl-1,3)-N-acetylgalactosaminide alpha-2,6-sialyltransferase 3
  Uniprot ID: Q8NDV1
  ENST ID: ENST00000328299
  CDS Start-End: 149-1066
gcagcttacaccgcggtccccttatttggatctgcgggaatgtgggctggagaggtcctgccgtggtaccagcctccagcctgcccccaggactgcccctgacccaggcgcgcccgctgctcggtggcaggagggccggcggagcgccatggcctgcatcctgaagagaaagtctgtgattgctgtgagcttcatagcagcgttccttttcctgctggttgtgcgtcttgtaaatgaagtgaatttcccattgctactaaactgctttggacaacctggtacaaagtggataccattctcctacacatacaggcggccccttcgaactcactatggatacataaatgtgaagacacaagagcctttgcaactggactgtgacctttgtgccatagtgtcaaactcaggtcagatggttggccagaaggtgggaaatgagatagatcgatcctcctgcatttggagaatgaacaatgcccccaccaaaggttatgaagaagatgtcggccgcatgaccatgattcgagttgtgtcccataccagcgttcctcttttgctaaaaaaccctgattattttttcaaggaagcgaatactactatttatgttatttggggacctttccgcaatatgaggaaagatggcaatggcatcgtttacaacatgttgaaaaagacagttggtatctatccgaatgcccaaatatacgtgaccacagagaagcgcatgagttactgtgatggagtttttaagaaggaaactgggaaggacagagtccagtctggctcatatctcagcacagggtggtttaccttccttctggccatggacgcctgttatggcattcacgtctacgggatgataaatgacacctactgcaagacagaagggtatagaaaagtcccctaccattattatgaacaaggaagagatgagtgtgatgaatattttcttcatgaacatgccccatatgggggtcataggtttatcactgaaaagaaagtgtttgctaaatgggccaagaagcacaggataatatttacacatccaaactggacattgtcttgataatggttttcctgatcttgccgcatcacttaatgtgatccccatactgcaactgtgatgctgatgatgctaatggagatgatggtaatgataaagacaacaacaatgattatcaagttcctgtacactctcagatgtggatggtgactctgctagtaatttaaacttggcatttcatggaggatggttgtgctcatgatgttctttctggaggttcaacactacgtaccgcactttataatttaactggaattgagatgaaggccagtgacatgacaactgtgacctaagaaatgggaagattatctttcaagatagctgcctagaattgttcaacagtgagtaacttccagaagccaaaagagtttggcttcatgaggcaaggtgattgactcaatggcttgttgaatctcagcagttccgccatcttgaagaatgattgattgtcaaacactgacccaagaactgctatcagggtgcaagtatcttactacttagcctaaggatgggaaaatatctcttcctaatataccatctttctacagtatttcctacagctaaagcctcaggccattgcctaattaacaatgaagatttcatggacatcctacacttcaggattacttgactatctcaaacacataaatcaaaatgggccaagtagcaaatcttgatgaatttccactcttaccatccattcttactaccaacagtataactgaacatgtgattagaatgatctatattaatgtttagttatttttggttgagtgctaaatatttcagaaggctacttaacatgtaagataccaacttcaacactgtaataacatatactgtgaaaacattcctaaaaagtaaccaaagggtttgctaactctgcttcaacatccaacaacacaaaactatatgatttttaaaatcatgaaatagagacagcaaagcatatttttacatcaatttgtatcctatcatacttcataatatatatttgtatattcaaatttctattttataggcccaaggtgtgtttctccaaacattacattctcattgccaagtgccagctgttacacatggagaggaaatgattccttatattaaacctgaccagagctttttgccttctagggatttatttttcccatagtgtatcagttgttatgccacaataacaacaataataatgttcttaatgtccaaagtgctttgtcatttagagtcctttaacatctgttataccatgtgatgcccttgaacaccccattgggctattgtctgtgtattctgctctctttagcagatgatctgtaatttggtcattgttctgttatattccagattgctctacttgctaatatttgtatagaatagaatttatgtaaactagtaaccagttgatctctgtgccaaatacattatatcaggattacacaaaaagtatcacaaaggatggtcttggccatatgctagggcccctgtgaaaataagtagttttgagaagtttttctatatacgtatatatacacgtgtggttctatttaggtggggaaaaaatgaaaaagcagggacaacaggaggaaatgaaggcagagaaatatagtttcctttcctaggattgagacaattctatttttcatatactcgttgctcattaaatagtaaagggttgatttgctgcaagagtagctgagaattcaaaaacatccttgcagaatgattcaaaagacaaaagccaggctcaacttatagaatgttttggaaactggaagtaatgatacatttcacttcagaagcacttgtaggtctttactagtgctaagtattatggtgagctatcattaaagtgtgccatcttggataaaggccttttgcctactctcttctgcaattttgacacctcaatattcacacccataaacattactaagccccagttctatcgttggaaggagttgttattcttttgttgttcccttatgcaatttttaattctatgaatgttaagtttttttgagctaatgatagatagaaatgcccactcaaagaaaaataaacagagacaaatgttaaaattgccatacagactgtttttccccctgttgtttcactttaaaataaaaagaaatccttgattaatcagaatggcttgggacatgaacttaatttatttagttttctaataaatgaagggccaactcttatttgttctagcccctactgatgagaaacatttgaaaacttgcttgctctcctgcctcgttgtagctttctctgatgaagacttctgcagtatattgtatccctcactctatagcagaaggtgtgtgtggaatatgtagactccagtgttttcttaggaggggtgggaaagggctttctttcctctcctctcctctcgtctcctctttctttcctttctttttgcaactaaactgctactctacactttttattgttgttttctttgtctttttctttctacaaacaggaaacaaaaaaaaaaaaaaacaagtttttctcaatttggagactcaattgaataatttccagtataatcagcattttgatagaatctcacaacttatttttctctgcttttatttcctgtttttctttgttccatctttctaattctagtgaaaatgcaaagtctaatttctcccatgttgagaataaatttttcatctatgatttgctgatagagaagagcttggtaagggagcaattcaaggaaactattttgccatgcacatttctgatcaattcccacagattctggtcaaatgaaagatattctatccaacatttaaacattgaaaaatttaactgaacttacttatcactgatgtgtatttatcccagaaattaattaatatctgtgaaaaataaaaatatttcaatactatccgtgcttcttggaaaatgaactataaaaaagggtcacaatttttctgaaattggcatgaaaacattcaagataaaaataatagactaaacattattttctgttatgcataattctatgaaaaagcaaggtaatttaaaaagagttttaaaatgtgtgtttgaatcttttccaatttaaccaagtgagaagtagcaatgatttacattgttatgatgataatgtgaataagaaaccttttagagtatatgattttacattgctatcaaacctatcaaagaaaaggcaattggaatttggaggaatgtttgtatatatgcacatagagtctatttgtgtgtgtgtgaacgcacatatatatacatctatatacttataactatatataaaagcatatatataatcctatattcttcactggtgcatgtgaatcacagaaagccctattttagacttcatctgaaattcgttgggttacattttgaatcctgatgaaaaaagcaaaaatccaaattaaatggactgattgctaagagtacgtaaaatcatattcaaaagctggccagaagaataaagctagagaagctgctaaatctagaaaacacaatcagatgccacagttgtcacaaatcagacttgtaagtatagcaatctgtattgtaggttctgccgattgcaggcttagctaaagtcacattgaaaaacattgcatcaagcttcattcacactgaagtaaatgaacattggtcctcctattcaaataagccagtctttagcataagcaaaatccagatttgcatgatttttattatatagctacagaactgtgaccactgtgaaaaaggaaaattatacaaggagattgctcttggaggatttggtatgaatcagctgaggtaggaacaagagtctgaattggggacctgctgaccttccaagaagtagaaggccatcagaagaaaatcactgttacttagagaagagacaacactaaagtacttcacctggtagtgttaattggatgttaattatgagctcggtttaatttcaataagcaagaaaatataatcagatgactgatttaaaaaaaaacaacaacaatgtgcccatctagcctttaatgtgacatgtcaaatgcaaataataaattatgttattcagtatcagttgtttgcatgtcttagcacaacaaaggatttacagtctgagggccaagagagaaaaaatgcttttttcttaaaacagcatatttaaaagacaagacctcatcatttcagtagtgtacatagattagtgactgaaggagccagtgctagcctttttaagtaggtcaggcttttagagctgaaagagattttaaagaccagccaattcaactcctacaccttggagctgaggaaacagacagaggtgaagtgacttgcctgtagttataaactggactaatggcagtactgagactcaaattcttgtctcatgttttcttctctagtgctttttccactacactttttagacagaagagtagctggaaaaagaatgcctaactgatttactaaagagtctattcatggaatccaagggctccaaattgtgctaattctgctcaggatgaaacaaatccccacgctgaagtggagaaatattttcataattgaaggaacatatcccattgattgtctacactttcttctctctgtttgttgctattggtaaggctaggctatgttctgttatcacaaaattctaggacttgtttaaagaacttaaaggtcagtttcttagtttctctttgtgattgaggatgagcaagccattgatacaccaagagctgctgagtgttggaggttgcctggtgaaactggcaggccctgttgttgacatttccccagagctaaaatgtcctcatactcaaaccaactgtgctgcccaagttagtgaaattatccatcagcactaacaccaccctttgggttcatgctcatccctgcactccatgtgacctttgagcccagatacccttctagaaggtgaatgaaagccccacatgtcccgcaagacttagtctgcataaaagatttaaaaggatttttttttctctacagtccatttatatgatactgttagaagtgaagaattttgaaactacatacactggcctctgaaaatggttcttgtggctcagaaatagtatattgttctgttgcttgtttttgctgaactgtagagaaaacaccagagtaaaattccatgtaaattgctaaggcatcgaatcagaactgtccttgggcgttgtaacagtgcagaaaatctcatttagtttttttctttttttttttcagttaactacttgtttgtttcttttcagaataggcacttttttttgagtagaaaacctcttctttctccacagatacatctctttttgttcacgccttgaagacttcagaaaaatagaagctcacttccttccataaaggtgaagaacatcttgatgaataaacagtcaactaccaagttcacatatttgcctatgaagtgagagctatttctaagaaacttcaaaaagatcaaaacgaggcaattttatagctttttgttacctaatctacaaagtactaatttccttgtgtttagctttgttgtcactgttactgagtaaatacccatttctgttacatatggtacattttttgcttcacttattttcctgagttcccatgattttttttctgtagtttctcattcattttaaaacccataatcttcatctatttttagaagaaagtgtaaatgcacagttgtacgtttgttgagagtttttatggcattatagtgctttatttataagcattgtgtcttagaataaagcttacaaaatggcaaa

SEQ ID NO: 186528 - DNA, 617 bp, Homo sapiens
  Payload ID: 16728
  Gene Symbol: ST6GALNAC3
  Gene Name: ST6 (alpha-N-acetyl-neuraminyl-2,3-beta-galactosyl-1,3)-N-acetylgalactosaminide alpha-2,6-sialyltransferase 3
  ENST ID: ENST00000621530
  CDS Start-End: 201-617
tgtagagaaagtctgtgattgctgtgagcttcatagcagcgttccttttcctgctggttgtgcgtcttgtaaatgaagtgaatttcccattgctactaaactgctttggacaacctggtacaaagtggataccattctcctacacatacaggcggccccttcgaactcactatggatacataaatgtgaagacacaagagcctttgcaactggactgtgacctttgtgccatagtgtcaaactcaggtcagatggttggccagaaggtgggaaatgagatagatcgatcctcctgcatttggagaatgaacaatgcccccaccaaaggttatgaagaagatgtcggccgcatgaccatgattcgagttgtgtcccataccagcgttcctcttttgctaaaaaaccctgattattttttcaaggaagcgaatactactatttatgttatttggggacctttccgcaatatgaggaaagatggcaatggcatcgtttacaacatgttgaaaaagacagttggtatctatccgaatgcccaaatatacgtgaccacagagaagcgcatgagttactgtgatggagtttttaagaaggaaactgggaaggacagaaatgag

SEQ ID NO: 186529 - DNA, 1691 bp, Homo sapiens
  Payload ID: 16729
  Gene Symbol: ST6GALNAC4
  Gene Name: ST6 (alpha-N-acetyl-neuraminyl-2,3-beta-galactosyl-1,3)-N-acetylgalactosaminide alpha-2,6-sialyltransferase 4
  Uniprot ID: Q9H4F1
  ENST ID: ENST00000335791
  CDS Start-End: 277-1185
gcgcggatcagcttccagcccagtcggcccggcccgggggccatggagctccgagcggcggatcgcgagcctcctgcgaaccccagcctgcacgcccggttagcattcggccgggagatgcggcagtggaatctggaagggcggtgaaaaacctacgtcctgccctcgcccggcctctccattcgtcccccgggtagagaggtgcccggctcccaccccttcccagccccagccctggagacagcagcccctagactactgagggacagcgacagcatgaaggctccgggtcggctcgtgctcatcatcctgtgctccgtggtcttctctgccgtctacatcctcctgtgctgctgggccggcctgcccctctgcctggccacctgcctggaccaccacttccccacaggctccaggcccactgtgccgggacccctgcacttcagtggatatagcagtgtgccagatgggaagccgctggtccgcgagccctgccgcagctgtgccgtggtgtccagctccggccaaatgctgggctcaggcctgggtgctgagatcgacagtgccgagtgcgtgttccgcatgaaccaggcgcccaccgtgggctttgaggcggatgtgggccagcgcagcaccctgcgtgtcgtctcacacacaagcgtgccgctgctgctgcgcaactattcacactacttccagaaggcccgagacacgctctacatggtgtggggccagggcaggcacatggaccgggtgctcggcggccgcacctaccgcacgctgctgcagctcaccaggatgtaccccggcctgcaggtgtacaccttcacggagcgcatgatggcctactgcgaccagatcttccaggacgagacgggcaagaaccggaggcagtcgggctccttcctcagcaccggctggttcaccatgatcctcgcgctggagctgtgtgaggagatcgtggtctatgggatggtcagcgacagctactgcagggagaagagccacccctcagtgccttaccactactttgagaagggccggctagatgagtgtcagatgtacctggcacacgagcaggcgccccgaagcgcccaccgcttcatcactgagaaggcggtcttctcccgctgggccaagaagaggcccatcgtgttcgcccatccgtcctggaggactgagtagcttccgtcgtcctgccagtcgccatgccgttgcgaggcctccgggatgtcccatcccaagccatcacactccacaaaaacatttaatttatggatcctgcctcctgccacgtgctgggtggacctaaggttccttcccgccccattctggcgacacttggagccatctcaggcctcatgacttgaaggggagtggaggggggagccgtgtctcccccctccactccctgagtaattcacggcatttgggggctcaccccacctccaggtctgtcaagtggcctttgtccctggggctgatggcccccaactcaccagcatcatgaccttgtgccagtcctggtcctccctccccagccgctcctaccaccttttggtgccacacttctcaggctggccgccctggttggggcagccgagagcctggggttcattggtgaaggggccttggagttgtgactgccggggccgtatcaggaacgtacgggtaaacgtgtgttttctgga

SEQ ID NO: 186530 - DNA, 1013 bp, Homo sapiens
  Payload ID: 16729
  Gene Symbol: ST6GALNAC4
  Gene Name: ST6 (alpha-N-acetyl-neuraminyl-2,3-beta-galactosyl-1,3)-N-acetylgalactosaminide alpha-2,6-sialyltransferase 4
  ENST ID: ENST00000361444
  CDS Start-End: 412-1013
ggcccgggggccatggagctccgagcggcggatcgcgagcctcctgcgaaccccagcctgcacgcccggttagcattcggccgggagatgcggcagtggaatctggaagggcggtgaaaaacctacgtcctgccctcgcccggcctctccattcgtcccccgggtagagagggtcggctcgtgctcatcatcctgtgctccgtggtcttctctgccgtctacatcctcctgtgctgctgggccggcctgcccctctgcctggccacctgcctggaccaccacttccccacaggctccaggcccactgtgccgggacccctgcacttcagtggatatagcagtgtgccagatgggaagccgctggtccgcgagccctgccgcagctgtgccgtggtgtccagctccggccaaatgctgggctcaggcctgggtgctgagatcgacagtgccgagtgcgtgttccgcatgaaccaggcgcccaccgtgggctttgaggcggatgtgggccagcgcagcaccctgcgtgtcgtctcacacacaagcgtgccgctgctgctgcgcaactattcacactacttccagaaggcccgagacacgctctacatggtgtggggccagggcaggcacatggaccgggtgctcggcggccgcacctaccgcacgctgctgcagctcaccaggatgtaccccggcctgcaggtgtacaccttcacggagcgcatgatggcctactgcgaccagatcttccaggacgagacgggcaagaaccggaggcagtcgggctccttcctcagcaccggctggttcaccatgatcctcgcgctggagctgtgtgaggagatcgtggtctatgggatggtcagcgacagctactgcagggagaagagccacccctcagtgccttaccactactttgagaagggccggctagatgagtgtcagatgtacctggcacacgagcaggcgccccgaagcgcccaccgcttcatcactgagaaggcggtcttctcccg

SEQ ID NO: 186531 - DNA, 3751 bp, Homo sapiens
  Payload ID: 16730
  Gene Symbol: ST6GALNAC5
  Gene Name: ST6 (alpha-N-acetyl-neuraminyl-2,3-beta-galactosyl-1,3)-N-acetylgalactosaminide alpha-2,6-sialyltransferase 5
  Uniprot ID: Q9BVH7
  ENST ID: ENST00000477717
  CDS Start-End: 236-1246
agttgtgtagatcgctgagagactacgagggtccggttcagttttaattctgtctctaatctctgcaacagccgcgcttcccgggtcccgcggctcccgcgcgcgatctgccgcggccggctgctgggcaaaaatcagagccgcctccgccccattacccatcatggaaaccctccaggaaaaagtggccccggacgcgcgagcctgaggattctgcacaaaagaggtgcccaaaatgaagaccctgatgcgccatggtctggcagtgtgtttagcgctcaccaccatgtgcaccagcttgttgctagtgtacagcagcctcggcggccagaaggagcggcccccgcagcagcagcagcagcagcagcaacagcagcagcaggcgtcggccaccggcagctcgcagccggcggcggagagcagcacccagcagcgccccggggtccccgcgggaccgcggccactggacggatacctcggagtggcggaccacaagcccctgaaaatgcactgcagggactgtgccctggtgaccagctcagggcatctgctgcacagtcggcaaggctcccagattgaccagacagagtgtgtcatccgcatgaatgacgcccccacacgcggctatgggcgtgacgtgggcaatcgcaccagcctgagggtcatcgcgcattccagcatccagaggatcctccgcaaccgccatgacctgctcaacgtgagccagggcaccgtgttcatcttctggggccccagcagctacatgcggcgggacggcaagggccaggtctacaacaacctgcatctcctgagccaggtgctgccccggctgaaggccttcatgattactcgccacaagatgctgcagtttgatgagctcttcaagcaggagactggcaaagacaggaagatatccaacacttggctcagcactggctggtttacaatgacaattgcactggagctctgtgacaggatcaatgtttatggcatggtgcccccagacttctgcagggatcccaatcacccttcagtaccttatcattattatgaaccttttggacctgatgaatgtacaatgtacctctcccatgagcgaggacgcaagggcagtcatcaccgctttatcacagagaaacgagtctttaagaactgggcacggacattcaatattcacttttttcaaccagactggaaaccagaatcacttgctataaatcatcctgagaataaacctgtgttctaaggaatgagcatgccagactgtaatcccaggtattcactgcatcagacaccgagacactgaacttcctgagccaccagacaggaaagggtagcagaaaacagcttcactcctcaggaagtaccatggacagacgcctaccaggggtgacaaagcagtgcagttggattgtaaggaaaaattccggaattaatgcatcctaatgaatgttgtccccttcaatggtgttaccttaggagctgaacattcaattcagttacaccactatgactaaaaacagtttggatctcttagtattgcctttgaaactgcaacataagcaactcaacaatattagttgcattcctttatagacataccatgtcaaagacgtttttctatcaagttgtattctttcctgttctataacctttgtcatctgttagactctgtatgtgtgatttgtaaaaagcaggctgaaactatggacatgatttctgaagagcacatctccactgactttcataaagcaaatgtccaatatttatttattgagagttttttagtgcaatctgggccagtatttttatagattatgattatgtggtaatttatccttcctaactctttaatcctgaatgatggttggaaatggcctagaattaggttactctgttcacaatgctcattgttagcatgcaattggtatttgacttggaagtgttgtgttgtattttttgaacccctaggcttcaggaaaactgctcttttgtaaaaagaatagcgatgacattttctaatgtgcagaaatgttccaaaaggacaaaattgaaaaccaaaaactatgttattaaaacaaaaaaatgctaacaagagaaatttaaaggtagttttctttagtaataatttatgtaagtgtcctctcttgagccctagtttcctttttggcagaatgatgtcactgtaccagacaacctcttaggtttcatcccaaatctaaacttgtggcctcttcttgacccatttgaagactctgcacttggagtgatggggccccaacagtagcaggaactttattttggggagccttatctacattcatattacttatatcactcttgtggttaaaactacacttcttcctgtgtccacatgggctaaaatctaccccctgcttctctcgaagcatcaccatccgcctcttccccagcctctcaacacaaaaacacaggatacacacacacacacacacacaaaagacatagctccaaggggttccctggctacaatagcaaacagctgcccttctgtgaggaaaagagactacaaggacatgccctatcattcaactcatttatgctatgaactgtttagactcactacaaatcttcttagattatattcattaccattccctggtctgaaggagtataaaggacttattttattcagagccaagataaattcatattatagatttttatttaaacaagtaatattgttcaaaaatagtctcttataaatatactagtgttttctttacacatgacttagaaggcattagtttctctaatgccaaatttgaaggcaccagcaaatattatgtatgaagactgacattgttttacagacatgacctggcttatgataaaagaagttttatcgcattaccacttcttttcccttttcttaattagtacactaactagtactattaattacacggagtattgttgttaaaatgcaaacacaatcagggtactcacataacataaacaaagttgatattgatgtgtatggcttgggctgttcaaagccagtaagattgaaatggccgtccaaaacatactggaatatgttctttaagttttctcatagtttttaaagggactatgaattttattccaacacattgtcttccacagcatggactctgaacacatcatactttatcaacatatgaaaaagtgtattaattttatacaatttacttataggccacctttataatcacttgaagacgttatgttgctcaaacataagtggctcctttggcaatttctatatttgtggaaatttggaaaggcatagtttcaacatgcaagaatgtaattatattgcttcatctaataatatctcacatatctgtctatcttcagattttagattttctttattaaaaaaaccatcatggtagctccatctcgtttgtaacttctccctctcaaatactcagaagaatgaagaggccaaattcagaaaatcatggcttcactgggaaatgttttaaatctacatgtagctaggatatgtgatttcatattttttaaaaatgtggtgtaaataagtgtaaaaaattaccacttgcaaagtggttttattacagcgttaaagaaaatgactagaattctgatagattgtgctgatgaacctggttgtgggcaattgaattcttgtcttcccactaccatttcatgactgtcgtctgaacactattcaacaccattaaatataaactctgatataaaa

SEQ ID NO: 186532 - DNA, 2055 bp, Homo sapiens
  Payload ID: 16730
  Gene Symbol: ST6GALNAC5
  Gene Name: ST6 (alpha-N-acetyl-neuraminyl-2,3-beta-galactosyl-1,3)-N-acetylgalactosaminide alpha-2,6-sialyltransferase 5
  ENST ID: ENST00000318803
  CDS Start-End: 197-907
agttttaattctgtctctaatctctgcaacagccgcgcttcccgggtcccgcggctcccgcgcgcgatctgccgcggccggctgctgggcaaaaatcagagccgcctccgccccattacccatcatggaaaccctccaggaaaaagtggccccggacgcgcgagcctgaggattctgcacaaaagaggtgcccaaaatgaagaccctgatgcgccatggtctggcagtgtgtttagcgctcaccaccatgtgcaccagcttgttgctagtgtacagcagcctcggcggccagaaggagcggcccccgcagcagcagcagcagcagcagcaacagcagcagcaggcgtcggccaccggcagctcgcagccggcggcggagagcagcacccagcagcgccccggggtccccgcgggaccgcggccactggacggatacctcggagtggcggaccacaagcccctgaaaatgcactgcagggactgtgccctggtgaccagctcagggcatctgctgcacagtcggcaaggctcccagattgaccagacagagtgtgtcatccgcatgaatgacgcccccacacgcggctatgggcgtgacgtgggcaatcgcaccagcctgagggtcatcgcgcattccagcatccagaggatcctccgcaaccgccatgacctgctcaacgtgagccagggcaccgtgttcatcttctggggccccagcagctacatgcggcgggacggcaagggccaggtctacaacaacctgcatctcctgagccaggtgctgccccggctgaaggccttcatgattactcgccacaagatgctgcagtttgatgagctcttcaagcaggagactggcaaagacagatatccaacacttggctcagcactggctggtttacaatgacaattgcactggagctctgtgacaggatcaatgtttatggcatggtgcccccagacttctgcagggatcccaatcacccttcagtaccttatcattattatgaaccttttggacctgatgaatgtacaatgtacctctcccatgagcgaggacgcaagggcagtcatcaccgctttatcacagagaaacgagtctttaagaactgggcacggacattcaatattcacttttttcaaccagactggaaaccagaatcacttgctataaatcatcctgagaataaacctgtgttctaaggaatgagcatgccagactgtaatcccaggtattcactgcatcagacaccgagacactgaacttcctgagccaccagacaggaaagggtagcagaaaacagcttcactcctcaggaagtaccatggacagacgcctaccaggggtgacaaagcagtgcagttggattgtaaggaaaaattccggaattaatgcatcctaatgaatgttgtccccttcaatggtgttaccttaggagctgaacattcaattcagttacaccactatgactaaaaacagtttggatctcttagtattgcctttgaaactgcaacataagcaactcaacaatattagttgcattcctttatagacataccatgtcaaagacgtttttctatcaagttgtattctttcctgttctataacctttgtcatctgttagactctgtatgtgtgatttgtaaaaagcaggctgaaactatggacatgatttctgaagagcacatctccactgactttcataaagcaaatgtccaatatttatttattgagagttttttagtgcaatctgggccagtatttttatagattatgattatgtggtaatttatccttcctaactctttaatcctgaatgatggttggaaatggcctagaattaggttactctgttcacaatgctcattgttagcatgcaattggtatttgacttggaagtgttgtgttgtattttttgaacccctaggcttcaggaaaactgctcttttgtaaaaagaatagcgatgacattttctaatgtgcagaaatgttccaaaaggacaaaattgaaaaccaaaaactatgttattaaaacaaaaaaatgctaacaagag

SEQ ID NO: 186533 - DNA, 2280 bp, Homo sapiens
  Payload ID: 16731
  Gene Symbol: ST6GALNAC6
  Gene Name: ST6 (alpha-N-acetyl-neuraminyl-2,3-beta-galactosyl-1,3)-N-acetylgalactosaminide alpha-2,6-sialyltransferase 6
  Uniprot ID: Q969X2
  ENST ID: ENST00000291839
  CDS Start-End: 1-1002
atggcttgctcgaggccccccagccagtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccggggtgagacgggcaaggacagggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgcggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctcctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggccggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccgg

SEQ ID NO: 186534 - DNA, 2424 bp, Homo sapiens
  Payload ID: 16731
  Gene Symbol: ST6GALNAC6
  Gene Name: ST6 (alpha-N-acetyl-neuraminyl-2,3-beta-galactosyl-1,3)-N-acetylgalactosaminide alpha-2,6-sialyltransferase 6
  Uniprot ID: Q969X2
  ENST ID: ENST00000373141
  CDS Start-End: 248-1147
ggctattcctggtggccgtgtaggagtaaacagcggctaggtcaaagggctcagagaatacaggaactgagaggcccctggagcaggggacggagctgaggagggccccctaagccccagtttcttccctctgcactcctgcccgccctgcccccggcctgtctgctggaggtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccggggtgagacgggcaaggacagggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgcggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctcctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggccggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccg

SEQ ID NO: 186535 - DNA, 2448 bp, Homo sapiens
  Payload ID: 16731
  Gene Symbol: ST6GALNAC6
  Gene Name: ST6 (alpha-N-acetyl-neuraminyl-2,3-beta-galactosyl-1,3)-N-acetylgalactosaminide alpha-2,6-sialyltransferase 6
  Uniprot ID: Q969X2
  ENST ID: ENST00000373142
  CDS Start-End: 174-1298
gccgtgacggcggcgctaggacccggcgggccgcgggtgcggcgaggcctgggcggcctgaggagcgcggaccccggcgctcggctcccggcgccatgtgagggggctcgggggccgcggggggccgggcgctccccgccggagatgaggaaactgaggctcagagaggtcacatggcttgctcgaggccccccagccagtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccggggtgagacgggcaaggacagggagaagtctcattcgtggttgagcacaggctggtttaccatggtgatcgcggtggagttgtgtgaccacgtgcatgtctatggcatggtcccccccaactactgcagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgcggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctcctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggccggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccg

SEQ ID NO: 186536 - DNA, 2406 bp, Homo sapiens
  Payload ID: 16731
  Gene Symbol: ST6GALNAC6
  Gene Name: ST6 (alpha-N-acetyl-neuraminyl-2,3-beta-galactosyl-1,3)-N-acetylgalactosaminide alpha-2,6-sialyltransferase 6
  Uniprot ID: Q969X2
  ENST ID: ENST00000373144
  CDS Start-End: 230-1129
ctgggccgggccgtgacggcggcgctaggacccggcgggccgcgggtgcggcgaggcctgggcggcctgaggagcgcggaccccggcgctcggctcccggcgccatgtgagggggctcgggggccgcggggggccgggcgctccccgccggaggtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccggggtgagacgggcaaggacagggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgcggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctcctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggccggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccg

SEQ ID NO: 186537 - DNA, 2460 bp, Homo sapiens
  Payload ID: 16731
  Gene Symbol: ST6GALNAC6
  Gene Name: ST6 (alpha-N-acetyl-neuraminyl-2,3-beta-galactosyl-1,3)-N-acetylgalactosaminide alpha-2,6-sialyltransferase 6
  Uniprot ID: Q969X2
  ENST ID: ENST00000373146
  CDS Start-End: 181-1182
gggccgggccgtgacggcggcgctaggacccggcgggccgcgggtgcggcgaggcctgggcggcctgaggagcgcggaccccggcgctcggctcccggcgccatgtgagggggctcgggggccgcggggggccgggcgctccccgccggagatgaggaaactgaggctcagagaggtcacatggcttgctcgaggccccccagccagtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccggggtgagacgggcaaggacagggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgcggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctcctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggccggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccgg

SEQ ID NO: 186538 - DNA, 802 bp, Homo sapiens
  Payload ID: 16731
  Gene Symbol: ST6GALNAC6
  Gene Name: ST6 (alpha-N-acetyl-neuraminyl-2,3-beta-galactosyl-1,3)-N-acetylgalactosaminide alpha-2,6-sialyltransferase 6
  ENST ID: ENST00000447681
  CDS Start-End: 201-802
ccaggcagatggagatgatccttgacaggtctggtggctggttcggggtctactgaaggctgtcttgatcaggaaactgaagactctctgcttttgccacagcagttcctgcagcttccttgaggtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccggggtgagacgggcaaggacag

SEQ ID NO: 186539 - DNA, 2018 bp, Homo sapiens
  Payload ID: 16731
  Gene Symbol: ST6GALNAC6
  Gene Name: ST6 (alpha-N-acetyl-neuraminyl-2,3-beta-galactosyl-1,3)-N-acetylgalactosaminide alpha-2,6-sialyltransferase 6
  ENST ID: ENST00000542456
  CDS Start-End: 248-508
ggctattcctggtggccgtgtaggagtaaacagcggctaggtcaaagggctcagagaatacaggaactgagaggcccctggagcaggggacggagctgaggagggccccctaagccccagtttcttccctctgcactcctgcccgccctgcccccggcctgtctgctggaggtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgcggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctcctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggccggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccgg

SEQ ID NO: 186540 - DNA, 2396 bp, Homo sapiens
  Payload ID: 16731
  Gene Symbol: ST6GALNAC6
  Gene Name: ST6 (alpha-N-acetyl-neuraminyl-2,3-beta-galactosyl-1,3)-N-acetylgalactosaminide alpha-2,6-sialyltransferase 6
  Uniprot ID: Q969X2
  ENST ID: ENST00000622357
  CDS Start-End: 219-1118
atgcgtcagtcacttcctccaggcagatggagatgatccttgacaggtctggtggctggttcggggtctactgaaggctgtcttgatcaggaaactgaagactctctgcttttgccacagcagttcctgcagcttccttgaggtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccggggtgagacgggcaaggacagggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgcggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctcctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggccggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccgg

SEQ ID NO: 186541 - DNA, 4645 bp, Homo sapiens
  Payload ID: 16732
  Gene Symbol: ST6GAL1
  Gene Name: ST6 beta-galactosamide alpha-2,6-sialyltranferase 1
  Uniprot ID: P15907
  ENST ID: ENST00000169298
  CDS Start-End: 675-1895
gcatacggaggcgactcgcttccttcccgcccctccgccgcgctcttcttccttccttctccagtcccttccactgtgcgtcttctgtcccccgttcttccccagcggacccctctttcgagactccctagtggggtccccagctcccgggcgatcctgcccttgccgagcgcgttttctggagtcacctgggggaggggagtcctgggcagggccgggctggggaagacgcctggggcactgcccggcgttaacaaagggagccgataccgaccggcgtgggcgcggagcgggcggccgccaccgagcgtgctgagcaaccgcagcctccgcggccgagagtgcagcgagcaaggggagagccagttgcgcagagccctgcaaccagcagtccagggagaagtggtgaatgtcatggagcccagctgaaatggactggcccccttgagcctgtcccaagccctggtgccaggtgtccatccccgtgctgagatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcgatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaatcctaattgtatgggacccatctgtataccactcagatatcccaaagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctcttggccaccccagcctgggaagaacattttcctgaacaattccagcctgctccttttactctaggggcctctgtcagcaagaccatggggacttcaagagcctgtggtcaggaaatcaggtccagccttccctgtagccagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacctacccccaaatcttctcctaaccaccatctgttttttttttttaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaa

SEQ ID NO: 186542 - DNA, 588 bp, Homo sapiens
  Payload ID: 16732
  Gene Symbol: ST6GAL1
  Gene Name: ST6 beta-galactosamide alpha-2,6-sialyltranferase 1
  ENST ID: ENST00000446170
  CDS Start-End: 315-588
aatgctgatttaccaagcggagtgcaaattgtgtgagatggagtttcaccgtgttagccaagatggtcttgatctcctgtcctcatgatcctgatccgcctgcctcggcctcccaaagtgctgggattacagatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcct

SEQ ID NO: 186543 - DNA, 568 bp, Homo sapiens
  Payload ID: 16732
  Gene Symbol: ST6GAL1
  Gene Name: ST6 beta-galactosamide alpha-2,6-sialyltranferase 1
  ENST ID: ENST00000440338
  CDS Start-End: 433-568
gaactttctgatagcttaataggaggaggttcctgtagggcggcacaaccagggagggcgtggaagctctgcatcccttctcccataccttgctctacacatctcttcatctgtatcctctgcagcatccttgatgataaaccagtaaattagagatggagtttcaccgtgttagccaagatggtcttgatctcctgtcctcatgatcctgatccgcctgcctcggcctcccaaagtgctgggattacagatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattcc

SEQ ID NO: 186544 - DNA, 4302 bp, Homo sapiens
  Payload ID: 16732
  Gene Symbol: ST6GAL1
  Gene Name: ST6 beta-galactosamide alpha-2,6-sialyltranferase 1
  Uniprot ID: P15907
  ENST ID: ENST00000448044
  CDS Start-End: 332-1552
aactttctgatagcttaataggaggaggttcctgtagggcggcacaaccagggagggcgtggaagctctgcatcccttctcccataccttgctctacacatctcttcatctgtatcctctgcagcatccttgatgataaaccagtaaatatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcgatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaatcctaattgtatgggacccatctgtataccactcagatatcccaaagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctcttggccaccccagcctgggaagaacattttcctgaacaattccagcctgctccttttactctaggggcctctgtcagcaagaccatggggacttcaagagcctgtggtcaggaaatcaggtccagccttccctgtagccagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacctacccccaaatcttctcctaaccaccatctgttttttttttttaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaa

SEQ ID NO: 186545 - DNA, 1005 bp, Homo sapiens
  Payload ID: 16732
  Gene Symbol: ST6GAL1
  Gene Name: ST6 beta-galactosamide alpha-2,6-sialyltranferase 1
  ENST ID: ENST00000448408
  CDS Start-End: 711-1005
actcagtccaggcctctatcatgcctggcacatagtgttgaatattgtattcaataaatattcaacagtaaatatttgttgaatacagtattaaatactatagaatttagacaggtccctgtatcaacaacagcaacaatgaccaccaccaccaccaccaccaccacaacaaaataacaagaatgtccaatgtagggggttgctttttgatccacttgcctttggctagtggtgtctttctctccttagcgccatattcttcagcacttttcggcagctgtatgtggttctattttggtctcctctttactgcacggcgattatgttttcaagaggcaaatcttcagggtgactagagtgacacgttatctgagttctggatggaggtaaaggaatatcacggtggtacttaagctccaagaacttacggcacacctgcttgagtggatcatgggtgagctggagaacctgaagtagcaaaggcaagaaggcaacgacgttccatctgtggaaggacctaccaaccagatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaagg

SEQ ID NO: 186546 - DNA, 596 bp, Homo sapiens
  Payload ID: 16732
  Gene Symbol: ST6GAL1
  Gene Name: ST6 beta-galactosamide alpha-2,6-sialyltranferase 1
  ENST ID: ENST00000455441
  CDS Start-End: 532-596
cttccttccttctccagtcccttccactgtgcgtcttctgtcccccgttcttccccagcggacccctctttcgagactccctagtggggtccccagctcccgggcgatcctgcccttgccgagcgcgttttctggagtcacctgggggaggggagtcctgggcagggccgggctggggaagacgcctggggcactgcccggcgttaacaaagggagccgataccgaccggcgtgggcgcggagcgggcggccgccaccgagcgtgctgagcaaccgcagcctccgcggccgagagtgcagcgagcaaggggagagccagttgcgcagagccctgcaaccagcagtccagggagaagtggtgaatgtcatggagcccagctgaaatggactggcccccttgagcctgtcccaagccctggtgccaggtgtccatccccgtgctgagatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaat

SEQ ID NO: 186547 - DNA, 504 bp, Homo sapiens
  Payload ID: 16732
  Gene Symbol: ST6GAL1
  Gene Name: ST6 beta-galactosamide alpha-2,6-sialyltranferase 1
  ENST ID: ENST00000430309
  CDS Start-End: 377-504
aacaaacccacgtgcgcacagccccggggaacacggatttctccacggcaccgcaaggggagagccagttgcgcagagccctgcaaccagcagtccagggagaagtggtgaatgtcatggagcccagctgaaatggactggcccccttgagcctgtcccaagccctggtgccaggtgtccatccccgtgctgagatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaa

SEQ ID NO: 186548 - DNA, 507 bp, Homo sapiens
  Payload ID: 16732
  Gene Symbol: ST6GAL1
  Gene Name: ST6 beta-galactosamide alpha-2,6-sialyltranferase 1
  ENST ID: ENST00000458216
  CDS Start-End: 431-507
cggccgccaccgagcgtgctgagcaaccgcagcctccgcggccgagagtgcagcgagcaaggggagagccagttgcgcagagccctgcaaccagcagtccagggagaagtggtgaatgtcatggagcccagctgaaatggactggcccccttgagcctgtcccaagccctggtgccaggtgtccatccccgtgctgagatgagttttgatcatcctgagaaaaatgggccttggcctgcagacccaataaaccttccctcccatggataatagtgctaattcctgaggacctgaagggcctgccgcccctgggggattagccagaagcagttggctacatgtctgctatcttacccagaattcctagcctctatcatgaggcttgttttcctgctcagaacaaagtgacttccctgaacacatcttcattatgattcacaccaacctgaagaaaaagttcagctgctgcgtcctggtctttcttctgtttgcagtcatctgtgtgtg

SEQ ID NO: 186549 - DNA, 570 bp, Homo sapiens
  Payload ID: 16732
  Gene Symbol: ST6GAL1
  Gene Name: ST6 beta-galactosamide alpha-2,6-sialyltranferase 1
  ENST ID: ENST00000442023
  CDS Start-End: 224-570
cgctgctaccaataatcaaaagcctacaattgacctttgaaaagacttgaagcatagatctgcacatcatttccaggttctgaaattctgttgtttttcctgattagtggaggactctattggcctcaacaacctggatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaatcctaattgtatgggacccatctgtataccactcagatatcccaaagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtatcatcatcatgatgacgctgtgtgaccaggtggatatttatgagttcctcccatccaa

SEQ ID NO: 186550 - DNA, 707 bp, Homo sapiens
  Payload ID: 16732
  Gene Symbol: ST6GAL1
  Gene Name: ST6 beta-galactosamide alpha-2,6-sialyltranferase 1
  ENST ID: ENST00000417392
  CDS Start-End: 368-707
gaggcgccacttgctggaagagggcgagagagacatttaaaaggcaaggggagagccagttgcgcagagccctgcaaccagcagtccagggagaagtggtgaatgtcatggagcccagctgaaatggactggcccccttgagcctgtcccaagccctggtgccaggtgtccatccccgtgctgagatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctgga

SEQ ID NO: 186551 - DNA, 602 bp, Homo sapiens
  Payload ID: 16732
  Gene Symbol: ST6GAL1
  Gene Name: ST6 beta-galactosamide alpha-2,6-sialyltranferase 1
  ENST ID: ENST00000423451
  CDS Start-End: 222-602
gcttaatgctgatttaccaagcggagtgcaaattgtgtgatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaag

SEQ ID NO: 186552 - DNA, 3947 bp, Homo sapiens
  Payload ID: 16732
  Gene Symbol: ST6GAL1
  Gene Name: ST6 beta-galactosamide alpha-2,6-sialyltranferase 1
  Uniprot ID: P15907
  ENST ID: ENST00000457772
  CDS Start-End: 670-1197
gctcttcttccttccttctccagtcccttccactgtgcgtcttctgtcccccgttcttccccagcggacccctctttcgagactccctagtggggtccccagctcccgggcgatcctgcccttgccgagcgcgttttctggagtcacctgggggaggggagtcctgggcagggccgggctggggaagacgcctggggcactgcccggcgttaacaaagggagccgataccgaccggcgtgggcgcggagcgggcggccgccaccgagcgtgctgagcaaccgcagcctccgcggccgagagtgcagcgagcaaggggagagccagttgcgcagagccctgcaaccagcagtccagggagaagtggtgaatgtcatggagcccagctgaaatggactggcccccttgagcctgtcccaagccctggtgccaggtgtccatccccgtgctgagatgagttttgatcatcctgagaaaaatgggccttggcctgcagacccaataaaccttccctcccatggataatagtgctaattcctgaggacctgaagggcctgccgcccctgggggattagccagaagcagatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaatcctaattgtatgggacccatctgtataccactcagatatcccaaagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctcttggccaccccagcctgggaagaacattttcctgaacaattccagcctgctccttttactctaggggcctctgtcagcaagaccatggggacttcaagagcctgtggtcaggaaatcaggtccagccttccctgtagccagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacctacccccaaatcttctcctaaccaccatctgttttttttttttaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaa

SEQ ID NO: 186553 - DNA, 544 bp, Homo sapiens
  Payload ID: 16732
  Gene Symbol: ST6GAL1
  Gene Name: ST6 beta-galactosamide alpha-2,6-sialyltranferase 1
  ENST ID: ENST00000427315
  CDS Start-End: 388-544
tccttccttctccagtcccttccactgtgcgtcttctgtcccccgttcttccccagcggacccctctttcgagactccctagtggggtccccagctcccgggcgatcctgcccttgccgagcgcgttttctggagtcacctgggggaggggagtcctgggcagggccgggctggggaagacgcctggggcactgcccggcgttaacaaagggagccgataccgaccggcgtgggcgcggagcgggcggccgccaccgagcgtgctgagcaaccgcagcctccgcggccgagagtgcagcgaatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaatcctaattgtatgggacccatctgtataccactcagatatcccaaagtggtaccagaatccggattataatttctttaacaactacaagactt

SEQ ID NO: 186554 - DNA, 577 bp, Homo sapiens
  Payload ID: 16732
  Gene Symbol: ST6GAL1
  Gene Name: ST6 beta-galactosamide alpha-2,6-sialyltranferase 1
  ENST ID: ENST00000416235
  CDS Start-End: 354-577
ataagccactccacaggagaaatgacttcattttttcaacaaatatatgccgtggaaaagaagaagtaagggagcgaggaactcttctagataagagagaattgaaaatggcacatcatccagtcatccaaacaaaatgtcctgtccttgtttggatccccttttgagcagatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccg

SEQ ID NO: 186555 - DNA, 1055 bp, Homo sapiens
  Payload ID: 16732
  Gene Symbol: ST6GAL1
  Gene Name: ST6 beta-galactosamide alpha-2,6-sialyltranferase 1
  ENST ID: ENST00000448449
  CDS Start-End: 1-537
cttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcgatgatcatgacgcagtcctgaggtttaatggggcacccacagccaacttccaacaagatgtgggcacaaaaactaccattcgcctgatgaactctcagatctctgtgcaccattgtgccagggctgcgaggaaggtggcccacttcccgggatacactacccaccctcaagagagcctttcctgctgcttcttagttggttaccacagagaagcgcttcctcaaagacagtttgtacaatgaaggaatcctaattgtatgggacccatctgtataccactcagatatcccaaagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctctt

SEQ ID NO: 186556 - DNA, 608 bp, Homo sapiens
  Payload ID: 16732
  Gene Symbol: ST6GAL1
  Gene Name: ST6 beta-galactosamide alpha-2,6-sialyltranferase 1
  ENST ID: ENST00000438590
  CDS Start-End: 317-608
attattgactgagcagacagagagacgtgtcctcgccaacatctacaaatagctctgggctttggcaggcctggatgcaggatcttggaaaagaggagcgtgggtctgctgtttacagtgcaaagatttgacagatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaaca

SEQ ID NO: 186557 - DNA, 6857 bp, Homo sapiens
  Payload ID: 16733
  Gene Symbol: ST6GAL2
  Gene Name: ST6 beta-galactosamide alpha-2,6-sialyltranferase 2
  Uniprot ID: Q96JF0
  ENST ID: ENST00000361686
  CDS Start-End: 190-1779
ttccgccggggcaggcgccgggactccctcctggccgcccacagcctgtgcgcattcctgcattcctgccgccgcccgggacccgagtgccccggaggtgtccaggcgcggtgccaggcgggtactgtgcaggttcattctgccacccatctgcattaagacacaaggtgctgaccgcagagacctgccatgaaaccacacttgaagcaatggagacaacgaatgcttttcggaatattcgcttgggggctcctctttttgctgattttcatctacttcaccgacagcaaccccgctgagcctgtacccagctccctctccttcctggagaccaggaggctcctgccggtgcaggggaagcagcgggccatcatgggcgccgcacatgagccctccccgcctgggggcctggacgcacgccaggcgctgccccgcgcccacccagccggttcctttcatgcggggcctggagacctgcagaaatgggcccagtcccaagatgggtttgaacataaagagtttttttcatcccaggtggggagaaaatctcaaagtgctttctacccggaggatgacgactacttttttgctgctggtcagccagggtggcacagccacactcaggggacattgggattcccttcccccggggagccaggcccacgggagggggcttttccggctgcacaggtccagaggaggcgggtgaagaagaggcaccggaggcagagaaggagccacgtgttggaggagggcgacgacggcgacaggctgtactcctccatgtccagggccttcctgtaccggctctggaaggggaacgtctcttccaaaatgctgaacccgcgcctgcagaaggcgatgaaggattacctgaccgccaacaagcacggggtgcgcttccgcgggaagcgggaggccgggctgagcagggcacagctgctgtgccagctgcggagccgcgcgcgcgtgcggacgctggacggcaccgaggcgcccttttctgcgctgggctggcggcgcctggtgcccgccgtgcccctgagccagctgcacccccgcggcctgcgcagctgcgctgtcgtcatgtctgcaggcgcaatcctcaactcttccttgggcgaggaaatagattctcatgatgcggttttgagatttaactctgctcctacacgtggttatgagaaagatgttgggaataaaaccaccatacgcatcattaattcgcagattctgaccaaccccagccatcacttcattgacagttcactgtataaagacgtcattttggtggcctgggaccctgccccatattccgcaaatcttaacctgtggtacaaaaaaccggattacaacctgttcactccatatattcagcatcgtcagagaaacccaaatcagccattttacattcttcatcctaaatttatatggcagctctgggatattatccaggagaacactaaagagaagattcaaccaaacccaccatcttctggtttcattggaatcctcataatgatgtccatgtgcagagaggtgcacgtgtatgaatatatcccatccgtgcggcagacggagctgtgccactaccacgagctgtactacgacgcagcctgcaccctcggggcgtaccacccactactctatgagaagctcctggtgcagcgcctgaacatgggcacgcagggggatttgcatcgcaagggcaaggtggttcttcccggcttccaggcggtgcactgccctgcaccaagtccagtcattccacactcttaaaaagggtttcttgggaatcaatgtgcaataaggtactactgttgtactcaaagtcacaaaagaatacttgaagatagattttagacagtgtagttttgagtctttaaacagtaatttagtggtggtcatgataatccttctctttctaagccattgagtatgtattactgctttgaacatagaaatggtttttttaaaaaaataaggctcaagaaagatgcaaaaccaaggatagctagaaagaaaacacatgtatgaccatgggtatgatacctccagaaatgttaacaacttattcttctgccatgagtacccctcatcagggttggtttcaatgacaggttttggtgatgttcctgaccatatgaagtggtttatgtttagaaacattcaaattgagggacatcatttacagcatcgagtgtgtcagttatacatgcattcatcattaaatatcctaggttttatgacagacattgaaattatcactcagatgtgtttaacagcaaaaaattcccagcacatcctggcaaaggcttttatttccaaccgttgcattcttcatctctgcctcccattgcccactgaatgctttgctttctgtgcatcaagacagagttctaaaaccagaaaacatccatcttgaaaggtccaagaaaaagccaaattccatatagcaccacagaggaggccctttgtttccctgcagtatttcaaccaggaacattagtatcacatccaccaggaggcacatcactggcaagtaacatagaatcacagggctgcaggtgcccctggacactccccggttctggcttttctgccttgtacctcctcacctgcagatctaccctgcagcttttgcatagtcagtgacacacttgacaattggcacagctgtgctggggaagacgggagacaccttgctccttccaaactagaaggaaagattttggagccatcaccctgtgcttctagggatgcacgcctgtctttattatacaggtttcttgcaggtttttatcagccagtgggaactccacagtgatgagcactgaatcttcactaaatcttcctacagacatttaggaatccagtccttgcttttgcagatatgttttatgtcagcagcatgacaaagccatataattaaataatttatgtgaaagcattgcttattaacaaggaaaatatgtagatgcttcagagggaaaggcagctagagggaaattttcatcccaatatgttagctatattcagggttgattttttctttaatctcaactgtcactgatacattgaaaaatttttgctatgaatatagtgaaacagaaacattctgtaataccttaattaaacatgctattatttcaatgtataaccaaaacatatctccatggtacagttaagacttgttgcaatgacaatagcagcttaattaaatgcgttctcccttgcaaaatgtatgaatgtcaggagagtttagtggaaaagttttctttgtttcaggattggtttcttctagactgttctcaggactactttcttgagcaagaatggcttacagagactgaaggcttctgtttggttagtctattcagcagatatggagctggaaaacaagacatctcctatagcttgctataatagtgaaggagaaattggaaagttttaatcacaataatatccaataaaagcccattttgagagttttgttattaagtcaatgagaagggataggtaactttgtcctatatattaacttatgtctaaatagacatggttaagccatgttcctttctaatttcttttcttttcttttttttttttttttttgagacagtctctcgctctgtcgcccaggctagagtgcagtggtgcgatcttggttcactgccagctctgcctcccacgttcacaccattctcctgcctcagcctcctgagtagctggggactacaggcacccgccaccacgcccagctaattttttgtatttttagtagagacagggtttcaccgtgttagccagggtggtctcgatctcctgaccttgtgatctgcctgcctcggcctcccaaagtgatgggattataggcgtgagccaccaccgcgcccggtcattcctttctaatttcttgaaaaaactttgtcttgtccttatgtttacatgtgtgtaataatttcagcaactctggaatgtgggtgaggtggctgtggtggatgaatattactccctaccctccttggatctttctagatcttccagaccattaaatgcccctgaagctccttttatagttttgcaagtggatttacttgtagacatccttactatccagcataatcccccttggctgacatgagaacttggttagaggagaatttattggggtcagtgtaaatattcaagttcaaaagcctcagaacccaacactttaaagatttttaaatggaattttgtcgtagtcattgtacttttaaaatagtactttcagtttcattgaggttacaagaaagactgaagagtacaaaggaaatttagttacaatttttgcatttattatggccttaaagactcttgggaatcaggctctgttcaacagtcaataaatgtaatacacacattaatatagtactgactgggcgttcttctataaaagtttaagttctttggcttctaagaaaatgttgggcagttacagttaacttgatgactacttctagtattagccaaatgggtcctaagtggcagcattttgccagacattgactaaatccttacatgccacatttactgaattccaataaacatatagttcttctgtggagtagttaacagtaagtggcagctcactgaatttctcccaggttctgtctcttccaaaatcctccatcctctcttatgaagggaagctgataaaaaaaaatcctcttggtgcaagctgaagctgttaaggattccttttttcactctcaggaccaacagacgttcttttgtatttcaagataatttcacctgttgttgttgttgttgttgttgttgttgttgttgttgttgttgttacaaagaaacaaattttgagcagcaatgacaattcaaccatatctagattctccctaccttatttctccagccagtcacaccaggcagacgggtaacctttaacagacctggtgttctcatggaataccgatgctcgtcccagggagctgacctttctcactatgtccttatagagctgctcttacagagaactttgtgctcaggaccaagggatggtcaattaaaagttgcatgtaagcatcaggcttggatgggcaagggagggcttttatacatctttgaacgaccaggtctttccttgtctgcctgaaggcagagcttcgagaaacagcacttcccatgtgtctggtcctcttggtctctcagccagacacttaatcaatcctggactctccagtagtcctcagtcattgtagccatagcatctgcaaaaaaagaaatgctaaaataatcattagcgttttcaaaattaggaaatcaaagtagctgggtcactctcttacatgtgtatgagccagttaattctgctggacagatcatacttacgctgctgattgactcttctgagcagtaacacatctcctgaattaattaggtaggtcccgtttgggtgctttaagtgggatcagtcttagatgagtgccagtatgtgattgaatttcatacgcacaaatgccatgattcaagttctctctccagtttttcttatagatcaacacacagtacatgtggtcagttacttggttgaatttctgcttagctgtggtaagagacagagaaagggagtgaggtgggaccaggggaattatcagaaagacatgagtgaacctattggccaggtagcttccaagtatgttctattgtattgtctgttttgattctgatagtttagaactctttctgatagtttagaactcttacccagtggttacatgactgatcaaggcaactccatctggaaattaattgcttgggtaaaatgtccctgagtttcaacttgtcttttatctctggatattctcttatgagattattatgcatgtttctgtcacatgggcattatttacacacttgataaatgaaaggtatttctctgtccgttcaaggaaataaaatgtaagttcttgttttattaaatgaatgaagccttttggttaaaaaaaaagtaatgtaatatgtttctgttcaaacttgagctaatgacatttaaggaattaaagacattgatctagttcttagtatgaaaagtgtacatgtagatatagttatataattgtgtatatacatatctacacacatggttggttttatattgctttttcatcaatatttttgactgaaacctttacaataaattttattttaattatgtaaccactaatattttgagagaaggaagcaaatgttatatgtccttctgttaaaagaaaaaaaattcagtcctccgccaaccgcttcccacacactcatactctgcacatcttggctacattaaaatggactgacagaattatttaaaaggcactatgaaggtagaacactaccttaatattttatcctagtcagaagcctgatttaacactgaactttgaagggaagcttagctgtagctcatggctttcaaagattagaagaaacatttactggttctatggaaaatagtcttcttgctaggtagattggaaacaaagaaattgcattggtggtgttaaaatctaacatttataacaaatcctgttttattctagatgaaatacttagacaattcttccagtggaaaccagtgaacttttttaacagctttgggaattcttttgtatgataatttttaaaatgaaatgtgtactcttcaaactaattaaagcttgaagttttccaggagtcgcattttaaaagtgtttgtacacattttaacacttggatattttctattttggttttgtatatttttatgtatacacaatgtacagacttttttcttgtaaataaaacatgttttcatttgtctagaa

SEQ ID NO: 186558 - DNA, 574 bp, Homo sapiens
  Payload ID: 16733
  Gene Symbol: ST6GAL2
  Gene Name: ST6 beta-galactosamide alpha-2,6-sialyltranferase 2
  ENST ID: ENST00000361803
  CDS Start-End: 1-286
ttctggtttcattggaatcctcataatgatgtccatgtgcagagaggtgcacgtgtatgaatatatcccatccgtgcggcagacggagctgtgccactaccacgagctgtactacgacgcagcctgcaccctcggggcgtaccacccactactctatgagaagctcctggtgcagcgcctgaacatgggcacgcagggggatttgcatcgcaagggcaaggtggttcttcccggcttccaggcggtgcactgccctgcaccaagtccagtcattccacactcttaaaaagggtttcttgggaatcaatgtgcaataagatgaaatacttagacaattcttccagtggaaaccagtgaacttttttaacagctttgggaattcttttgtatgataatttttaaaatgaaatgtgtactcttcaaactaattaaagcttgaagttttccaggagtcgcattttaaaagtgtttgtacacattttaacacttggatattttctattttggttttgtatatttttatgtatacacaatgtacagacttttttcttgtaaataaaacatgttttcattt

SEQ ID NO: 186559 - DNA, 7275 bp, Homo sapiens
  Payload ID: 16733
  Gene Symbol: ST6GAL2
  Gene Name: ST6 beta-galactosamide alpha-2,6-sialyltranferase 2
  Uniprot ID: Q96JF0
  ENST ID: ENST00000409382
  CDS Start-End: 612-2201
gcagcctcggtgcgtgggccgggaaccgccgcctctccccggggctcggggccgcggttcctctggccgcgggagccgccgccgcgctgcccgaaacaatgaggcgtgcagcgcggggctgagcgtagcctcccgccggctttgaggccgagccacccgctgtgccccgccgcccgcgcttgcagctgccgccggcgcggagcagcgctggccccggagaggtgatcccgcaggccgcctgggacgggagcgcggggcagctccgagaccccacggtggcaggaggaggactcgagcctgcggcaggacgactcccgccgcgcactcgccttctgcagcccccaagttccgcggcgtgagtcggggaccccggccagggtcccagctctagcgggcgccagcgtgagtgtgggagcgcgtagcgcgcgcacccgagcggctgccggggaataaaatgtgacacgcacgccttggactccagtgccgcgctgccagggggagcaccgagcaccacggtgtcgtgcgcttcgaggcgcggcgtgggaagaaggctggttcattctgccacccatctgcattaagacacaaggtgctgaccgcagagacctgccatgaaaccacacttgaagcaatggagacaacgaatgcttttcggaatattcgcttgggggctcctctttttgctgattttcatctacttcaccgacagcaaccccgctgagcctgtacccagctccctctccttcctggagaccaggaggctcctgccggtgcaggggaagcagcgggccatcatgggcgccgcacatgagccctccccgcctgggggcctggacgcacgccaggcgctgccccgcgcccacccagccggttcctttcatgcggggcctggagacctgcagaaatgggcccagtcccaagatgggtttgaacataaagagtttttttcatcccaggtggggagaaaatctcaaagtgctttctacccggaggatgacgactacttttttgctgctggtcagccagggtggcacagccacactcaggggacattgggattcccttcccccggggagccaggcccacgggagggggcttttccggctgcacaggtccagaggaggcgggtgaagaagaggcaccggaggcagagaaggagccacgtgttggaggagggcgacgacggcgacaggctgtactcctccatgtccagggccttcctgtaccggctctggaaggggaacgtctcttccaaaatgctgaacccgcgcctgcagaaggcgatgaaggattacctgaccgccaacaagcacggggtgcgcttccgcgggaagcgggaggccgggctgagcagggcacagctgctgtgccagctgcggagccgcgcgcgcgtgcggacgctggacggcaccgaggcgcccttttctgcgctgggctggcggcgcctggtgcccgccgtgcccctgagccagctgcacccccgcggcctgcgcagctgcgctgtcgtcatgtctgcaggcgcaatcctcaactcttccttgggcgaggaaatagattctcatgatgcggttttgagatttaactctgctcctacacgtggttatgagaaagatgttgggaataaaaccaccatacgcatcattaattcgcagattctgaccaaccccagccatcacttcattgacagttcactgtataaagacgtcattttggtggcctgggaccctgccccatattccgcaaatcttaacctgtggtacaaaaaaccggattacaacctgttcactccatatattcagcatcgtcagagaaacccaaatcagccattttacattcttcatcctaaatttatatggcagctctgggatattatccaggagaacactaaagagaagattcaaccaaacccaccatcttctggtttcattggaatcctcataatgatgtccatgtgcagagaggtgcacgtgtatgaatatatcccatccgtgcggcagacggagctgtgccactaccacgagctgtactacgacgcagcctgcaccctcggggcgtaccacccactactctatgagaagctcctggtgcagcgcctgaacatgggcacgcagggggatttgcatcgcaagggcaaggtggttcttcccggcttccaggcggtgcactgccctgcaccaagtccagtcattccacactcttaaaaagggtttcttgggaatcaatgtgcaataaggtactactgttgtactcaaagtcacaaaagaatacttgaagatagattttagacagtgtagttttgagtctttaaacagtaatttagtggtggtcatgataatccttctctttctaagccattgagtatgtattactgctttgaacatagaaatggtttttttaaaaaaataaggctcaagaaagatgcaaaaccaaggatagctagaaagaaaacacatgtatgaccatgggtatgatacctccagaaatgttaacaacttattcttctgccatgagtacccctcatcagggttggtttcaatgacaggttttggtgatgttcctgaccatatgaagtggtttatgtttagaaacattcaaattgagggacatcatttacagcatcgagtgtgtcagttatacatgcattcatcattaaatatcctaggttttatgacagacattgaaattatcactcagatgtgtttaacagcaaaaaattcccagcacatcctggcaaaggcttttatttccaaccgttgcattcttcatctctgcctcccattgcccactgaatgctttgctttctgtgcatcaagacagagttctaaaaccagaaaacatccatcttgaaaggtccaagaaaaagccaaattccatatagcaccacagaggaggccctttgtttccctgcagtatttcaaccaggaacattagtatcacatccaccaggaggcacatcactggcaagtaacatagaatcacagggctgcaggtgcccctggacactccccggttctggcttttctgccttgtacctcctcacctgcagatctaccctgcagcttttgcatagtcagtgacacacttgacaattggcacagctgtgctggggaagacgggagacaccttgctccttccaaactagaaggaaagattttggagccatcaccctgtgcttctagggatgcacgcctgtctttattatacaggtttcttgcaggtttttatcagccagtgggaactccacagtgatgagcactgaatcttcactaaatcttcctacagacatttaggaatccagtccttgcttttgcagatatgttttatgtcagcagcatgacaaagccatataattaaataatttatgtgaaagcattgcttattaacaaggaaaatatgtagatgcttcagagggaaaggcagctagagggaaattttcatcccaatatgttagctatattcagggttgattttttctttaatctcaactgtcactgatacattgaaaaatttttgctatgaatatagtgaaacagaaacattctgtaataccttaattaaacatgctattatttcaatgtataaccaaaacatatctccatggtacagttaagacttgttgcaatgacaatagcagcttaattaaatgcgttctcccttgcaaaatgtatgaatgtcaggagagtttagtggaaaagttttctttgtttcaggattggtttcttctagactgttctcaggactactttcttgagcaagaatggcttacagagactgaaggcttctgtttggttagtctattcagcagatatggagctggaaaacaagacatctcctatagcttgctataatagtgaaggagaaattggaaagttttaatcacaataatatccaataaaagcccattttgagagttttgttattaagtcaatgagaagggataggtaactttgtcctatatattaacttatgtctaaatagacatggttaagccatgttcctttctaatttcttttcttttcttttttttttttttttttgagacagtctctcgctctgtcgcccaggctagagtgcagtggtgcgatcttggttcactgccagctctgcctcccacgttcacaccattctcctgcctcagcctcctgagtagctggggactacaggcacccgccaccacgcccagctaattttttgtatttttagtagagacagggtttcaccgtgttagccagggtggtctcgatctcctgaccttgtgatctgcctgcctcggcctcccaaagtgatgggattataggcgtgagccaccaccgcgcccggtcattcctttctaatttcttgaaaaaactttgtcttgtccttatgtttacatgtgtgtaataatttcagcaactctggaatgtgggtgaggtggctgtggtggatgaatattactccctaccctccttggatctttctagatcttccagaccattaaatgcccctgaagctccttttatagttttgcaagtggatttacttgtagacatccttactatccagcataatcccccttggctgacatgagaacttggttagaggagaatttattggggtcagtgtaaatattcaagttcaaaagcctcagaacccaacactttaaagatttttaaatggaattttgtcgtagtcattgtacttttaaaatagtactttcagtttcattgaggttacaagaaagactgaagagtacaaaggaaatttagttacaatttttgcatttattatggccttaaagactcttgggaatcaggctctgttcaacagtcaataaatgtaatacacacattaatatagtactgactgggcgttcttctataaaagtttaagttctttggcttctaagaaaatgttgggcagttacagttaacttgatgactacttctagtattagccaaatgggtcctaagtggcagcattttgccagacattgactaaatccttacatgccacatttactgaattccaataaacatatagttcttctgtggagtagttaacagtaagtggcagctcactgaatttctcccaggttctgtctcttccaaaatcctccatcctctcttatgaagggaagctgataaaaaaaaatcctcttggtgcaagctgaagctgttaaggattccttttttcactctcaggaccaacagacgttcttttgtatttcaagataatttcacctgttgttgttgttgttgttgttgttgttgttgttgttgttgttgttacaaagaaacaaattttgagcagcaatgacaattcaaccatatctagattctccctaccttatttctccagccagtcacaccaggcagacgggtaacctttaacagacctggtgttctcatggaataccgatgctcgtcccagggagctgacctttctcactatgtccttatagagctgctcttacagagaactttgtgctcaggaccaagggatggtcaattaaaagttgcatgtaagcatcaggcttggatgggcaagggagggcttttatacatctttgaacgaccaggtctttccttgtctgcctgaaggcagagcttcgagaaacagcacttcccatgtgtctggtcctcttggtctctcagccagacacttaatcaatcctggactctccagtagtcctcagtcattgtagccatagcatctgcaaaaaaagaaatgctaaaataatcattagcgttttcaaaattaggaaatcaaagtagctgggtcactctcttacatgtgtatgagccagttaattctgctggacagatcatacttacgctgctgattgactcttctgagcagtaacacatctcctgaattaattaggtaggtcccgtttgggtgctttaagtgggatcagtcttagatgagtgccagtatgtgattgaatttcatacgcacaaatgccatgattcaagttctctctccagtttttcttatagatcaacacacagtacatgtggtcagttacttggttgaatttctgcttagctgtggtaagagacagagaaagggagtgaggtgggaccaggggaattatcagaaagacatgagtgaacctattggccaggtagcttccaagtatgttctattgtattgtctgttttgattctgatagtttagaactctttctgatagtttagaactcttacccagtggttacatgactgatcaaggcaactccatctggaaattaattgcttgggtaaaatgtccctgagtttcaacttgtcttttatctctggatattctcttatgagattattatgcatgtttctgtcacatgggcattatttacacacttgataaatgaaaggtatttctctgtccgttcaaggaaataaaatgtaagttcttgttttattaaatgaatgaagccttttggttaaaaaaaaagtaatgtaatatgtttctgttcaaacttgagctaatgacatttaaggaattaaagacattgatctagttcttagtatgaaaagtgtacatgtagatatagttatataattgtgtatatacatatctacacacatggttggttttatattgctttttcatcaatatttttgactgaaacctttacaataaattttattttaattatgtaaccactaatattttgagagaaggaagcaaatgttatatgtccttctgttaaaagaaaaaaaattcagtcctccgccaaccgcttcccacacactcatactctgcacatcttggctacattaaaatggactgacagaattatttaaaaggcactatgaaggtagaacactaccttaatattttatcctagtcagaagcctgatttaacactgaactttgaagggaagcttagctgtagctcatggctttcaaagattagaagaaacatttactggttctatggaaaatagtcttcttgctaggtagattggaaacaaagaaattgcattggtggtgttaaaatctaacatttataacaaatcctgttttattctagatgaaatacttagacaattcttccagtggaaaccagtgaacttttttaacagctttgggaattcttttgtatgataatttttaaaatgaaatgtgtactcttcaaactaattaaagcttgaagttttccaggagtcgcattttaaaagtgtttgtacacattttaacacttggatattttctattttggttttgtatatttttatgtatacacaatgtacagacttttttcttgtaaataaaacatgttttcatttgtct

SEQ ID NO: 186560 - DNA, 1657 bp, Homo sapiens
  Payload ID: 16733
  Gene Symbol: ST6GAL2
  Gene Name: ST6 beta-galactosamide alpha-2,6-sialyltranferase 2
  Uniprot ID: Q96JF0
  ENST ID: ENST00000409087
  CDS Start-End: 191-1591
cttccgccggggcaggcgccgggactccctcctggccgcccacagcctgtgcgcattcctgcattcctgccgccgcccgggacccgagtgccccggaggtgtccaggcgcggtgccaggcgggtactgtgcaggttcattctgccacccatctgcattaagacacaaggtgctgaccgcagagacctgccatgaaaccacacttgaagcaatggagacaacgaatgcttttcggaatattcgcttgggggctcctctttttgctgattttcatctacttcaccgacagcaaccccgctgagcctgtacccagctccctctccttcctggagaccaggaggctcctgccggtgcaggggaagcagcgggccatcatgggcgccgcacatgagccctccccgcctgggggcctggacgcacgccaggcgctgccccgcgcccacccagccggttcctttcatgcggggcctggagacctgcagaaatgggcccagtcccaagatgggtttgaacataaagagtttttttcatcccaggtggggagaaaatctcaaagtgctttctacccggaggatgacgactacttttttgctgctggtcagccagggtggcacagccacactcaggggacattgggattcccttcccccggggagccaggcccacgggagggggcttttccggctgcacaggtccagaggaggcgggtgaagaagaggcaccggaggcagagaaggagccacgtgttggaggagggcgacgacggcgacaggctgtactcctccatgtccagggccttcctgtaccggctctggaaggggaacgtctcttccaaaatgctgaacccgcgcctgcagaaggcgatgaaggattacctgaccgccaacaagcacggggtgcgcttccgcgggaagcgggaggccgggctgagcagggcacagctgctgtgccagctgcggagccgcgcgcgcgtgcggacgctggacggcaccgaggcgcccttttctgcgctgggctggcggcgcctggtgcccgccgtgcccctgagccagctgcacccccgcggcctgcgcagctgcgctgtcgtcatgtctgcaggcgcaatcctcaactcttccttgggcgaggaaatagattctcatgatgcggttttgagatttaactctgctcctacacgtggttatgagaaagatgttgggaataaaaccaccatacgcatcattaattcgcagattctgaccaaccccagccatcacttcattgacagttcactgtataaagacgtcattttggtggcctgggaccctgccccatattccgcaaatcttaacctgtggtacaaaaaaccggattacaacctgttcactccatatattcagcatcgtcagagaaacccaaatcagccattttacattcttcatcctaaatttatatggcagctctgggatattatccaggagaacactaaagagaagattcaaccaaacccaccatcttctggtttcattggctcatttgtaaaaattggccatatcagagcttgcagtgagccgagatcacgcgactgcactccagcctggacgacagagtgagactccatctcaaaaaaaaaaaaaaaactggccatataagaaacttaacattcatactgtttaaag

SEQ ID NO: 186561 - DNA, 308 bp, Homo sapiens
  Payload ID: 16733
  Gene Symbol: ST6GAL2
  Gene Name: ST6 beta-galactosamide alpha-2,6-sialyltranferase 2
  ENST ID: ENST00000419159
  CDS Start-End: 205-308
acactccgtgtttaggagcgagacccgtgtgtggggaatgttgaaggtggtttggggaaaagcaggaaattctggagaagcgaacgggaggacggcttgcgctttggggacgggcggatacagttgtgcccctgtggctcagtaaaggttcattctgccacccatctgcattaagacacaaggtgctgaccgcagagacctgccatgaaaccacacttgaagcaatggagacaacgaatgcttttcggaatattcgcttgggggctcctctttttgctgattttcatctacttcaccgacagcaaccc

SEQ ID NO: 186562 - DNA, 1996 bp, Homo sapiens
  Payload ID: 16734
  Gene Symbol: ST8SIA1
  Gene Name: ST8 alpha-N-acetyl-neuraminide alpha-2,8-sialyltransferase 1
  Uniprot ID: Q92185
  ENST ID: ENST00000261197
  CDS Start-End: 483-890
ggggggggttgcctggcggcgcagcagcgcgggaggcggcgaagggcgcaggagcatcgctcggaggggacaaggggacgccacgggccacatgtttaggagggagccgagccttctcccggaccctcgccgagggcgaccgtgatgctgcagaaccggcgggagcgactcgccgccgccgctctctgcgcactcggagaccccagcgcccgccttctgcaggggaagcgaccatggccatagatcgtgacttcacccccagccacttcccctagaaagaaatccttggaaaagttgcatttgaaaaaatccttgcgctgacctttggggccgacggggccgaagaagcgtgcgtgcgtttgcaagtaagagaaccaaaggtgtgtgtgcatggggggctggcggtgggggaccctccgctgccacttcgcctagctttgtgctgaggccccggcccccgcccctgggacgccggggctgcgatgagcccctgcgggcgggcccggcgacaaacgtccagaggggccatggctgtactggcgtggaagttcccgcggacccggctgcccatgggagccagtgccctctgtgtcgtggtcctctgttggctctacatcttccccgtctaccggctgcccaacgagaaagagatcgtgcagggggtgctgcaacagggcacggcgtggaggaggaaccagaccgcggccagagcgttcaggaaacaaatggaagactgctgcgaccctgcccatctctttgctatgactaaaatgaattcccctatggggaagagcatgtggtatgacggggagtttttatactcattcaccattgacaattcaacttactctctcttcccacagatgcaatctccctcctttgtcaagtgaatacactaaggatgttggatccaaaagtcagttagtgacagctaatcccagcataattcggcaaaggtttcagaaccttctgtggtccagaaagacatttgtggacaacatgaaaatttataaccacagttacatctacatgcctgccttttctatgaagacaggaacagagccatctttgagggtttattatacactgtcagatgttggtgccaatcaaacagtgctgtttgccaaccccaactttctgcgtagcattggaaagttctggaaaagtagaggaatccatgccaagcgcctgtccacaggactttttctggtgagcgcagctctgggtctctgtgaagaggtggccatctatggcttctggcccttctctgtgaatatgcatgagcagcccatcagccaccactactatgacaacgtcttacccttttctggcttccatgccatgcccgaggaatttctccaactctggtatcttcataaaatcggtgcactgagaatgcagctggacccatgtgaagatacctcactccagcccacttcctaggaacaatggaagaagaaaggactgaaccagggtatttttgttaggttttctatgtgactccaagagggaatggtcaagttgtttcatgagtttgcatgggcccttggaaaaacaggaaaggagcaatgaagatccaagcaaaactttactttcagcgttggcttggaggacaaataagaaatgaaacatcctatgaaatactttatagcacatggcagatttgcaactagtaaaatgctggtgaaatgctgttggtaaagcacatggttcaaatctagaagatgcagttcaaaaacaagacagactcgagttgttagggctgaggaaccaatcaaggtagaacaaagaaaatgttggggtaaaagtgttgctgattgtcaacacaaactggcttaataatattaataagaacctgtcttattaagactggctttagaaccgtaggtttttttaaaaaattattatttatttttgccctctttggggaagtgggtgggtagatttaaaaaatcccttcctgagtaataaagatacaaaatgttactgctgataa

SEQ ID NO: 186563 - DNA, 1036 bp, Homo sapiens
  Payload ID: 16734
  Gene Symbol: ST8SIA1
  Gene Name: ST8 alpha-N-acetyl-neuraminide alpha-2,8-sialyltransferase 1
  ENST ID: ENST00000381424
  CDS Start-End: 440-691
gggcgcaggagcatcgctcggaggggacaaggggacgccacgggccacatgtttaggagggagccgagccttctcccggaccctcgccgagggcgaccgtgatgctgcagaaccggcgggagcgactcgccgccgccgctctctgcgcactcggagaccccagcgcccgccttctgcaggggaagcgaccatggccatagatcgtgacttcacccccagccacttcccctagaaagaaatccttggaaaagttgcatttgaaaaaatccttgcgctgacctttggggccgacggggccgaagaagcgtgcgtgcgtttgcaagtaagagaaccaaaggtgtgtgtgcatggggggctggcggtgggggaccctccgctgccacttcgcctagctttgtgctgaggccccggcccccgcccctgggacgccggggctgcgatgagcccctgcgggcgggcccggcgacaaacgtccagaggggccatggctgtactggcgtggaagttcccgcggacccggctgcccatgggagccagtgccctctgtgtcgtggtcctctgttggctctacatcttccccgtctaccggctgcccaacgagaaagagatcgtgcagggggtgctgcaacagggcacggcgtggaggaggaaccagaccgcggccagagcgttcagctgtggcattgcatgagagggaagcagccaagaccgtaagagctgtgtcgctctaattaggtgccaggaggaagtggaaatgaattcagagccacacattctccatttttcagatcttaaacacagaagacactatcagagatttccaggtgaccacaatgagaaaagggcctttcgtcccactacatcttgcctgggatgcaaaatctttagtttgtttccattattgataaaataaacatatatagtacatgattttatgtcccccatgttcatttaaacaatttatagtgtttattatttgtctgattttggaaagaatacatatttactatagaaaacttttaaatgtagtaaaaaa

SEQ ID NO: 186564 - DNA, 9714 bp, Homo sapiens
  Payload ID: 16734
  Gene Symbol: ST8SIA1
  Gene Name: ST8 alpha-N-acetyl-neuraminide alpha-2,8-sialyltransferase 1
  Uniprot ID: Q92185
  ENST ID: ENST00000396037
  CDS Start-End: 483-1553
ggggggggttgcctggcggcgcagcagcgcgggaggcggcgaagggcgcaggagcatcgctcggaggggacaaggggacgccacgggccacatgtttaggagggagccgagccttctcccggaccctcgccgagggcgaccgtgatgctgcagaaccggcgggagcgactcgccgccgccgctctctgcgcactcggagaccccagcgcccgccttctgcaggggaagcgaccatggccatagatcgtgacttcacccccagccacttcccctagaaagaaatccttggaaaagttgcatttgaaaaaatccttgcgctgacctttggggccgacggggccgaagaagcgtgcgtgcgtttgcaagtaagagaaccaaaggtgtgtgtgcatggggggctggcggtgggggaccctccgctgccacttcgcctagctttgtgctgaggccccggcccccgcccctgggacgccggggctgcgatgagcccctgcgggcgggcccggcgacaaacgtccagaggggccatggctgtactggcgtggaagttcccgcggacccggctgcccatgggagccagtgccctctgtgtcgtggtcctctgttggctctacatcttccccgtctaccggctgcccaacgagaaagagatcgtgcagggggtgctgcaacagggcacggcgtggaggaggaaccagaccgcggccagagcgttcaggaaacaaatggaagactgctgcgaccctgcccatctctttgctatgactaaaatgaattcccctatggggaagagcatgtggtatgacggggagtttttatactcattcaccattgacaattcaacttactctctcttcccacaggcaaccccattccagctgccattgaagaaatgcgcggtggtgggaaatggtgggattctgaagaagagtggctgtggccgtcaaatagatgaagcaaattttgtcatgcgatgcaatctccctcctttgtcaagtgaatacactaaggatgttggatccaaaagtcagttagtgacagctaatcccagcataattcggcaaaggtttcagaaccttctgtggtccagaaagacatttgtggacaacatgaaaatttataaccacagttacatctacatgcctgccttttctatgaagacaggaacagagccatctttgagggtttattatacactgtcagatgttggtgccaatcaaacagtgctgtttgccaaccccaactttctgcgtagcattggaaagttctggaaaagtagaggaatccatgccaagcgcctgtccacaggactttttctggtgagcgcagctctgggtctctgtgaagaggtggccatctatggcttctggcccttctctgtgaatatgcatgagcagcccatcagccaccactactatgacaacgtcttacccttttctggcttccatgccatgcccgaggaatttctccaactctggtatcttcataaaatcggtgcactgagaatgcagctggacccatgtgaagatacctcactccagcccacttcctaggaacaatggaagaagaaaggactgaaccagggtatttttgttaggttttctatgtgactccaagagggaatggtcaagttgtttcatgagtttgcatgggcccttggaaaaacaggaaaggagcaatgaagatccaagcaaaactttactttcagcgttggcttggaggacaaataagaaatgaaacatcctatgaaatactttatagcacatggcagatttgcaactagtaaaatgctggtgaaatgctgttggtaaagcacatggttcaaatctagaagatgcagttcaaaaacaagacagactcgagttgttagggctgaggaaccaatcaaggtagaacaaagaaaatgttggggtaaaagtgttgctgattgtcaacacaaactggcttaataatattaataagaacctgtcttattaagactggctttagaaccgtaggtttttttaaaaaattattatttatttttgccctctttggggaagtgggtgggtagatttaaaaaatcccttcctgagtaataaagatacaaaatgttactgctgataattgtgatttgttgagccacgtctatattaactatagctcccctctatttttaaaattttacataagaattgcttcttcctcttttgtcaagtccacagagacaatgtgaagcattattgaatttagactgtgttgcttcatagtctggataacaggagccactttccttcctcagaatttaggacataaacccaattttaggtctgcattatgtaagcctgtttgcattgtcatttttattttagtgcaaaagactaccaatatgagtgaattatttgtttgtaaattggcataattgtcttcataatttaatgttcagaaatgcagtaaagcacgttgatgaaaagcttagtctctgtggaagacagaccagaagacaaatcccttttctatctactgtggcatattcactgcaaggtaaaggacatgtatgcatacatgcaagaatgaattgagcgaaactttgaatatgtttcctcttttgagctattgttatttagtagttacctaaaaaagaatacatttttactagtataccattaaaaatgtaaaaggcttaacatgtatgcatacatgtagacacacatacacacacacaaagttaaacaaagctcattactgtgcaactatgaaagctgaactcatatgacctggtatggcaaaaatttgtaaccagtgttggagaatcacaaatgtgttatgcactatccattacatgttgatataagacaaccgagctcactggttgccgcacataatacccatagcagcacaagatgcaagtcttacccccaaatgcttacccggaatgagcagaattgtcttactcatcctgattttacccaaaatctcatgaatgggcttgctgttgagcgtggtcacacaaggtatagtttgtacaagtaaagaaatgtgaattagtagctatttatttccttagtagcaggtaggactacttagcttgttacaacagctttgatacacagtaagaaaactctactgacagattacaagcagccaaatgtgtttacatttcagagaagggtaagggaagcctctcgttgtcttcatactttggaatgtcttaagctaaaatgtgacactagagttcaatttcttttttattttaaatgtcactaaattgtaggtaaactgtaccaaaaagttctagtttaattttaacagtaaaaactcagcataccatgttaccacgtaaacaataatggctggtattttctgtgggttaatttaacatgacataaacataggaaagcccttggcaaaattctacatcattgaagtagaccatttctaaatgcaattaaatagtgaggttattataaaaattagaatttaaaatatgacttgttgatagtgcagattataatgttacttagaaagttaagaattcgagagtaatgatgctattggagaactggtttgctatacggcagcaaaaacataatgagaatgtaccatgaagaaattgtgttaaatattcactttgagtgaaactttaaatatgtttcctcttttgagctactgttatttagcagttacctaaaaaagaatacatttttactagtctaccattaaaaatataaaaggcttaacaaaaacgcatataaaagttaataaaatgttactcagattagtactttaattgttaaaatgtaattaatgagctccatagagcccatacatcacagttccattgaaaatatcatctggactagaatctcttaaacccaggaagtggaggttgcagtgagccaagatggtgccactgcactccagcctgggtgacagggcaagaccctgtctcaaaaaaaaaaaaaagaaaagaaaaagaaagaaaatattatgtggaaatttttcatctttttatgatgcctgggatagatttatgcagtagatttatatataatgtttagtttacaaacttgtgaaactatttcatgtgggttctgaaaggcaaaacagaaatggccagtgctggtgatgtttgattagaccagctcttctcagctggggtgattcattatccctctctggtgacatttggcaatgtctggagaccagagacattttttattttcatgactcaagggtgctaatagcatgtacttagtagaggttagggatcctgctaaagatcttacaatgcacaagtcagcctctcacagcaaaataattatccaggctgagatgtcagtagtatcaaggttgacatctcagacctggattagacctggattagaccaaaatgaaattttgattgttccaccttgtcttcacttaaagatagatatacatgctcacagcattcaaaatatgactacaatttaatgaaaatattttcttatggtagattacaactcactagatacaccatacatatgccttttggacataattggttagataggagtgtgtgtgtgtgtgtgtgtgtgtgtgtgtgtgtgtgtgtgtgtgtagcatgaagttaggcatctctatccttaactgtgctatgtgttcctaagtaaggacctcgctagaatcatcctgtagagtgctctggaatactctattattaagatcttcaattctaagctcccattatctttctttgtttatctgaaattaagaccttcagaattaggcctggtacttttccagatttgatcagttacattttgatataactgactcttaaaattcagcttagaagacattcaataagaaaatctttaatcacttttggtgatgcacctgccaagagggggcatcactttgtaccatcagactaattaaaaaaattgttgtgtagtcataaaaattaggctgatccataggggcaaaaggaagggtgaagagactaaaaactagtaccctgatagaattttagtttttattagcctcgatttgagaactgcattgattccaaagatcatgaaggtaggtgaaggattaagtcattccataattaagaaaagtaatgtttatatgaaagatttttatatggacaatgactcacagacacatatgctttgtatagaggattttgccaaaagtttatacaaaattgcacatctaaactgcataattctcatacaagaagttaaggaagtgctcactggattttgcttctgtatagttcacttttatctgtcttcacaagggtaggaagtaaatgatctcaaatggcacatgttcagacaatactgtgtttggctttgtgatgtctcatgtctttctcttggctaaaaaaaattgtttaggctatatataacttgtacctgaagcaatctggacaacatggcttaaaatggaaaataactgaaaaaatcctgggattttaaatttgccaaaaatacccttggattagtcaaaggctttacaagagtgttatagatgatccaaaatggaaacaatattgataacatttcttttcgtcagcagctacatattccagttttataactttattatatacattttttgattattaatagaaagtcagccatccagagttttaacttctgtggttgaaatattgactttgtgaaatttttcactgacaaatacttgttaggagggacctaagggggaggggaatgttaccagtccactgaaaactttaggaaatgttcattgtgttgtgtaaatactttcccaccagcaccaggtaatatattctctatgtttgtagaattccaaagatcaaaagctgtaaggacgtttatgtgaacttgacgcaaacttgtggaggaataaggactgagagtaatgttgtgctttttctttatcttcccgtcgtataggtcgactctcaggttatatgacttttattgggcacacgtcaggggtggaagtggtagaagtgggttaacaatttcaaggcctggcaacctaggtcaaaacctctaataaagtcagcagtaaacataactagcaacttcattccactatgtgctaggaggagggtgaggcaagttgaaaggagatgaccctatccccacactctcaggatgtaaaagggcagagtgctctctacccttaaccttggctttttagcaccgtcagtctctgtcctctcccaggagagctgccttggctccagagttgagctagtagcattgtgactagagaggtagtgtggaaattcgctgaggacctcaaaattttacactgccttaaactgttttgtttttgcttaaactcgtgctgtctaaatgtgggtgttttgtggcagagtctgatcaccccgacctagttatagccctgccagtgattctaaagtggaacttttccccctcattcatatggatagtctgagtccttgaagctagggagatatcaaatattctaccagttcctacatagcttctttaaaagtcctagagactaactcacaggaagtctgaagcccagagcgtctgtttataaactcctaaatatgaggccacaatatttaggttgagcactagaaaatttctattttgcaagtggaaggagacttgaatctataattgctgtagctttttttcccttctatcataagaaaatggataccatctgctttaccctcagcccagacttgtcttttgaattttttacatacatcttaggggtgagagattgaaacaagtgcatgaatgaaaagcttattgaaacataacacagcccctgctcaccatttcagtaagggaaaatacatgtttctgtttccctctaatttgttttctctggtgccaacatttctgatttcttctgtctctaatacataaggaataaataccatattttaaattgacttacatgcctgcgagcatttgccagataatcaaagcctatgactctaactttttaaagcacagaagaggaattatattttatggtcactcctctgtgtttctattgatctctatattgtgctaaaattctttcaggtaatttttttcttgttgaagctgtgggatataatcaatgatgccaagctgtctgagaattttatagaataatatccaaatatattgatcctgcctctttctgcttctatgtaattaaactttcttttgatgtttatttttaaaatgtatgcttcacacaacaccaataaacatctaagagatgtgatataatccaaggcaaagaaaagtaagaatcagttaatgtctattttatctgcacagcattacgaacagaaaattgtaataaaaaaaggtttaaccaaactgaaaaaaagagagacaaaatcttggttttaatttgaaaagatgattgggagtgatctcagaagagagttcagcaggaagcaaggaagaggctgttgaccttgagtgcagcctcaagaatggaacctttttgaaatattttaaaggaaatatcttgtcatccagctgttatggttaataatgaatagttttctctgggtgaagcttatccattgcacacctgatgtgctggcccctgcgatttccccaaatgttggaatgttgcctgcataatttgtggtaatgggggactgtgttcctgcttttacctggttacaaaaaacaaaacaaaacaaaacaaaacaacaaacagaaaaaaaaagagagaaaagatgctagaggaagcagtgtgacagacagatcatgagatgctgacggagagaacagagtggtacctgtttacccacttggaccatgacagtatcaaggctccaccccttgctgtcccttcccaagaggtgctctcctgggagtttgatcacagtgaaacaacactcccgttttctttttcctttctttctttctttcttttttttttttttttttttttttgttgagacagagttttttgctcttgttgcccaggctggagtgcaatggcgtgatctcggctcaccgcaacctccgcctcccaggttcaagcgattctcgtgcctcagcctctggagtagctgggattacaggcatgcgccaccacacccggctaattttgtacttttagtagagatggggtttctccatattggtcaggctggtcccgaactcctgacctcaggtgatctgcccgcctcagcctcccaaagtgctgggattacaggcataagccaccgagcccagccccacactcctgttttcatagcccttttttgtctgtactttggtacatattccccaaataagattattatttacatctgtcatgatgaggcagtgatagcagcaagtgtcactttgaccctcacccttggaaagtgggctatgcatagctagagttagaacaggaggttctaatcctgcttccacaattacttcagtaacaggcttttgtatccatgattacttaagctgacttagatgcattttctaccctgtattctagtgtacacaacacaaacacacataagccctttacctgtggagaagagggagatggttgattcagtgggagtggggagtggcagagggtgccttaactttttctggcttgacccctacttccttatgtgtttccttcatatacctctgtcactttagagatgtaatcatgtctgttccaagttgtatcgttattatcaagaagtcctataaatgtagcaaatgtgactattttatagaaatgcacaatagtttataggccttggagaagtctgataatagtatgtaaatatccttcattgaagtcatagaaccttctagtaggaagctccataggtgataactgcaagaggattaatgtttgtttctccagtaaacaccggaagcaaggaatcaatctgtcactgtttatcattcagtcttgagcaccgttgggtgttgataggttactatagacactccccttataattaatatacaggactcacaatttaggatgtctgatggccactagggtacatcatagagacactagagagaagagaacaaatatagctccatcaaaaagcctgcttaatctttaacaagtctgaaatattactaaaattccagttaccgtgcagcatagtcagtctaaaaagcactggggaaaaaggtgtctttttggtctctttaattctattatggcacattttaatattattccacatgtgtgcaaactatttctcaagagcaaagtttgaggctggagttaagaaaatagaaaaattaaaacattattttttctcatataatataatctgactactagttcatggatataataattctgggaaaaattttagattaaactataaaattgaaatcacctttgaagagtatatggaattgcttctttctattaaagccaacctacattggcaaaaagtgtggagaaaatcagtgtgctcaattctttttgtagagtttcatctaaaatgttgcaggtaaaaaagaaaactttaattggtactttctacggtgtgattagaaaaattagtatctatctctgttggttctgctgacttgcttctttccaccgaatctaaatgcaatgtcataggaggaggtttgctgtaaaaacatgtctttttctttggtgtattcattgtaattatggctggcagtgagaaggttcggtaagtctcaatttctctacctcctttacttggagaaaatttgtaaatgtaccctgtgaataaaatgattttttata

SEQ ID NO: 186565 - DNA, 1920 bp, Homo sapiens
  Payload ID: 16734
  Gene Symbol: ST8SIA1
  Gene Name: ST8 alpha-N-acetyl-neuraminide alpha-2,8-sialyltransferase 1
  ENST ID: ENST00000404299
  CDS Start-End: 469-831
ggcggcgcagcagcgcgggaggcggcgaagggcgcaggagcatcgctcggaggggacaaggggacgccacgggccacatgtttaggagggagccgagccttctcccggaccctcgccgagggcgaccgtgatgctgcagaaccggcgggagcgactcgccgccgccgctctctgcgcactcggagaccccagcgcccgccttctgcaggggaagcgaccatggccatagatcgtgacttcacccccagccacttcccctagaaagaaatccttggaaaagttgcatttgaaaaaatccttgcgctgacctttggggccgacggggccgaagaagcgtgcgtgcgtttgcaagtaagagaaccaaaggtgtgtgtgcatggggggctggcggtgggggaccctccgctgccacttcgcctagctttgtgctgaggccccggcccccgcccctgggacgccggggctgcgatgagcccctgcgggcgggcccggcgacaaacgtccagaggggccatggctgtactggcgtggaagttcccgcggacccggctgcccatgggagccagtgccctctgtgtcgtggtcctctgttggctctacatcttccccgtctaccggctgcccaacgagaaagagatcgtgcagggggtgctgcaacagggcacggcgtggaggaggaaccagaccgcggccagagcgttcagcgtctccacactgttgacacttgctgcccatgagtcacttaatatccatcttggtggtgggatcaccgtgcttgtgttcaaggaacaccgattttattttaccagtggccccaaaatgcaagactgatgatgcagctgtggcattgcatgagagggaagcagccaagaccgtaagagctgtgtcgctctaattaggtgccaggaggaagtggaaatgaattcagagccacacattctccatttttcagatcttaaacacagaagacactatcagagatttccaggtgaccacaatgagaaaagggcctttcgtcccactacatcttgcctgggatgcaaaatctttagtttgtttccattattgataaaataaacatatatagtacatgattttatgtcccccatgttcatttaaacaatttatagtgtttattatttgtctgattttggaaagaatacatatttactatagaaaacttttaaatgtagtaaaaaagaagaaaaagcctgctgaaattccctcactcggaagtacttattgtaaacagtctcttttgtgtatgtttgtttgtgtgtattactaaattgtatgtattttgtatatttaattttatatcctcttttattcactcaaaattatacctttagaattttctcatataattaaataacttttaatttataaacttgtgaaaaaatagctttataattttttattttggaaaaataattatttattgtccaagtattaccataaaaatactttaaaaaaagattatgctgctgacaaatttatgttagacttttttctttaatgatttcttcatatgtagttgttgtatagctgagcataggaaattaaaaagcctctttaaagatctgtactgtcttgaggttgatatttaaaggataaaagcaacactattttcatttgtaaaagtaattgacatttaacaaacatcgctaatattttggtttatattcttctggatcattcaatgccaatgtgtgtataaatgaaacaaaaatataatgaattcaacagtacattgcaaatatttttctagtaatagtatatgcagtctacatcatctcttctaatggctgtaagattttccattgttaggatagatacaaatgtatttaattaatatactgttattggatatttatgttgtaatttctcacttttatgaataaagatgtggtgatcatc

SEQ ID NO: 186566 - DNA, 695 bp, Homo sapiens
  Payload ID: 16734
  Gene Symbol: ST8SIA1
  Gene Name: ST8 alpha-N-acetyl-neuraminide alpha-2,8-sialyltransferase 1
  ENST ID: ENST00000541868
  CDS Start-End: 1-519
ccgcggacccggctgcccatgggagccagtgccctctgtgtcgtggtcctctgttggctctacatcttccccgtctaccggctgcccaacgagaaagagatcgtgcagggggtgctgcaacagggcacggcgtggaggaggaaccagaccgcggccagagcgttcaggaaacaaatggaagactgctgcgaccctgcccatctctttgctatgactaaaatgaattcccctatggggaagagcatgtggtatgacggggagtttttatactcattcaccattgacaattcaacttactctctcttcccacaggcaaccccattccagctgccattgaagaaatgcgcggtggtgggaaatggtgggattctgaagaagagtggctgtggccgtcaaatagatgaagcaaattttgtcatgcgatgcaatctccctcctttgtcaagtgaatacactaaggatgttggatccaaaagtcagttagtgacagctaatcccagcataattcggcaaaggtaagagtttatgacttctgtttgtgacgaacgaagatgaagtcttctcaagtacttagcatttcaaaggcagtgagcataattcagtttgggaaatcaagaggaaaaccatctggacaggcaggaaggatgaagggaattgtaaataaagaaaacaggattatgggaatccaaacaata

SEQ ID NO: 186567 - DNA, 572 bp, Homo sapiens
  Payload ID: 16734
  Gene Symbol: ST8SIA1
  Gene Name: ST8 alpha-N-acetyl-neuraminide alpha-2,8-sialyltransferase 1
  ENST ID: ENST00000540824
  CDS Start-End: 1-572
cttttccaggatagaagagagttggctggttactttgcaggacttaagatgatcttcattttaaagaatctgtatcagcctccactgtggaaacaaatggaagactgctgcgaccctgcccatctctttgctatgactaaaatgaattcccctatggggaagagcatgtggtatgacggggagtttttatactcattcaccattgacaattcaacttactctctcttcccacaggcaaccccattccagctgccattgaagaaatgcgcggtggtgggaaatggtgggattctgaagaagagtggctgtggccgtcaaatagatgaagcaaattttgtcatgcgatgcaatctccctcctttgtcaagtgaatacactaaggatgttggatccaaaagtcagttagtgacagctaatcccagcataattcggcaaaggtttcagaaccttctgtggtccagaaagacatttgtggacaacatgaaaatttataaccacagttacatctacatgcctgccttttctatgaagacaggaacagagccatctttgagggtttattatacactgtc

SEQ ID NO: 186568 - DNA, 543 bp, Homo sapiens
  Payload ID: 16734
  Gene Symbol: ST8SIA1
  Gene Name: ST8 alpha-N-acetyl-neuraminide alpha-2,8-sialyltransferase 1
  ENST ID: ENST00000538256
  CDS Start-End: 1-75
agtcagttagtgacagctaatcccagcataattcggcaaagggattttacagctgtcgagagggtgaagaaatagattcttgattaaggaaatggaaaacagctccaaaagccaaatgacagaacgtctccagcaatcaatagactgcagaatcagtcagaatcagaatccctgccacgttgagaagccacaacttcagctgctcactccagactcatgctgcttgaatcagaatctggcttgaaaaatgggcccctgtctcctcatttaacccagttcagaagtcaggactcacacaggtacatgacattggctgcgccagcatcacagctggaatcccggctataaagaagtctgagaaaggcagttcttagcttttccactttggactacaggaagatacagaaggaggttgaaatgattattttgtgatccagtccatacatgcaccacactctaaacattcaaattataagaaatgtattcaatggctttaaatgactctgaaatacttttgattaaacattttttaaaaagcatgaa

SEQ ID NO: 186569 - DNA, 5708 bp, Homo sapiens
  Payload ID: 16735
  Gene Symbol: ST8SIA2
  Gene Name: ST8 alpha-N-acetyl-neuraminide alpha-2,8-sialyltransferase 2
  Uniprot ID: Q92186
  ENST ID: ENST00000268164
  CDS Start-End: 238-1365
gggagggaggggcaggcgggagccgggagggagcgagcgggctcgccgcgcctgagcaacccctgcctgtcgctgccgctgccgctgccgctgccgccgccggcccggactcgtccggagcgcagggtgtctgcccagctgcgcgcggcgcgcggaggctccggcgtccgccgctgcgccctccggcccctgctcctcgcgccggcccgcgtgggtcccggcgggcgcgaacccaccatgcagctgcagttccggagctggatgctggccgcgctcacgctgctcgtggtcttcctcatcttcgcagacatctcagagatcgaagaagaaatcgggaattcgggaggcagaggtacaatcagatcagctgtgaacagcttacatagcaaatctaatagagctgaagttgtaataaacggctcctcatcaccagctgttgttgacagaagtaatgaaagcatcaagcacaacatccagccagcctcgtccaaatggagacataaccagacgctctctctgaggatcaggaagcagattttaaagttcttggatgctgaaaaggacatttctgtcctaaagggaaccctgaagcctggagatattattcattacatcttcgatcgagacagcaccatgaatgtgtcccagaacctctacgagctcctccccaggacttcgccactgaagaataagcactttgggacttgtgccatcgtgggcaactcgggggtcttgctgaacagcggctgtgggcaggagattgacgcccacagcttcgtcatcaggtgcaacctggccccagtacaggagtatgcccgggatgtggggctcaagacagacctggtaaccatgaacccctcggtcatccagcgggcctttgaggacttggtcaatgccacgtggcgggagaagctgctgcaacggctgcacagcctcaatggcagcatcctgtggatccctgccttcatggcccggggcggcaaggagcgtgttgagtgggtcaacgagcttatcctgaagcaccacgtcaacgtgcgcactgcatacccctcgctgcgcctgctgcacgccgttcgcggatactggctgaccaacaaagtccacatcaaaagacccaccaccggcctcttgatgtataccctggccacacgtttctgcaaacaaatctacctctacggcttctggccctttccgctggatcagaaccagaacccagtcaagtaccactattatgacagcctcaagtatggctacacctcccaggccagcccgcataccatgcccttggagtttaaggccctcaagagcctacatgagcagggggctttgaaactgactgtcggccagtgcgatggggccacgtagggtgggcaccccatgggactcagtggctcacatttcctgccagctacaccacaggcagatgggagtcggggtggcacaaacaatagaacaagcaggctagtggttttctttgttaaagtgtaaaacagtgaccagaatatatatatctatacctgcatatatatattgacctgagtatttataactgtgtggtgttcatctagcattaggcagataggccacaggaagaaggtgtggagaacccacctgaaccagattgagactcaatccatctttgggggtggaaggacttgacatgaaaagaagccagtcccatgactttggatgacaaactgcctcctggcttggagggatctttgggctcatggatgaatggcgagccacctgttgtcagctgccccaagcctctgggatatgtggattcggagaaagctgaggcccagaggggacactcgacccagtctaaagtgggtgccattcacggaggagagggaggttggagacttcaaccgggcaaaggagcacaaggaaaccaagcagcagaggccccatcagcacagagggcctcgttccacgaacgtagagtttgactgcctaagggacagcacgaatgactcacatgtttcagacaggcctccacggctatggagagaaggctggaggagacacaatggatggttcatgttctggcttagcaagagccaccaagaactttgggtgaagcaagcagatgacaatgaagaggagtaatgttccgaatcatgtttttgaaaaatcaagacctcctgttaagggcccacttgaccctagaataaggcaggagagtgtctaaaatctagctgctttgggtgttttttaaagcaatgtgagtccactgaggaggaagagaccctgggatttcaccctctgggttagtctctgtctcaccctgttagaatgtcacgagggactgtactgtcccctctgtcaccagggaagccacaatgagagcttgaaagggtgctgtcaagataaatgtcatccttcttaaaatacatatgattgcctttttgggtgcctcacagagccccagagtgtgagacctgaaagaatgttcagcatctagctccatgtccctgcaaccactctctgtttgccttctgcattctgcactctgcggggcctttgcagccagactgctgtgtcaatgttactttcttgtcactttcctaccctgatggtcacactagcccaccccaagctccgacattgaggttttcatctctgcagggagaggttccaatgtccaccccacccccaggtacccgcctcttcccacagaagcaattttagaattttgcaaaattcttttccccttattgagattaatatttaagattaaaaaaaaaatacccaaagccaaatgcagttccaaatagtggacataatctcccagggaaatctgggctcgaggcctacaacttaggggctggaatcacaggtctcacatagagaaatagccagcttgaatttgttagtcgtattccttcacctgatgaataacagtgttttaaaacatatttgaaaggtaagtaaaaaactaccatcttgaaggtgaagggagttaagaaaagtaatcaagacctgctcctaagcatatgagaccagatgtaattaatcaatggcaatgcagaacaggaccttggctctaaattaatggttgaccggaagggattggaggcggcagaaccattaaccctacacaagaacactccagcccaaaaccgtgaggaaggtgatatatctctgcattttcccttgttgttgcttgaagtctgtgattggggatttgcgttataaaatgaatattttaaaaagcaacagccctaatagcctctgtgggaactgagtggtttcggactcctcacaggcggtggaaataattaataccatattttatacatctccagagcctttcatcttgaggatctcaaagaccgtagaagacatttaatttctaaagcttgaagtgccccgaggagcaggtagaatttccagcagggccttggtggattaaccaaggccttggattccagaatgtttcatggtaagcactgtggagaacctacatgtcaggttctggagttggccctgagctctatccaccaagccagcaccccaccatccctttgcaggggagtcaaagggccagaactccttgggggaccagaacatggttttccttctgcctatcttagtcatggctcctaaaattgaagctgatatgagctggagtgcaaggagtccttccaccctgccttcaggttctctctggagaaaggttagagaccccaggacaatcaacatgtgcaccgttcccctcctcggcttgagtcctgcactaccaaaatggcctggccatttgatggcggagctccaggggccttggctttctctggctcattgtccttctccatctgggccaattgtccttccctgcccattcagagttcaatttgagcctccactgcagttcctggtgtgggccagctggtgttgggtggccccagggagtcacacagtctgtacccggccccgagatcctctgctgtaactgcagggtcacaggcatcccgggagaatgggcctccaccctcagccagccctcactgctgacaggcacccctctgtcacctcctgccacctgtcagatacccagcctgcccgccatcagccacccgagtggttccgacctccattcacctcaagccccaacaggcccctgtcattccacttcatggaagagacggagccttctgaaatgagatctaccctgaaaatctcttctccttcccctttctgagaaacgtcatccccaccagttaacgtttcctgtacaccctcaccctctctcgtccatctctgttgcctctgcacatcagcacacactgactccacctgggctggctcctgccgcctcttccctacctcctccactagccgcaggaagggcctccagcacccacaactgcccttcctcttgatgcccctcggcttccccccagcctggcagcagcgtcccagcgcctccacattgcccctctcacctcccagctctccacgccacttggctctgcagcgacccctcctagacgctccctggcccctcggcacccagaatgccacattcttgtgtttttttcctccttctttcccaatccctctcaaccatgtatttatttatatatgtatgtatttttttatttattatttatttattgaaacccctactttgattgacaaaggaatcaaggtagatctgaccagtattcccctctcttctccttgtcccaccacatggacatgccttacactggcgtcctctcctgagtccctccgcactctccatcagcaacctcacacctgccttcagacccggctgcaacttcctaagctgcccctgccccagctcctctctgcaacccagccctctcctgagctctaggctgggattacacccgctggagggacactcaccccatctgctcccacggcagcaccatcaactcaacaagtcagaagccaagtggatcatctgtgtccccttcccccacaatccctcctttttctagtaaaagacccgtgatcccgtcagccacccagtctgagatgctgacgttatcttcgactattcttccctgtcctgccttgctaattcttcccactagcactaatctcgactctttgtcacttggactatttcagcaacagtctcatctcccagattacctctgtgcacactgacacgtggtcccgtccatcctgaacatgcacagtgattttcctctcccgttgcacacaaacctttaaaagttccccggcccgtgaacaaatgtacaattctctattctgacattacagaccaccggataaggccccattcttcctttacaccctcccctggtcagcctaggagagttgtttttcctggaaagggtgcctgcgttttactgtctctgtgcctttggtcttgctatccccatcccctggaatgctcccttttcttcccttcaaagcccatgcggaaaccacgtccttcatgaagccctccctgatgtaccaaccactgggatctctccctctgctgaaccaccgtagcactttatttgtacctttctcatggcacttaccatattctgccttgtattatagttatttgtgcacttgtcctttgactgttcttagactgtaagcttgccaagggcagggactgtgttttattcatctgtatccatcacagcactaggcgtggtgcatagcacacagcagttgctcaataaatgtttgttggattaaatccttaa

SEQ ID NO: 186570 - DNA, 1089 bp, Homo sapiens
  Payload ID: 16735
  Gene Symbol: ST8SIA2
  Gene Name: ST8 alpha-N-acetyl-neuraminide alpha-2,8-sialyltransferase 2
  ENST ID: ENST00000539113
  CDS Start-End: 25-1089
ggtcccggcgggcgcgaacccaccatgcagctgcagttccggagctggatgctggccgcgctcacgctgctcgtggtcttcctcatcttcgcagacatctcagagatcgaagaagaaatcggagctgaagttgtaataaacggctcctcatcaccagctgttgttgacagaagtaatgaaagcatcaagcacaacatccagccagcctcgtccaaatggagacataaccagacgctctctctgaggatcaggaagcagattttaaagttcttggatgctgaaaaggacatttctgtcctaaagggaaccctgaagcctggagatattattcattacatcttcgatcgagacagcaccatgaatgtgtcccagaacctctacgagctcctccccaggacttcgccactgaagaataagcactttgggacttgtgccatcgtgggcaactcgggggtcttgctgaacagcggctgtgggcaggagattgacgcccacagcttcgtcatcaggtgcaacctggccccagtacaggagtatgcccgggatgtggggctcaagacagacctggtaaccatgaacccctcggtcatccagcgggcctttgaggacttggtcaatgccacgtggcgggagaagctgctgcaacggctgcacagcctcaatggcagcatcctgtggatccctgccttcatggcccggggcggcaaggagcgtgttgagtgggtcaacgagcttatcctgaagcaccacgtcaacgtgcgcactgcatacccctcgctgcgcctgctgcacgccgttcgcggatactggctgaccaacaaagtccacatcaaaagacccaccaccggcctcttgatgtataccctggccacacgtttctgcaaacaaatctacctctacggcttctggccctttccgctggatcagaaccagaacccagtcaagtaccactattatgacagcctcaagtatggctacacctcccaggccagcccgcataccatgcccttggagtttaaggccctcaagagcctacatgagcagggggctttgaaactgactgtcggccagtgcgatggggccacgtag

SEQ ID NO: 186571 - DNA, 998 bp, Homo sapiens
  Payload ID: 16735
  Gene Symbol: ST8SIA2
  Gene Name: ST8 alpha-N-acetyl-neuraminide alpha-2,8-sialyltransferase 2
  ENST ID: ENST00000555434
  CDS Start-End: 1-998
atgcagctgcagttccggagctggatgctggccgcgctcacgctgctcgtggtcttcctcatcttcgcagacatctcagagatcgaagaagaaatcgggaattcgggaggcagaggtacaatcagatcagctgtgaacagcttacatagcaaatctaataggaagcagattttaaagttcttggatgctgaaaaggacatttctgtcctaaagggaaccctgaagcctggagatattattcattacatcttcgatcgagacagcaccatgaatgtgtcccagaacctctacgagctcctccccaggacttcgccactgaagaataagcactttgggacttgtgccatcgtgggcaactcgggggtcttgctgaacagcggctgtgggcaggagattgacgcccacagcttcgtcatcaggtgcaacctggccccagtacaggagtatgcccgggatgtggggctcaagacagacctggtaaccatgaacccctcggtcatccagcgggcctttgaggacttggtcaatgccacgtggcgggagaagctgctgcaacggctgcacagcctcaatggcagcatcctgtggatccctgccttcatggcccggggcggcaaggagcgtgttgagtgggtcaacgagcttatcctgaagcaccacgtcaacgtgcgcactgcatacccctcgctgcgcctgctgcacgccgttcgcggatactggctgaccaacaaagtccacatcaaaagacccaccaccggcctcttgatgtataccctggccacacgtttctgcaaacaaatctacctctacggcttctggccctttccgctggatcagaaccagaacccagtcaagtaccactattatgacagcctcaagtatggctacacctcccaggccagcccgcataccatgcccttggagtttaaggccctcaagagcctacatgagcagggggctttgaaactgactgtcggccagtgcgatggggccacgta

SEQ ID NO: 186572 - DNA, 11833 bp, Homo sapiens
  Payload ID: 16736
  Gene Symbol: ST8SIA3
  Gene Name: ST8 alpha-N-acetyl-neuraminide alpha-2,8-sialyltransferase 3
  Uniprot ID: O43173
  ENST ID: ENST00000324000
  CDS Start-End: 2035-3177
agatcttactccctttggcattttacaccttactcatacaatcatttttaaaaaatagcaatttaaaaaaatacagttcaagtgttcatcatatccaggcatgcaagccttttctaaatttttttaaataataaaaaagccccacagaggaaaggaggttatttgtgtcctcctgacacacacttttagattttggttaaaaagtctctagtgggtgcaaagtgaccccctttgtcactggaaacaaataggagcattctttgtgccactgtccacaaccacacagatatgtttcccaagggagctcatcaggtcttcaaacatttagcaagcatgacatgtgtaagagacagtattggagaagtaagacaagccttgctctgccgaagcttacaatccaggagctcaccccttcaaggaatttacagcctccagacagataataacattaggtccatgaaagcctacaaggcaagaagttcaggagagaaagaagtcataaccatcttggaagaatctcaacttgttttatcagaactcaaacgccaatttctcacccctagcttccctcattagtgcttattaactagtattgggaggaccaagcgaagagtaaagctagggtagcagaggccataagctaattgcaaaggacagagctaaagaaacatgctagtttcccctgagcacccaactgcatgactgaaaatggattaatttgtatttctaatggatatacaagaaacacgtgaatatgctaaaataaatttaaggtcaagcaatgcaaagtgttagtgcgtttgccttccactctcagaggcagcctctattatttggttcttgggctgcttcataaaaagttctgtgttttttaatggcctcagcttttgggaggctcaggccacctagcccatcaggagaccaggcccgaaggatggatctgaagagtgggcaacggagagttaaaccagggctgacttcaacaggcccagtcaagtcaggggcaagcacattgtccatccactggaagacggaaaggggagaggaaggcaggccctcccgactcacaggtcacctcgcaactttgctaggcactacccaccctttagggataagtgaagtatgtggtgggcatacaaggcgcacaggggagtcattctggcaaattccaagaaggttttaagggctcccgaggcaggcaggcccagttgctgtttggagcttcctttggggtgggaggatggcgggggcagggggccggggcggtgccttaacgaggggagatgcttttaaatagctgccttccaaaaaccatcctccctgcttctttgagaagcacccagctgttgtttaccctccaggacagcaaatccggttatttgtctctctattccgtgatattataaagtaatgaatggtccattaaactaagtttgggatcccgtctccccacagccacctcctcgccggcaccctcagccggggaggccgtaggctcgggctgcagcctggcagcctcagtccccctccctccaccatttccctctactccctccctctcctgcaccccctccccccggttatttgggagattagagttcattaattaaatcctgtgcttagatcgaactgtaacattattccaatcacatttatcttgcaggcggcggaggagatggcagcctcgctggaaacgcgcgggggagcctgagccggcggccggggacgcacggcgctgcgcgctccttcgccacgccgccgcgcagcccctccatcttcctgctcggcaccgggccccgcgcgcccctgcctacggggtcccgctgctctccggggctcctgccagccccaacccccggccccggtggcctccccccacccccgcccgggtccccctcctccgccacacgcgcgcgcgctcacacacacacacacacacacacacacacacacacacatatatacacgccagcgagctgctggccgctcaatggaccgatttccccggtttccctgaacccagcccagcccgggatgagaaactgcaaaatggcccgggtcgccagtgtgctggggctggtcatgctcagcgtcgccctgctgattttatcgctcatcagctacgtgtccctgaaaaaggagaacatcttcaccactcccaagtacgccagcccgggggcgccccgaatgtacatgttccacgcgggattccggtcacaatttgcgctgaagtttctagacccgtcattcgtgcccattacgaattctctcacccaggaactccaagagaaaccttctaagtggaaatttaatcggacagcgtttttacatcaaaggcaagaaattcttcagcatgtcgatgtaataaaaaatttttctttgaccaagaatagtgttcggattggacaactgatgcactatgattattccagccataaatatgttttctctattagcaataacttccggtcacttcttccagatgtgtcacccattatgaacaagcattataatatttgtgctgtggttggaaatagtgggatcctgacagggagccagtgtggacaagaaatagataaatcagattttgttttccgttgcaatttcgcccctacggaggctttccaaagagatgttggaagaaaaaccaatcttaccaccttcaaccccagcatcctggaaaaatattacaacaatctcttgactattcaggaccgtaacaactttttcctcagtttaaaaaagcttgacggggccattctttggatccctgcatttttcttccacacttcagcaactgtgaccaggacattagttgacttttttgttgaacacagaggtcagttaaaagtccaactggcttggccgggaaatataatgcaacatgtcaacaggtactggaaaaacaaacatttgtcacctaaacggctgagcacaggtattcttatgtacacccttgcatcagcaatatgtgaagagatccacttgtatggattttggccgtttggatttgaccccaacacaagggaagatcttccataccattactatgacaaaaaaggaaccaaatttaccaccaagtggcaggagtcccaccagctgcctgctgagtttcagctgctgtaccgaatgcatggggaagggctcaccaagctgactctgtcacactgtgcctaagaactccaaacggaaagcgccaaatggctgtttaaaaagtgccccaaatcaaattgaatagccttcagaatagaaccctagagaatgtcttataaggattgtctgccatttaaaaggaaagatgtcttttctcttttgcactgctcttttaagagttttagcagatttagcaggacagatgcattgaagccacatggtttagacttgattgataaagggaatgttgcatttgggactatgctgctaacgaaatggtttgaagtattttcatgtttggattttaataataaactgcctctcatttttatgaggactagagctatagtttctgcagctctgctcagatagtcctcataatcagaggcctctggccaactggggcaggacctgttttgctggtgggatcagactctgaaaaatggaaacgtaaaaaactggtttgcatatctcatcttctatctatctccctatctccatctctatcaccatctcactccttccctctgcaactactccctgccctaccaccgtggagtttaataatttgctaggaatcctattgaattcgctttgcttgtatatgttgcatttgtacttgatgtgtttaaggttctgggtaactttgatgcttcatgacaaaataggcaaatcacgatggactcccttgtgattccttttttaaagaaatgcctctgatgcagtcctcaccagtccattcagtcattctacagcaagatggtccctctgtggtgagtgggatataaggcagtgcatctttcatgatcacaaagaaagcctatgttgtggatagcattgcgtctcttgatgtaggcattgttatggcaaataatagcactgtggccacatctgtaaggccattccagcctaaatttagtgtctcccataatcccaacccatgcactaggctgggtgttctctcagaatatagaggcaatgaatcagcttaagaccctgggacacacaaaggaaaaggaagaagaatatttagaagttgttatggaatcctgtgtaccctaaagtgtggtaaccatgttacccattccagctgggttaaagtggaggaggatcttggccaggccaggtgcccaggtgactagtgctgaggtgcgatcgttttccgtatcattgtgtgcaccaccaccaatccagaaccatttgctctctttgagaacattgtagcactggatattccctctttccactgaagtcagatctatacaactacaaattaagcatttcaaaagaaaaagccattgtgcagtggcaagagttggaatccaagattatgtagacctgcgatgaaggaagtagctggccattctcattttctttatttcagccatatgagtagaaatcaaatcattcccatccctggctttttactgagcagcactttgttcttccaattcagcccaacgtctggccaagttgatgttaaattttaataagagtttctttcttctttccaaatgccagtcaagcatatttgttatgcatttgagtggggtagctcattcttttcctgaaatctcatctagattgcttgcaatgcgacaaataactgtttaaaaaatgtgctgtagttcagtgatgagctcattgcccctctttaggaaggtaagatcatgcctaaaattaaaccgaatatggtaaggaaagacactatcgttatgctcacgttctgcctggtcctaaacctgccttattattattttcagaaagcaatctaattagagcaacttgcatagatctagatattaactaatgaaagaaacaccaagttcaaatgtgttaccaattatgacacacattacaatataattataaggggagacattaaaaacattttgtaattcagtggtataatttgatgggtatcacaaccacaccgtgtttgttccctgtccctttgaagaggactgtactaccatcctcacactgtgctctgttgggatcactgagagattgacaactgacagaagtgtttagttggctgttcctgagcacttagttcatttggttatagctaagtgatattaatgccaatattacttgggccagattctgactctggagttttaatcccaatgtgcccattcattttcactaaatataaatgcatagacactttaaaccaagaagattaaaagaggaaaagaccagaatctctaaaaaacagtttactgttctgtagtggacaatttaaattttatctcatcataatgccaaggatttttgtttgttttttaagttcagggagattttttaaatctccttgcagtcttggctccatcttaaccttagagtgggaggactttcccatcccccaccaccgtgttatctatcactttaatgaaaactcaaaatagtgaggaaatggacttttcttcagaacttgaggggtttagagatcaggctcatctctgcttataaggaggacttcctggagatgatcccaatagatcacccttcacttttgaagaatagcagcttctagctgaccatgcaaaatctctgtttgtttttaaagactgtttcaaagattaaatctatacaaccacttttatgaccaaaaaagttgttgtgtcccaagtgtcctaattagaaaggcagctggctctcctgcagctcccaggcttgtgtagtcaagtgcagtgaactgggcagtaatcagctcaggaccattggctctttcctcctctttcagctacagacacatgccctggcttttgcattgaccttgctttgttagttctagactaatttatccttttgtcagacactttcccttttttaggatactcacaacagagtccactttcagctattggaatacattttaccataaagcccccaaggctttctacccataacaccaacacaaaaaaccaattaagttgcagaggggggaaataatcacaaacttttggcaacctgcttaatgctagacgctctgttttcactggttattctgagtgtcatatgcagatgcagatccaagggagacagggctaaatggtggtgtcaagaattcctcccacaccccaaaaattctttccaatatttgattattaaaatatctatcatttctccaccttgtgtctgtgtcttaagtgtctgtgaatattgtaaaagtgctgtatgtttagtagtgttgtgtgcctggcagtgctgactatgactactgtgccatctgtctgtgaccttgatgtcaggtacctggccatggggctaccagcaaggatgtgcaaaggaagaaccgctgcccctgccctcagcttccttatgcccgagccactacttatccgtgaatgtgagtgccaagagaaacctaatttggtggggaagccaaggaatgggagaacgttttttctgatttgagtcaaggcactaattattagacactctcagacaacaaagcggtattgacctgagatcaaaggaagcagggacaatattgtagaatgctaggacactggaaatgaagaggccttcagcttcgccagtcttgattcttgactttacaaatgagaaaatggagaaacagggaggctaggtgatttgccccagatgacactgtcaattagtggagaaattatgattcctcctctagtacttcttggtcttaccagcatcaaatgaagctgggctcacagggaaagtggtttttggtctgggatctgcagagcacataaaataagttagaaagtctataaaagaggaaaaaaggttctcctctccctcccaaaaatgacttcccaacacagaacaataaaggagatgcttgtgtgggtatgcaactgtccaccaattatcacctaccttctccctgagatgaaacaaaacacgcttggtaaatcatgatttgataaataacaattaagttactggtggttcatgcttgacagctgcaatcttacccaataagctattcatcttagtaaaaccttgttttagtaatatacatgcataatttagaagttgaaggctgaaaattgttgtgttcttctccatatatatacaactttcatcggggtcccttgagttaagaaatgccttctattttataggtaatctcaacagcagactttgaaatattgtgtttggttcaatatgctaagaagatatacaaataataataacttcgtgagtcttcatgtgcaaaatgacaaactgagcaattttctgtataattctagattcttaaaaccttttttcccataattgtttgaatgcactaggcacaagtttctgtttaagcctctgcttctccctgaatgtgtagaactgtcactttgcttacaaaggggctgtgtgtttgtggctggcagcccagatagagcactctgggtgctggggattgagggcaccttggccagctgattgacctgtctggactctgtggcccaattaatcgaggccacagatcagttggtactaagcatcaaaatgattcattatgcctctctcacactccgattgctttgccacatagataacagcatttgaaatgggaaacactttagaatgtcattattgtattatatattgtcatcttatgcagtatttctgaaaatttatttttattgtgatgactgattgaagacatatgtgtatgaatagatgttcctcagtgaagcctattctcttgttgttgatgacagtggcatcagagtgaagagttgttgcagagtaactgacttcagtttaaggttaccctggggttctggggttaggacccggattatgcagctgatctcccagcaaacacagctgtatgaaataagcaactcttcaaaatacaattcttgccactcattctggacctttgattcataatgtcctgggataagtccaacttacaaagattcccaggtgattcgtgtgaccaccatttggaaaccagtaatatatacatccggagtcatatataccattttgaacaaagtagctaaatgcttatctctccttgtgcgattagtttcacatgttcgttgaggttatcatgttaaatggcaatatagacacagtcttagtgattcaacaattcagctgtttcagccgaattgaccagttgctaatttataagcaaattgtaactgatcaatttagtcagaatggatgcaagcccaaagacaaggtggagagcaagctttaatatacactttgtctcaaggccagctcttcatatttccctctttatatttcaaactaagaggcagatctcaggtcactcatctttagaattggtgagaatgagaaacagggaactgaagtgattcattcagattcaatttggaagtcattcccagagcctaaaatatttatctaaggggtctgatttatcaacctcaggtagtctccaaaacacaaaggtattcaggctaaaataaaaccaatcaaaaaaggaaattcaggaggctccagttctaagactaacccagtataacaagggtgatcagttattacttgtggccttgtaccacctctgttggataatgtgccaccgtcctaatgaagctttggccagacttctttctatagctgtgcacatagaaaggctttagacaacagtgataccaaagggttcctttgattttccttctgtgtgattctcagacagttttagctctttggtgtgctgccaaatgtttaacaactggctctggaaaacagtggaacccagatttttagcacctaccaatttctatggtgtaaatactctcatctcagccaatttcaggctactaacttaatgtcaaccagctgaaaacacaacaatatgttttcaagagccagtataagttggctccaatacagcatgagccagctccagcatagcactgcctgaacaatttttaagtcagtgagtaccaaataggagaggctagcagaggctttggagggacttttaaatgtcccctccaccaagggaagcatttccatgttggttagttttactgatttttagtaaaagagcatattattggatcccaaggtgttcaaatattccacgtgactcttaggaacctctcaacagactccccagtatcttgggagattaccaactgtggcttttctaatttctaagggtgaccctccaggaaaacattctttaatttaactaccagttaaaaccatgtttggctgatcttttttaaaaaatctatacctatagttcatcacttgtttccccaactttgtcattttccctatccacttgcccctcatccttctgacacaataaaaaaaatacaggtacccacaaaacagtgcctgcaaaggagcaggggaagaacaaggcacccagtaagctcacttggctctacatatctggaaaggcactgaggttccaaggtctctaccccaccaggggacacccagtaaacatcacgctgagagtttaagttgcactcaactggagttgatttgcccttagaaaagtttccaacggtgaagaaataccacttggtaggaatatctctgggcaacttcattgctgactgggcaaactttgtaggataaggtgtcatgtgatgtaaggctggaccatgaaaaacaaaaatctactaatacacatttggcccctgcagtcccctggcattgagcaatagagcaactgtcctttctcaccactagttgtgagtgtacttccaactgagtgtttagaaatcaggtaatctggtaatccacagaacaagctttgtttgcaaattgcaaatttttctggtagaagtcattcttaggtgggcttcattaaatctttggagaggcaatgctgggaaaaaatatgcctaattcctaggacacagtgagtggccgtaagttgttatctgcatgtactaaatcaaaattagatcatgaaggaccaaatctacttccgttgctataataaaataccctacaggttctgtaaggcatttctaaactgtaaatgcttgaaacgcaagttggacattttctatactatgtgtaaaatgccaggttatacctctattttctttcttcctaatggtcattgaaatgagcttgtttctctacattgagcaagctacattttattttaaatgagtcaggtgcatgttcagatgtctgtattcccaatacattgcatgcagcctgagcacaagtatgccttcaccctctggctcttttcctgacaccaaacagagaagtccacagctacaagcacaaggggcttgacaggtaggccttgttttattatgaacaaattcaccagaaaaccattcttgaggaaccagccactcccatagcatttttagtcttagggaagaaaattggcagggaagaaaaattggcagacaatgggaaagaggtttggtcaacctgcataagtggaataaagtcattgaagtacttgcaaaaagaagagggaggtttccctctgaaggaatctagaccattttttaatatggagaataactgtaccccatgttagaagtgctctttagccatatttcaagatccagatctgaacccatactgtgcagaaaagcacaagagcgcttacagccaagagccctgggaggagttgagtaacaggctgagatccggtcaccaagcatcattagttagcactgaaattctcccaggacacaaaacaaatgtatggaaacatcgcaatacactatcatttactcacatgggacaaccacctaagtccatagcaaaactttacagatctagatgttatctcaagtcaggattccagatcaacatcctccatgtggagatgagacaactgaggttcagaaagttggagtgacttatttgcccagctagctaactggaattagagtctgggtctcccaaccactgattctgctacaccacactgtgctgcttccattagttagatggacattgacaattaattgtgaaagcattaattagaagtcaagacaaaagaatgtttgtgatatcttctctcgcttaacatactttgatttcaccattgcatttcagcattttaaagaatagtgtatcagtatagaaggaggagcaaagctctttaagagtaatgatgaaaccaaaaggtcaaaaagtagaagaatagcgaatgtaagttattaaataaatgagcaagaagtatgtgtcagggaaaataaatgcttcttatattgttaataccgtgattccctgcccgctcaccccgtcactcaacacttgatgcatttgttttggaaagtgccattttatgctgagatactggtattgaaaacttccctctttcccaactctgtcagaagttctcttgctctttggaagaagccgagggccttaacaaatcagactgacctcccttgtgacaggcagcctcgcctgcccttggaaacaagctgccagaatgtgagggccacagagacccaagagaagccagcactgctagactgaggaacttgtaaatatcttctgctttcttggtgaacaaggacagaggcaattgcgtgtatattgtgactgtagtttgtgaagaaaatgcaaccatttgcttcgacagctcctcaaatgtacttgttaagtgtgaatgtgcctgcctcattgccttgtgttccaaacacagtactgaatgcgttgtttttaaataaaccatttcgttttgctttgggaaaca

SEQ ID NO: 186573 - DNA, 554 bp, Homo sapiens
  Payload ID: 16736
  Gene Symbol: ST8SIA3
  Gene Name: ST8 alpha-N-acetyl-neuraminide alpha-2,8-sialyltransferase 3
  ENST ID: ENST00000586360
  CDS Start-End: 1-377
ataaatcagattttgttttccgttgcaatttcgcccctacggaggctttccaaagagatgttggaagaaaaaccaatcttaccaccttcaaccccagcatcctggaaaaatattacaacaatctcttgactattcaggaccgtaacaactttttcctcagtttaaaaaagcttgacggggccattctttggatccctgcatttttcttccacacttcagcaactgtgaccaggacattagttgacttttttgttgaacacagaggtcagttaaaagtccaactggcttggccgggaaatataatgcaacatgtcaacaggttctttgcaactttacattgctgtaaacagtgctctgatgaacatctttggaattaaatgtttgattatttccttagataaatcccttgaagtggattttcaagagaaaacttaccaacaagttaggagaaaaacatgcatcatcattaaggaagacttcctcaacagaaggattatgcattattgtgtactaaataaggaaaataaataagctattgttgtgtgcttcttcaa

SEQ ID NO: 186574 - DNA, 6303 bp, Homo sapiens
  Payload ID: 16737
  Gene Symbol: ST8SIA4
  Gene Name: ST8 alpha-N-acetyl-neuraminide alpha-2,8-sialyltransferase 4
  Uniprot ID: Q92187
  ENST ID: ENST00000231461
  CDS Start-End: 312-1391
gctgcagaagctgccgccacctccaatgcacaaggtgtctcatctgaaaagaaacctgagccccagggaggcggcgcggagcgaccctggcagagctggcgcaaacagggcgagaggtcgctgggcagcgttcgaggaccagagggagctcggccacagaagaccccagtgatctgatcccgggatcccggctccaagctctcctcgcattttacagatttcacccccgcgactatctccccaaaacggagcctttatatcaagagaaggtgcgggagctggggcaaccaggactttctcgggcacccaagatgcgctccattaggaagaggtggacgatctgcacaataagtctgctcctgatcttttataagacaaaagaaatagcaagaactgaggagcaccaggagacgcaactcatcggagatggtgaattgtctttgagtcggtcacttgtcaatagctctgataaaatcattcgaaaggctggctcttcaatcttccagcacaatgtagaaggttggaaaatcaattcctctttggtcctagagataaggaagaacatacttcgtttcttagatgcagaacgagatgtgtcagtggtcaagagcagttttaagcctggtgatgtcatacactatgtgcttgacaggcgccggacactaaacatttctcatgatctacatagcctcctacctgaagtttcaccaatgaagaatcgcaggtttaagacctgtgcagttgttggaaattctggcattctgttagacagtgaatgtggaaaggagattgacagtcacaattttgtaataaggtgtaatctagctcctgtggtggagtttgctgcagatgtgggaactaaatcagattttattaccatgaatccatcagttgtacaaagagcatttggaggctttcgaaatgagagtgacagagaaaaatttgtgcatagactttccatgctgaatgacagtgtcctttggattcctgctttcatggtcaaaggaggagagaagcacgtggagtgggttaatgcattaatccttaagaataaactgaaagtgcgaactgcctatccgtcattgagacttattcatgctgtcagaggttactggctgaccaacaaagttcctatcaaaagacccagcacaggtcttctcatgtatacacttgccacaagattctgtgatgaaattcacctgtatggattctggcccttccctaaggatttaaatggaaaagcggtcaaatatcattattatgatgacttaaaatataggtacttttccaatgcaagccctcacagaatgccattagaattcaaaacattaaatgtgctacataatagaggagctctaaaactgacaacaggaaagtgtgtaaagcaataaagcacattttgaaacaaacaatatgcacttcttttctgaagatgcttccgaagatttgaaaataggatccaaaacacggctgggtttcagcatccaccaatgaactgaaaggtgaataaaggacgttcatgagaaatcgactaccagctgatgaaatacctgcaaagtgctctaaaaattaaatattttgactttaagggtcctagtaagtgccacttccactaagaatacagtttgaatgtataatcagtagtgtttacaagatccaacagtgcactcatcattagttaacaaagcaaatatgttcatcactgtcaggctgcccacagcaacaccaagcatattagaagaggaaccccaggaacgcaactcagaccttgggaaattaaaccatccttgtcagcagaagccaagatggaagcagtttgagcaatgaaatccgtaagattaaacaactcaagtaaatgcttcagtcaggactctgagtctgatcatgaattttatgttttaatttatgttttttttttgtcttctggaatctcttttggtttggatattgggatgcttagaaatcctttctgagatgcatatgagtgaggaaataaactttaagtaattatttttaaagttcttatactttttaaaagctatcacacaaagacttttttttttttttttgtctcgctctgttgcccaggctggagtacagtggcgcgatctcagctcactgcaagctccgcctcccaagttcactccattctcctgcctcagcctccggagtagctgggactgcaggcgcctgccaccacgcctggctaattttttgtatttttagtggagacggattttcaccgtgttagccaggatggtctcaatctcctgacctcgtgatccacccgccttggcctcccaaagtgctgggattacaggcgtgagccaccgtgcctggccgacatttttaaaaaagttttattttgcacggctctaaacctccatgttattttccagtggtgtagaaggtaccagctaaagtgaaccactatgtaatattaggccattctaaaggaaagatgttccatgtcatcagagatggtaaaataggccgggaaaaaaaaatctttggtaccaaagattacacttgtgtttctacacagcaaaccatttttctttcatgaaaataatatattattaacatgaatatattattttgctattaatgtgaaagttgtctctaaatattttttaattttcaaactcatactttattttcatttgaaatgtttttcacaccttttgcattacataataattttgtggaagcattttgccctttagaataaatattagattgatatagctgaaatgtgacttccagttctttgatattccccttgttattcaaatagaaatatggaaatgctttatatattactgttaaatttcttagtgcagaaataacattattaatagagtattgttttcaaaacagagatgattaatttcaagaggtttaacagtgaaattgtgtcaatattttgcatttaaaatgaatttaattgaccgatattttctgtagttaaatttagtcacaatatcacatatgttcttcaagaaacacatgaaattattaataaagtaattaaaaaatttttaatgtataacagaattgaccaataggccagttttctggtaacttatgatagtagattgtttctttagaaactgggcagaagctctgcattctcacttgtactttgatttcttatttcttgggcaggcaatttgaggaaagaagaaatggcatggggaatatatatgttttgtttcttagggaaaacagtctgagaaatgaataaaaagcatgaagtacgtgtgtgtgtgtgtgtgttaccatggaaaaggatattcacagtagtacagttctcaatatttttaattagatgtcatatttttttaatatagtaaaaccttgggatatagaatattacatcttttgagaatgtatgtgtctctaagtaagtaaaatctaatgcgtataggagactgatagctaaaaatgaatggaacattaatgtacttttataattaaacctcttatctatcagaaattgtaagagaatagatacatgttttgaatgtaaagttgaaaagtctggtttacttaataaattgaaagtgatttataaaatctaaatttggactacttgcaaatgataagctattctagtagcctttagtttaaatccaacagaaatctagaagtcacaagcaaatatcttaaaggtaaaatccatctgggcactcatttaaagtatatcttaaaaaagcagcagcaaggtaccttgccatttttagcatattttcttcctttttcttttttcttttttttttttttttgagatggagtctcactctgtcacacaggctggaatgcagtgatgccatctcagctcactgcaacctccacctcctgggttcaagtgattctcgtgcctcagcctcccaagtagctggggttacaggcgcccaccaccacactcggctaattttgtgtttttagtagagacaaagtttcaccatgttggccaggctggtcttgaacttcctgacctcaggttatccacccacctcagcctcccaaagtgctgggattacaggtgtgagccaccgcagccggaccatttttagtatattttcagtaaatacatttaaacaatgttaaggccacagcacacatatctcagccattcattgttctgtgcattgatgtttatctcatagatgcattgagtagtgcctttttagctttttcacattactttgtcaccatatcctttgtgttctctaaatacattgcccacttccaaaaatgttcagcatgaaaaaaagggcttcagtgtcgattgagattgcttttgttcatctcagggatttcaatagtcaagaatgaattcagttaaaggtatttagggttcaaagaagacaaactgtacaagcccatttcattccttgttgtatacctttccatctgccctcccattttaactatctactgtggcctttttatggaaacagagcaagatcaatgaaggctaatggcaagaataagaaaaagagttgagatttaaccaatagcggagcataaaggatcatgacaaaatcaaattataaaagcatacttgaaataggtggagctttttcttttgaaaatatatattcacaattttaatattttaatttattttttactatttaaccctgtacttggcaatgctcaggcagctgattgtgaaatattcttgtcctttacagaacatggttgttattgtgctgttgacatgaatagaccatggaaacattttcatcattattattcagcctgtgctgtagttaatgttaagttgctgaaataaaaagtgagcaagtaatagattttcttggcaaatctaatgattcagcccacaggactgttgaaactactgcggaagtttttctatctgaaagaaggtgctgggcattcaaatgtgttcatgtattgtatatcatatgaattgtatatcaattactaatgggaatttctacatatatgcttacaaaagcaatttatttaagtaatgctaggggtagtgtacataccaattagttattcagctactatacagaaaaaggatgaacaaattaatttatttctaattgagccagttagacataatgcatataacgtgatatttggttcatgaaagagttgttttcatgtggttattgtagggagtatatataattgtggaaggggtatgggaagagttgtgtatagttagttgttatctctacaagtttgaaagttttcccatcaaacattatcaatataccaatgttttaaaaattgagtgagggttattatttgtatttgatgaaagaaaatccaaataaagcccacctagaaatagatattttattatatatgtgctatagatatacctatatagtacaaatagacatgtgtgatgcatatatacaatgttatatatgtgtatatgtctgtatacacactgagtctgtaatatgtatacactaaatttgtgttatgctaacatcttcagggtctgcactgtgaactcccctggagataagtaagtccactttagaataaagaagttcttttgagacttcagttactaacgtgctttaagaggtatctactttataactgaattctatgtcgttcatacgtagagttacagtaagggtctagtatgtccaaatcttaataataaagaagaaaagtaaaggcttcaagctagcaatgtattcgaattacagttttcagattgtggctccaggccttgtgtttctcatttaagtagcaccttttaataaaaaccgtttctttgtgtaggcaaaagcacaagtgtttcaaatgtaaatagcaggaaaaaaaaagagtttacagagatagcattgctgcacagaataattgctactgagtatttcttatagaatttgtggaactgaaagatgaggtttattctgtcaagttcaagttcattctgttcaacactgttttcttattgtttgtgtatagcaaccgggtattattgttttatcatttgtaaaattgtaaaataaattaatccctttttttcactgtttctcttatctcatatatccaagcccttggttatactttgtatgtcaatgttaggtgatcatttttaacaagctttggcttgtgctttgcttttccactccccttagccctagtggttggcaattaggcaaaccatttatttttaagtgtatacatgggaatatgaacaatgtcaaaaaccccatgaatattaggaaatccttaacgatattttgtgtagcacattctgtttgcggttgagggaataaagtatttcacaagtga

SEQ ID NO: 186575 - DNA, 655 bp, Homo sapiens
  Payload ID: 16737
  Gene Symbol: ST8SIA4
  Gene Name: ST8 alpha-N-acetyl-neuraminide alpha-2,8-sialyltransferase 4
  ENST ID: ENST00000523381
  CDS Start-End: 270-410
tctgaaaagaaacctgagccccagggaggcggcgcggagcgaccctggcagagctggcgcaaacagggcgagaggtcgctgggcagcgttcgaggaccagagggagctcggccacagaagaccccagtgatctgatcccgggatcccggctccaagctctcctcgcattttacagatttcacccccgcgactatctccccaaaacggagcctttatatcaagagaaggtgcgggagctggggcaaccaggactttctcgggcacccaagatgcgctccattaggaagaggtggacgatctgcacaataagtctgctcctgatcttttataagacaaaagaaatagcaagaactgaggagcaccaggagacgcaactcatcggcgcttctggtggaggagttgactcataaaaccatcaaatcatctcattgactgtctttctacccaagccacgtggagaggccagttttgagttttgagtaaactggaatggaggttcggctccagatcccggtccagtattcaagtgagagatggtgaattgtctttgagtcggtcacttgtcaatagctctgataaaatcattcgaaaggctggctcttcaatcttccagcacaatgtagaaggttggaaaatcaattcctctttggtccta

SEQ ID NO: 186576 - DNA, 1794 bp, Homo sapiens
  Payload ID: 16737
  Gene Symbol: ST8SIA4
  Gene Name: ST8 alpha-N-acetyl-neuraminide alpha-2,8-sialyltransferase 4
  Uniprot ID: Q92187
  ENST ID: ENST00000451528
  CDS Start-End: 260-766
aacctgagccccagggaggcggcgcggagcgaccctggcagagctggcgcaaacagggcgagaggtcgctgggcagcgttcgaggaccagagggagctcggccacagaagaccccagtgatctgatcccgggatcccggctccaagctctcctcgcattttacagatttcacccccgcgactatctccccaaaacggagcctttatatcaagagaaggtgcgggagctggggcaaccaggactttctcgggcacccaagatgcgctccattaggaagaggtggacgatctgcacaataagtctgctcctgatcttttataagacaaaagaaatagcaagaactgaggagcaccaggagacgcaactcatcggagatggtgaattgtctttgagtcggtcacttgtcaatagctctgataaaatcattcgaaaggctggctcttcaatcttccagcacaatgtagaaggttggaaaatcaattcctctttggtcctagagataaggaagaacatacttcgtttcttagatgcagaacgagatgtgtcagtggtcaagagcagttttaagcctggtgatgtcatacactatgtgcttgacaggcgccggacactaaacatttctcatgatctacatagcctcctacctgaagtttcaccaatgaagaatcgcaggtttaagacctgtgcagttgttggaaattctggcattctgttagacagtgaatgtggaaaggagattgacagtcacaattttgtaataaggtgagctttcttctgctttttgagattgtaagtttttcaaagatattttacttgggggtggaaaactgttagaaaattttaaagtattactaaaacctcaaacaaatatttgtctatgatatccttttctgtgcaacatttaaattacatttaccctggaatagaatattataattattgcgtagttgaaagaaaaagtgatcctgtcatagcaacaagattcacacagctttttttggtgaggtgaggggggaggcaaatggcaattttattaaatttaatattccacacaaacttttttcttagtatctcttcttcatactcattagttttgtgtgattttatttgttgtataaagattatgaatattactatggaatgatgtaatagatttatgttaatgttactttttattaataattatctaggagatagtaagaacatagtttagcaagtttatatttgatatcctgagccatatttctttaatttctctttatatgtggtatttgtgtatgttagtatatttgaattttatgtttttttaacataattaagcgtgcatgtttgtttttcattaacggttaaaagatatttgatgaattgtgtgtttgattaacctattaactgaaaaaaactcaacagtagaaatggaattataatcacatcataaatataagcagtttttaatgatcaatttttatatctgtacagtttttttggattgttttagttccttagaaaaattagctaaatgacagaaacatggatattgaaatatgaaatagtacaatataaagatagatagaaaagtatgctgagttgacatgttgaaaaacacagtctcttgaagatatactggaatacattatttttgaatattttgaatattttttgaatatttttaaataaagtcttaaaagcataaataggtaactacttttaaaaaaaaagtcatgagaaatcacactcaagcattatcaagtgaagaaaattcataatagcaaataaaactgcaaacattttacctta

SEQ ID NO: 186577 - DNA, 2716 bp, Homo sapiens
  Payload ID: 16738
  Gene Symbol: ST8SIA5
  Gene Name: ST8 alpha-N-acetyl-neuraminide alpha-2,8-sialyltransferase 5
  Uniprot ID: O15466
  ENST ID: ENST00000315087
  CDS Start-End: 662-1792
ttttaattccaagattcaaacccggcgttttgcgctccgcccctccccctccccacggcccgcctatcattagccagactgcgcgggtgttttgtacgccccctccccccgtccctatcggcagaaccggaggccaaccttcgcgatcccttgctgcgggcccggagatcaaacgtggcccgcccccggcagggcacagcgcgctgggcaaccgcgatccggcgccggactggaggggtcgatgcgcggcgcgctggggcgcacaggggacggagcccgggtcttgctccccattggccgccacctcggcgggaggggccgcctccggctcgtggcacctggcgtctcccctccgcggggaaatcggcggctacccggcaccggcgcctggaggtaaaggtacccgggggtggggaaggcccctggccgcggcagagctccctgccaccggccctgtcctgcttgccgccccagcgcctgcgacgcttggatgcccccagctccggccgcgccaaccagaaactttgcccctcgaagtcccccgcctgcctgaccgcaccgtgaggcgccaagtcggccgcgcgccccccggggccccggaaccccgcgagtcattgcctggccgccccgtaccccgcgcccgcggcgcccggtagccaggatgcgctacgcggacccctcggccaaccgggatttgttggggagccgaactttgctcttcatcttcatctgcgcctttgccttggtgaccttgctgcaacagatcctgtatggcaggaactacattaagaggtactttgaattttatgaggggccttttgaatataactccacaagatgcctggagctgaggcacgaaatattggaagtgaaggtgctgtccatggtgaagcagtcagagctgttcgacaggtggaagagcctccagatgtgcaaatgggcgatgaacatctctgaggccaaccagttcaagtctactctgtccaggtgctgcaacgcccctgcctttctcttcaccacccagaagaacactcccctggggacaaagctcaagtatgaggtggacaccagtggcatctaccacatcaaccaggagatcttccgcatgtttcccaaggacatgccctactaccggtcccagtttaagaagtgtgctgtagtgggcaacggaggcatcttgaagaacagccgctgcgggagggagatcaacagcgccgacttcgtcttccggtgcaacctgccccccatctcagagaagtacaccatggatgtgggggtgaagacggatgtggtcactgtgaaccccagcatcatcacagagaggttccacaagctggagaagtggcggcggccgttctatcgcgtgctgcaggtgtacgagaacgcgtcggtgctgctgcctgccttctacaacacgcgcaacaccgacgtgtccatccgcgtcaagtacgtgctggacgacttcgaatcgccgcaagctgtctactacttccatccgcagtacctggtcaacgtgtcgcgctactggctcagcctgggggtgcgcgccaagcgcatcagcaccggcctcattctggtcactgcggcgctggagctctgtgaggaggtgcacctctttggcttctgggccttccccatgaacccctcgggcctctacatcactcaccactactatgacaacgtcaagccgcgtcccggcttccacgccatgccctctgagatcttcaacttcctgcacttgcacagccgaggcatcctccgcgtgcacacgggcacctgcagctgctgctgatggctgccagccaggctgcccggcaagcggcgccccctctcctgctgtccctcctggtggaactgggagccccgaaccgggcagcgtggggtcctggcgttcaggctgtctctccctccattgttcagctctgtacttggatcctggggtagggaggcagggttaggaaccggggcagagtcagctctgtgctgagcctcctggcctggcccccaccggtgcatccgcccagtgcgtccacctgccctggctagcatgctgctgggccacaccccaagatcaggggccctggggacggcaagtgaataaagcacatttccacccaattttgtcatccgagagagagcacaaactgcaggcccttgttgcagctgaaggaagaccctacagagaatggaattgagagtggagacaggacacttcacaggacacttgagcacagtcaagattttattcacacttttggttcctgtgttttatatcgaagacttagctatgaattgctatctaaatctcagagcttagaagccaacccagtgactagaccttccagtgaagaaagtgatctcaagaggtccagggacttaacagccaagccacaccacccgacaggttcttctgtgacaccgagagatctaacccaaggcctgggttatgtcttagtcgagacatcatcatctgagaagcaccacatcctttcagacacatcctcggacacacatgcggtcttggtgcccccaggttcaatcctgcgttagctcttttgatgagaaggaaataaaccaaaccagccacttgcactatggcttccaagccaatgttattgactcaataagtgcttagcaattggcttcctcttttgtcttcctattttcagctccatttaaaccaggagttatttataaagacctcttcctctcatgt

SEQ ID NO: 186578 - DNA, 1499 bp, Homo sapiens
  Payload ID: 16738
  Gene Symbol: ST8SIA5
  Gene Name: ST8 alpha-N-acetyl-neuraminide alpha-2,8-sialyltransferase 5
  ENST ID: ENST00000536490
  CDS Start-End: 303-1340
gaaatcggcggctacccggcaccggcgcctggaggtaaaggtacccgggggtggggaaggcccctggccgcggcagagctccctgccaccggccctgtcctgcttgccgccccagcgcctgcgacgcttggatgcccccagctccggccgcgccaaccagaaactttgcccctcgaagtcccccgcctgcctgaccgcaccgtgaggcgccaagtcggccgcgcgccccccggggccccggaaccccgcgagtcattgcctggccgccccgtaccccgcgcccgcggcgcccggtagccaggatgcgctacgcggacccctcggccaaccgggatttgttggggagccgaactttgctcttcatcttcatctgcgcctttgccttggtgaccttgctgcaacagatcctgtatggcaggaactacattaagagggtgaagcagtcagagctgttcgacaggtggaagagcctccagatgtgcaaatgggcgatgaacatctctgaggccaaccagttcaagtctactctgtccaggtgctgcaacgcccctgcctttctcttcaccacccagaagaacactcccctggggacaaagctcaagtatgaggtggacaccagtggcatctaccacatcaaccaggagatcttccgcatgtttcccaaggacatgccctactaccggtcccagtttaagaagtgtgctgtagtgggcaacggaggcatcttgaagaacagccgctgcgggagggagatcaacagcgccgacttcgtcttccggtgcaacctgccccccatctcagagaagtacaccatggatgtgggggtgaagacggatgtggtcactgtgaaccccagcatcatcacagagaggttccacaagctggagaagtggcggcggccgttctatcgcgtgctgcaggtgtacgagaacgcgtcggtgctgctgcctgccttctacaacacgcgcaacaccgacgtgtccatccgcgtcaagtacgtgctggacgacttcgaatcgccgcaagctgtctactacttccatccgcagtacctggtcaacgtgtcgcgctactggctcagcctgggggtgcgcgccaagcgcatcagcaccggcctcattctggtcactgcggcgctggagctctgtgaggaggtgcacctctttggcttctgggccttccccatgaacccctcgggcctctacatcactcaccactactatgacaacgtcaagccgcgtcccggcttccacgccatgccctctgagatcttcaacttcctgcacttgcacagccgaggcatcctccgcgtgcacacgggcacctgcagctgctgctgatggctgccagccaggctgcccggcaagcggcgccccctctcctgctgtccctcctggtggaactgggagccccgaaccgggcagcgtggggtcctggcgttcaggctgtctctccctccattgttcagctctgtacttggatcctggggtagggaggca

SEQ ID NO: 186579 - DNA, 13761 bp, Homo sapiens
  Payload ID: 16738
  Gene Symbol: ST8SIA5
  Gene Name: ST8 alpha-N-acetyl-neuraminide alpha-2,8-sialyltransferase 5
  Uniprot ID: O15466
  ENST ID: ENST00000538168
  CDS Start-End: 302-1540
aaatcggcggctacccggcaccggcgcctggaggtaaaggtacccgggggtggggaaggcccctggccgcggcagagctccctgccaccggccctgtcctgcttgccgccccagcgcctgcgacgcttggatgcccccagctccggccgcgccaaccagaaactttgcccctcgaagtcccccgcctgcctgaccgcaccgtgaggcgccaagtcggccgcgcgccccccggggccccggaaccccgcgagtcattgcctggccgccccgtaccccgcgcccgcggcgcccggtagccaggatgcgctacgcggacccctcggccaaccgggatttgttggggagccgaactttgctcttcatcttcatctgcgcctttgccttggtgaccttgctgcaacagatcctgtatggcaggaactacattaagagaggcctccagtttggttggcagagtggtgaccagctgaccaattggacggggctctttaatgtcacggatgatccagcagtgcagagcggcagtgactccagctccaggtactttgaattttatgaggggccttttgaatataactccacaagatgcctggagctgaggcacgaaatattggaagtgaaggtgctgtccatggtgaagcagtcagagctgttcgacaggtggaagagcctccagatgtgcaaatgggcgatgaacatctctgaggccaaccagttcaagtctactctgtccaggtgctgcaacgcccctgcctttctcttcaccacccagaagaacactcccctggggacaaagctcaagtatgaggtggacaccagtggcatctaccacatcaaccaggagatcttccgcatgtttcccaaggacatgccctactaccggtcccagtttaagaagtgtgctgtagtgggcaacggaggcatcttgaagaacagccgctgcgggagggagatcaacagcgccgacttcgtcttccggtgcaacctgccccccatctcagagaagtacaccatggatgtgggggtgaagacggatgtggtcactgtgaaccccagcatcatcacagagaggttccacaagctggagaagtggcggcggccgttctatcgcgtgctgcaggtgtacgagaacgcgtcggtgctgctgcctgccttctacaacacgcgcaacaccgacgtgtccatccgcgtcaagtacgtgctggacgacttcgaatcgccgcaagctgtctactacttccatccgcagtacctggtcaacgtgtcgcgctactggctcagcctgggggtgcgcgccaagcgcatcagcaccggcctcattctggtcactgcggcgctggagctctgtgaggaggtgcacctctttggcttctgggccttccccatgaacccctcgggcctctacatcactcaccactactatgacaacgtcaagccgcgtcccggcttccacgccatgccctctgagatcttcaacttcctgcacttgcacagccgaggcatcctccgcgtgcacacgggcacctgcagctgctgctgatggctgccagccaggctgcccggcaagcggcgccccctctcctgctgtccctcctggtggaactgggagccccgaaccgggcagcgtggggtcctggcgttcaggctgtctctccctccattgttcagctctgtacttggatcctggggtagggaggcagggttaggaaccggggcagagtcagctctgtgctgagcctcctggcctggcccccaccggtgcatccgcccagtgcgtccacctgccctggctagcatgctgctgggccacaccccaagatcaggggccctggggacggcaagtgaataaagcacatttccacccaattttgtcatccgagagagagcacaaactgcaggcccttgttgcagctgaaggaagaccctacagagaatggaattgagagtggagacaggacacttcacaggacacttgagcacagtcaagattttattcacacttttggttcctgtgttttatatcgaagacttagctatgaattgctatctaaatctcagagcttagaagccaacccagtgactagaccttccagtgaagaaagtgatctcaagaggtccagggacttaacagccaagccacaccacccgacaggttcttctgtgacaccgagagatctaacccaaggcctgggttatgtcttagtcgagacatcatcatctgagaagcaccacatcctttcagacacatcctcggacacacatgcggtcttggtgcccccaggttcaatcctgcgttagctcttttgatgagaaggaaataaaccaaaccagccacttgcactatggcttccaagccaatgttattgactcaataagtgcttagcaattggcttcctcttttgtcttcctattttcagctccatttaaaccaggagttatttataaagacctcttcctctcatgtctctgaatcctgcagaatcctgctgtatcgtgttcctcagtcggaaccataggctctgggctggaaagcactgacatgtcaggtggtgagcttagcagagagaaacgagttgtggcctccgacaccagcatcactgaggcttccgctgtgaaggcgggacttctcacagcagaccccagggcctgggcttggggcagtcagctgggcttaggcagagaggggttcacatatcatttcacatctgaaattaattccctttgcttctccctgtggtgtttccaccataaatgggatggtgtctaagagacactgttggtgaactaactgccttagaacttagctttgtggaatcataggatgttagtgctgggaggaggacttcagcctacctgcctggcaacctgtctccctccctccttcctttctccctgcctcctcccctttctccttccctcccttcctcttttcttcctccccttaaacatttctggaaagcctattctgctttggtctgtggttggacttaggaagacataaggataaacaaaggcattatctgtgtcttctgggggtgcagggcccagagattatagacccagtcccacgtgctgggtgctctgggagggttaggagctgtaagagtctatcagggagtgggatctgctatccaatcacctcatttgacaggccccccggctgagccagtcagggacgtggagagtgcaggctttatcccaggcctccaggctcctgatccagggctccgttcttggccaaacttttgtgtcttggcttgggcttcctgtgggggggttgttgtggaacctgtgccctgtgcacaacactgttctcagtgctgactctcacctgcattctgagctctggtcctggttgggaaaacctcaggtggctctgagtctcagtctgctggtcaggaatgtaggggagtagccaaggggatgaaatgatcccaaacacctgctaaaccaggaagaactgcaaaggacagtggatggttattacttgcttgagctctgcctatttctcccagggagggaatttctgggaaagattccagttacctgagatttctagccactgcatggttaattgaacccagttcttgaaaccatggaatataaaaactagaaggttcttaaagaccattttgttccactttaggaaacaggcccagagcaaagatgtgactgggtcaagtcatgcctggggctctactgagtgcctgctgtggacagagccctctactggaagccctctgggtactagttatgttccagatgggcagtgtttgggggaggctccctggtgacacagacatcaggattcccacagctgagggtgttgcaggttggaatctgccccagccagggccctcgtaggagctgaggattggagcatcgggatccagcccacagaggagttgggacacctggctgctggccatattcctgcctgtgggtcttagggccagtccttcctctccctcaatgtctcagtttcctcatctctacaactagaagctttgtaaaaatcttcagcgtctgtacaatgtccttattttggggggacattcatgatgaatggatctaaaccataattaatatttctcattatactagctagcatttatcaagctacgttaagcactttccctatattatctcctgtaatcatcatgagacccctttgggtaaggaggctcccattgtacagatgaggagacagaggcttaaagcaattccaggacttgcccttggtcaggcacccaatggagggaacggcacccaatggagggaactgcacccagatctgtagagccccaaagtctgtgctccaaacctctgtcttagcttcccagacagtgacaccagaacatgagggatcctgaccaagatgcccctgcaggatagtacggggccctcctccagggacaaatgctctaggaggctgtcatcgtccgggaagcagcctgtgcttataggtgcctctccctaaccctgccgcctacagcagtagcgacttacccacagtggcactggaggggaactgaggccatcgtcacatttttaaggtgaggaaagatgcccagagatagcacatgttaagtgacaacacgaatgacttgcccagggctacatggccagcttgtggctcaactgggactcaccagtctcctgactttcaggatatagtttttctgctgcagccagtgtttataagaaaaacattttttcaaaggctcagagagacctggtgttgactctggaagccttctgccatgttcctccacagccctgtcaccacgccaccatgcagtgcagactacccattgaattattattcaagggaaatcgattcccgtaaacaaaacaaccatcatgtcttcctttgtgctaaacccactgctccaggcttgaaaggcagcaaaaacaagtaaatgactcagtgcttagccaagcacaaagaaaggtggctcaaggtcagaggcagcgtctgagaccatttcagcaatgctgctgcggcagctctgcccactaatcacctggtgcccagagacagcatgtgctcatcgcccttgactttgctgagagcagggaggaagcagagcagtgcttagaaacaactgaggcagagtagagtgctggccaatttagtgagtgaattggtgaataaattatatttattgagtgctcatgttgtgccaggcatggtgccaggtgccggggagctagtgatgaacaaaacgtcgtccctgccctccgggagtttgtggtctggtgtgtgtgtatacagacgttaaatgacgaatcccacaaacgtacgtgggagctggttgtgctgaacactatcaaatccagtctcagggacagttatctgggagaggtggaggaggggatgaccaaagtcaattccgaattctgaaggttggcagcataaaaagtgtaatgagcaaagcagcagatacttctcagatatcatccttgacatccgtgtaacatttgacaaggttggcctctctggtcttttttgtttgtttgtttgagacagagtctccctctgtcacccaggctagagggtggtgatataaatatggctcactgcagcctcgacacctgggttcaagtgatcctcccacctcagcttcccaagtagctaggaccacaggcacgtgccattgctcccagctaatttgaaaatttttttttttttgtagaaacggggttttgctatgttgacgaggctagtctcgaactcctgagctcaagcaatcctcctgccttggcctcccaaagtgctgggattacaggtgtgagccactatgcacagtctctctggtctttctaaagtcctctcctcttctgttttctaactattcttccctgactttcctcctgtctctctgaatgctccttctcaggttcctttgtggattcatcttccgtgaagcttcctcagggttctcttctcttcctaggagcattcctgcagaaatctcatctattcaaagccttaagtatcttctgccctggcatcttaacccctctacctgcaggccagtcctccctaggagcattggaagcatgctcactgtggcctcctgcatgtctgtgtctgcacagcatctcagacctcaacatgtcctcaactggtatagttaaaagaacaatctgaactcagagtctcctcctactacttcgtagctgtgtgaaattgagggagctccagaagcccctggaggctctggactcatcatctgaaatgaggacaggataccaaccacaacagctgttgcaaagctaagtgaaatagtgttgcacaatgcctagcacagtgcccagcacaaactagacactagcaagcacaggttgccttggcccaaaacttggatcacctttgcctcttccttctccttcactctttatgtctatttgttcactgtatcttgtcaattccaactcataaacatccctttaagtcattccctccctgcaacccctctgctactgccctaacccagaccatctgatggatctttttgctttcagagaataaccttccaaaaataccttttgtggggcccattgcctacctgtatcataaacttcaggttctttaccaagtcatgcagggaatgtcccaagctggcttactcaccttcccagagatcctcctgccacctccctgccctatcccatactattccaggcacctttgcacactctgttcaaacacctggaatggccctcacactcctaagttcctctctccttccttttatctggccacttttgcagaagtcaggtaatggccccctgcatcctcccctctagagacctgggctgggcactctctcctctgtgcttctgctgcaaccatcaccgactccattaggacatcctcacagcacacagcataagggcccgtgtgtccttgatagaaggtttgccttctccccaagggaagacacgatatctaagctcattttgtattgccagcactggcggggaagcacatgccatggccactcaacacatgtttactacagtaatgaggtctctggttcctgggggactccagcagttcaggataccccgctaataaactgagtaacaccttggggaaattgtcagctgaggagagtcctctattgatttttttacctagcacatcccaggaaggcagagactcctcctgcctgtccaggggagctcggggctcaggaggctgaaatgtctgtctagtgggggcttatgggcttggctagcctctttttgttttccctcattataatcctgctcatctgctttttgctggctagccaatcctttttcctctagtttaaatgaaagaagggagagacattttctgtgtttcttgttgtctacttcttcccttcctcaaagccacacaaacatgtcaggctcttacatcactgtggctgaggtgcagcctgggaagcaatgtaagagggatttatcaatggtgtttaaaaaactagaggaacatgctgaatgctttggctgggaaacaggtgagctgagctttgcaggatgtctgctccagatgcgaaggggaagaccaggagcatggggttgtttcctgggggaaaaaaggtgctgcttctctgagctcaacacacgccctgacctagtctcctccctgtaaccagagcaccctctgggaagaggctaactgtggctcaggggtcaggtgaggccaggcgaggggtgcaccagtggccagggtgtgccttgtgctattgtttagaggtctagtcaaacgaggccagtctgtggaggctgattccatcctacggggcatcctaataaaccagtgtgatcttcaaagggtagactggatagatctacagtgtgatcttcaaagggtagactggatagacctacagtatagatctacagtatagatctacagtctaccctttgaagatcacatgggtttattaggatgccctgtaggatggccttctgatggcctgcatcagaatcacctgggtgcttgttaaaactatggactgagaacctgggggagaggtggcgcctgggaatcagcatgtgtgaggccctatctgttccctgagcatacaactgcttgtggttcagaagttgccaccagttgagtggccatgtatggcttgaaattcagactggagccttgagtaggaaaagaatgaaaagaagaatttggcacacaacccaacttctgccttttctgtacatacaaatataatatataacccactatgtacctagcaacaaaagtcaagtgctcgggaatctaacatttacaaaattggttttgctttaacacaaacaaagatttctttttcatttgtaattatggtaaaatacacataacatagaatttatcatcttaaccatttttaagtgtacagttcagtaatggtaagtacattcacactgttgtatattctgtctctggaactcttctcatcttgcaaaatgaaaactttaaacccattaaatgacaagtcttcacttcccccttccccagcccctggcaatcgcaattctactttctttctctatgaattttactgctctaggtccctcatataagtagaatcatataatatttgtctttctgatgactggcttatttcacttagtatagtataccagagactttttagaatcacttaggtgcaagcagctctcaaatgacattaactgttttgggtgtccctaaagcagaaatctgatttttgtttttgtttttgccttgggcagttgtcctgggctggtcgttggcccctggcttcctgagaccttggccccttgctgagggagagtgcagacctggccttgctctgccacctgggctccactgtcctggccagcatgtcctgagagacaatagccttgctgatcttttagaagtctttaggtattttcccctgcacagtctcttctgagaacctttctttttttttttttttatttcaaaggaaaaaaaccaaaagcaaaaacatacacttccatgacttagctgttggccacaaaagccagaaatcagtgactctctcttcagttgaagatggttcccatggcaacaaatctctcatttccttcaactaaatgatctgctcagctttggggtaaaagttctgttttctctagaattgccatttgcaaccttgtgtgtacataggaatcacctggaagtctttataaaataatccccaagccaggtcctttacttcccggaggatctgattcagcaggcctggggatagggcctggtatccctattttgaaagatctcattaagtggttctgtctcacatggttgggagtcattaccctaaggcaggcagtctatgccttggtgcacgctagagtcgtctgaagagctttaagaaatactcgtgcgaccccaccccttgacattctgagtcaggtggtctgagatgtgacctgaatattaggatttcacaaattctccagatgtttctaatgtgcagccagccttgagaaccactattctaggtcagcagttctcaaactggaggctgcctcagaatctcttggagagctccttgattatgggccccgccccagagttatttggtgaggccagggtggagcatctctaacaagttcccaggtgatgccaatgctggtccagggactgcacttggaggctcatggctctagatgatcctttaatgagattggccctgttctgctgccctgttctttttcctggttgggggttggtggacccttccttccctcagtctgactcaggcgtgagacttcttaaaggtaccagcttttctttttctgaacattttagcattcagataaatattatgacatatttttaaagcaaagtaacatagatttcttctcccggggctaggagcctcagagtctgcctgaattaagaatttatctgtgcctaagattaggatgcatttagtgatctgagctaaggggttggtggatctgcagcaataggttcagcctgtgcctgggtgagggtcaccttgtgaccggcgctgggtaggatctgagtaccacacacttggccctctagcatggggaggacctgtctggtccacctgggggaaagcctggttttctgatgcagacccagccctctgcccacctccacatctgtgcacaaacatggaaggtagcaatgaggaaacacagcaccaggactgccgtgagcccaggagctagggttagagcctcacttctttatgcatttccttttctatcatactttggaacaggcttgagctgaaaccagagagttagtacctggtttctgcctcaatctagtctccctcctccaaagatgcccccacaacgtgggcaacttcaacccccatgagagctcagaattccacattcagcgacaaagttgacaagagcctctggagatctcaaagacttattaaaagtggaaatggctactgttttactgaggcagggtgaaaacacaactcacttcctaggatcgaacccagcaaattcactcagcccccaggtaactgaggactcagttgaaggaaaataattttgagcccctgaaaatagatgctataaagctgtgtatcaagggccaaccattttgctaatatcacatatctcacggcatttgctttgattttaaattcagttctagtgaacttggttctgatttctaatgacaaagcaaactaagagaatgatgacatgtgctagataaagcaagaagtggcagctaatagcctaaattgtgatggcattaagaagaccaaaactagtttacttgttcaacgacagcttgtctttggaaaaaaaaaaacactacattaaggataagaaaatatgtccaggcatggtggctcacatctgtaatcccagcattttgggaggctgaggcgggagatcgcttgagctcaagagttgacgaccaacctgggcaacatggcaaaaccctgtctcaataaagaatacaaaagcacacctgtagtcagtcccagctactcaagaggttgaggtgggagactggcttgagcccaggaggcagaggttgcagtgagctgagatcataccactacactccagcctgggtgacagagccagaccctgtctcaaaataataattaaaaaagaccaaaactaaatacatatctcaggaaccatcaagtagcctgaggtcgttggtcgtttagtggggaagagagggagaatatgttataataaccccgggagcaacacagcatttcagctcagttcaccctgtgacatccaggacatgcagaggtaaaaaagcgttccaacaatgttcaatacactgtctaagaaggcagggctgcgttttatccactttagaattatttccatccccaaacagttaaaatactttcacaaaagtcttggtgcttaaaagataaatgctcagtgacctggaagttcacataaatgaaacggttgatgatctgatgatgaaggataggcgagatgggtaaactcactctttttttttttttgagatggagtctcactctgtcacccaggctggagtgcagtggcatgatctcggctcacggcaacctccgcctcccaggttcaagtgattctcctgcctcagcctcccaagtagctgggattacaggcgcccaccactttgcccagctaatttttggtatttttagtagagacggggccaccattttggccaggctggttgtgaactcctgacctcgtgattcgcccacctcctcctcccaaagtgctgggattataggtgtgggccaccgtgcccggccaaactcactcttttgaacttaacattttccccctgacattggagactctcctgctacctctctcctaagaaaaaagggcaggtggtggggggacaagccccttccaccttcccatctccaagggactttgcagtgtgggtgatggtgtggctgatcatcctctttctgcacctctgattctgcttgtgttgtccttattgtgtggggcaggagggtcaggacttcagctaggggtgtgctggctctgcagtgactcaggcctgggtgttttttggtgaatttaaaaagatgaccatttctgggggaaagtgacacttttactttctccacaccttcaccatccattttcttactggacttcgctgcgttcctgcaaggaggacagggcagagagtagcaaccctccttgccgaggcccagaaagatagcgtggtgtgcccagggcacccatggtgggtgatggacatctccttttgggtgccaaggcttcctcaaggtgggaggaactggagggcaggggacggtggccagtgtcccgctctagccctctagggcacctttttctcccctctgaagttgttaggctgatctggagtctgctccaggcctgggcttcaccctggcctcatgccctgcccagcacctgtgtggagggacctgttcgtattcattcctctttgggggccaagctcagggcacccgaaccagcagccttgggtggctgaacctagtgggacagaagggaggcagttgtatctggcagagtcacccaaggccacaggcctgagcaaagcaggagagcggggcaagctggggtcagggaccatggtgctggccccctgctgctctggccatgtgggaggcagctggaggggtcccaagtggcagctcctgccagactaccccggactcccgagcccatcgtcctgtactcttctccagtgggacgtctggccctcactgtggctagcttctgggcaagtccctctgctcaagatcactttatggggcagctggtgccccctggggctcccacactctgcacatacaatttagggacctggcagggtcttggtggcctgcagcttccctttctggaaccgactcgcctcccatcagagagccataactcttcttcaatacagtattgtttgaactttgaaatatatgcatttgtctatgtattttcttaaaaattaacactgtatctcaataagcatacaatggattgttcaatggtacagtttggaaccaatcccccgccacttccctccccaagtaaagccaggacagatgctggagtcagcatgggagctgtggaaaccttttgccctggagccaggtgcctgtggctgtgcctgggagtggcttcagcccaggcgtggtgtcagtttcctggcacccctgcccaggagcctgcatgaaggcagccgggtctctctctgagtggctggtgcaccggctcatttctgagtggcctcctgcgtatgaagaaaaagcggccacgtggcatgcctcccttccctcccttgctttcctctcaaagagccaagtcacgctgcactgcgctccgtggagcctttcccgatggagaagagaagggaggcctgagatgtcctttgctgggatgtggagaaacaccatctatatgaaaagccccttgcttgctctgctgattttctccctcccctggccctggagagaaaggctgtgccattcaaagacagtttggggacatgggggctgcaggcctgatcttatttttatgcaaattttgttctgggagcagtggtttatacaaactcctgtagcataattccagcttgtgtgtggctgtccttgagtagtgattctgaagtgatgactgtgatgctatgcctaaaaacatcatcagggtactttgtatctgtcactgtgtttgaacggccctcaatttctatctaataaaaccagtcaaatggttcaccta

SEQ ID NO: 186580 - DNA, 582 bp, Homo sapiens
  Payload ID: 16738
  Gene Symbol: ST8SIA5
  Gene Name: ST8 alpha-N-acetyl-neuraminide alpha-2,8-sialyltransferase 5
  ENST ID: ENST00000590488
  CDS Start-End: 158-280
agcaccaagtagagaaaaattagtgaaaaattagtactgtcatcttggagcctgtgtgtaggacctacctcataatttggcccagtgcaaagagaaatgcaaacccccttgttcaaaagtttgaagacagcaagagtggagcaatcagtcaaaatcaatggtggtggtggggacaaatgaacaagtcccactcccaagaagccagcctgcctgtgtgtgtgggagaaagaacctcatctcagaatcccaagacttgttgctagggtgcgtgatgctctaaaaggtccaagaagagcatagaggagctctctaaggagagcttcttgagcgaaagtgtgcatgttatggtgccatccctaactttagagatgatggtcataggatgagcagggccctcccctggccaggatgggatccgtcaggaagactgtttatatccttaggttgaggattattcatcccctttgacggatgagaaaactgagacttcaagaggttcaatgctgagagtcacactgctagtgaatggtggaatgcgagcccccctatccaagaatctctagaggcaagcattgcctggag

SEQ ID NO: 186581 - DNA, 364 bp, Homo sapiens
  Payload ID: 16738
  Gene Symbol: ST8SIA5
  Gene Name: ST8 alpha-N-acetyl-neuraminide alpha-2,8-sialyltransferase 5
  ENST ID: ENST00000591375
  CDS Start-End: 43-207
aaagtttgaagacagcaagagtggagcaatcagtcaaaatcaatggtggtggtggggacaaatgaacaagtcccactcccaagaagccagcctgcctgtgtgtgtgggagaaagaacctcatctcagaatcccaagacttgttgctaggtactttgaattttatgaggggccttttgaatataactccacaagatgcctggagctgaggcacgaaatattggaagtgaaggtgctgtccatggtgaagcagtcagagctgttcgacaggtggaagagcctccagatgtgcaaatgggcgatgaacatctctgaggccaaccagttcaagtctactctgtccaggtgctgcaacgcccctgcctt

SEQ ID NO: 186582 - DNA, 2276 bp, Homo sapiens
  Payload ID: 16739
  Gene Symbol: ST8SIA6
  Gene Name: ST8 alpha-N-acetyl-neuraminide alpha-2,8-sialyltransferase 6
  Uniprot ID: P61647
  ENST ID: ENST00000377602
  CDS Start-End: 76-1272
ggagccgcgagtcggggccgcccgggctgtgcttcgccccggcagcagcggtggcggcggcgcctgtggctcaggatgcggccggggggcgcactgctcgccctgctcgccagcctgctgctgctgctgctgctgcgcctgctctggtgcccggcagacgcgcccggccgcgccaggattctggtggaggaaagcagggaggccacccacggcacccccgcagcgctgaggacgctccggagcccggcgaccgcggtaccgcgcgccactaacagcacatatctgaatgagaagtcgctccaactgacggagaaatgcaaaaatctgcaatatggcattgagtctttctctaacaaaacgaaagggtattcagagaacgactaccttcagattatcacagatatacagagttgtccatggaaacggcaagcagaagaatatgcaaattttagagccaaacttgcttcctgctgtgatgctgttcaaaactttgttgtttctcagaataacactccagttgggactaatatgagttacgaggtggaaagcaaaaaagaaatcccaattaagaagaacatttttcatatgtttccagtgtcccagccttttgtggactacccttataatcagtgtgcagtggtcggaaatgggggaattctgaataagtctctctgtggaactgaaatagataaatccgacttcgtttttaggtgtaacctacccccaaccacaggagatgttagtaaagatgttggcagtaaaacaaatcttgtgactataaatccaagcatcataactctgaaatatgggaacttaaaggaaaaaaaagccctatttctggaggacattgcaacctatggagatgcattttttcttctgccagcattttccttcagggccaacacgggtacctctttcaaagtatactacacgctcgaagagtctaaagcaagacaaaaggttctatttttccatcccaagtacctgaaagatctggcccttttctggagaactaaaggtgtgactgcataccgcttgtccaccggcttgatgatcacaagtgttgcagtggaactgtgtaaaaatgtgaagctgtatggattctggcccttctctaaaactgtagaagacatacctgtcagccatcactattatgacaacaagctacctaaacatggtttccatcagatgcccaaagaatacagccagatcctccaacttcacatgaaaggaatcctcaaactgcaatttagcaaatgtgaagtcgcctaaacaaagtatcttaaaatgggaataattttaatataatgcagtaggtgattaacaatgtctccaaacaccaaaggaggtggctaaagagtattttgagatgagccccaaaatttggtttgaccaaagcttccccactcattttgcaatgatggcaagtcattcaatccttctcatcttcattttttctccttataacatggacaccatatctgactcatacaaatttttataatttatgaaaattattggcatggcctttggtgtgaggtagggactcaaagaatatttctttcttactatttataccagccatctccaccttcaccagaccgataataaaagcatgctttcttggagatctcttctaaagagaatagctgcattaccagtatccattggatttctttctgtggcaggtctctatcaataatatccttcccatttttctgtctcaaagactgcatgcaagaaaattatatacttaagcaaaaagttcttgatcattcgggaatgaaattcttctctgagtatggcagtatgcctgcttctgattaaattcacttttaatagtagctgtgatgatattttggttgaatttaagccatttattttcctcttatgtctacatttcttcatcacttaataattttattttaacttcctgcctcattcttacacttttttctctctcacttatacgatatacttcaaggacgtgaacagttacaatacccagtctttcttacctgttgtcttgcctgtggggtcactcactcaattttattttaaaattactgaataactacttcatgccaggccctgcaccaggctctgtgagaggacaagaaggattattgcctcttgtaggagaaaacagatgtgcatatcattaattatgatggggtatgataagtattacaatgacaaaagctatgaataaagtgctacaaggaacagaagcagggataattaaatccatttcagtggaatctatttcaatgtac

SEQ ID NO: 186583 - DNA, 697 bp, Homo sapiens
  Payload ID: 16739
  Gene Symbol: ST8SIA6
  Gene Name: ST8 alpha-N-acetyl-neuraminide alpha-2,8-sialyltransferase 6
  ENST ID: ENST00000440449
  CDS Start-End: 1-385
ctacccttataatcagtgtgcagtggtcggaaatgggggaattctgaataagtctctctgtggaactgaaatagataaatccgacttcgtttttaggtgtaacctacccccaaccacaggagatgttagtaaagatgttggcagtaaaacaaatcttgtgactataaatccaagcatcataactctgaaatatgggaacttaaaggaaaaaaaagccctatttctggaggacattgcaacctatggagatgcattttttcttctgccagcattttccttcagggccaacacgggtacctctttcaaagtatactacacgctcgaagagtctaaagcaagacaaaagtgcaaaacaaaaagaaaaactataaactccatcttgtagatttgtagattcgccacaaccaagtctgactgtgacactcccaagaaatctgtatgtaatcagcattgcttaaatattgttagatctaatgtgatcttctgctcttaaaactcaagtacatctaagggcattgagaatggaaagtctgagttctggtactagacaagagcagccctttaggccaggcgcaatggctcacacctgtaatcccagcactttgggaggccaaggtgggtgggtcacttgaggccaggagtttgagactagcctgggcaacatagtgagtacccttctctacaaaaaacaaaaaaa

SEQ ID NO: 186584 - DNA, 7928 bp, Homo sapiens
  Payload ID: 16740
  Gene Symbol: STAB1
  Gene Name: stabilin 1
  Uniprot ID: Q9NY15
  ENST ID: ENST00000321725
  CDS Start-End: 77-7789
ctgcctgtgctgtgcctgcctcctagagctcattccctacgccccgactctgtcctggacagcgtgcccaccagccatggcggggccccggggcctcctcccactctgcctcctggccttctgcctggcaggcttcagcttcgtcagggggcaggtgctgttcaaaggctgtgatgtgaaaaccacgtttgtcactcatgtaccctgcacctcgtgcgcggccatcaagaagcagacgtgtccctcaggctggctgcgggagctcccggatcagataacccaggactgccgctacgaagtacagctggggggctctatggtgtccatgagcggctgcagacggaagtgccggaagcaagtggtgcagaaggcctgctgccctggctactggggttcccggtgccatgaatgccctgggggcgctgagaccccatgcaatggccacgggacctgcttggatggcatggacaggaatgggacctgtgtgtgccaggaaaacttccgcggctcagcctgccaggagtgccaagaccccaaccggttcgggcctgactgccaatcggtgtgcagctgtgtgcacggagtgtgcaaccatgggccacgtggggatggaagctgcctgtgctttgctggatacactggcccccactgtgatcaagagctgcccgtctgccaggagctgcgctgtccccagaacacccagtgctccgcagaggctcccagctgcaggtgcctgcccggctacacacagcagggcagtgaatgccgagcccccaacccctgctggccatcaccctgctcactgctggcccagtgctcggtgagccccaaggggcaggctcagtgtcactgccctgagaactaccatggcgatgggatggtgtgtctgcccaaggacccatgcactgacaaccttggtggctgccccagcaactctactttgtgtgtgtaccagaagccgggccaggccttctgcacctgccggccaggcctggtcagcatcaacagcaacgcttctgcgggctgcttcgccttctgctcccccttctcctgcgaccggtctgccacttgccaggtgaccgctgatgggaagaccagctgtgtgtgcagggaaagcgaggtgggggatgggcgtgcctgctacggacacctgctccacgaggtgcagaaggccacgcagacaggccgggtgttcctgcagctgagggtcgccgtggccatgatggaccagggctgccgggaaatccttaccacagcgggccctttcaccgtgctggtgccatccgtctcctccttctcctccaggaccatgaatgcatcccttgcccagcagctctgtagacagcacatcatcgcagggcagcacatcctggaggacacaaggacccaacaaacacgaaggtggtggacgctggccgggcaggagatcaccgtcacctttaaccaattcacgaaatactcctacaagtacaaagaccagccccagcagacgttcaacatctacaaggccaacaacatagcagctaatggcgtcttccacgtggtcactggcctgcggtggcaggccccctctgggacccctggggatcccaagagaactatcggacagatcctcgcctctaccgaggccttcagccgctttgaaaccatcctggagaactgtgggctgccctccatcctggacggacctgggcccttcacagtctttgccccaagcaatgaggctgtggacagcttgcgtgacggccgcctgatctacctcttcacagcgggtctctctaaactgcaggagttggtgcggtaccacatctacaaccacggccagctgaccgttgagaagctcatctccaagggtcggatcctcaccatggcgaaccaggtcctggctgtgaacatttctgaggaggggcgcatcctgctgggacccgagggggtcccgctgcagagggtagacgtgatggccgccaatggtgtgatccacatgctggacggcatcctgctgcccccgaccatcctgcccatcctgcccaagcactgcagcgaggagcagcacaagattgtggcgggctcctgtgtggactgccaagccctgaacaccagcacgtgtccccccaacagtgtgaagctggacatcttccccaaggagtgtgtctacatccatgacccaacggggctcaatgtgctaaagaagggctgtgccagctactgcaaccaaaccatcatggaacaaggctgctgcaaaggttttttcgggcctgactgcacgcagtgtcctgggggcttctccaacccctgctatggcaaaggcaattgcagtgatgggatccagggcaatggggcctgcctctgcttcccagactacaagggcatcgcctgccacatctgctcgaacccaaacaagcatggagagcaatgccaggaagactgcggctgtgtccatggtctctgcgacaaccgcccaggcagtgggggggtgtgccagcagggcacgtgtgcccctggcttcagtggccggttctgcaacgagtccatgggggactgtgggcccacagggctggcccagcactgccacctgcatgcccgctgtgttagccaggagggtgttgccagatgtcgctgtcttgatggctttgagggtgatggcttctcctgcacacctagcaacccctgctcccacccggaccgtggaggctgctcagagaatgctgagtgtgtccctgggtccctgggcacccaccactgcacatgccacaaaggctggagtggggatggccgcgtctgtgtggctattgacgagtgtgagctggacatgagaggtggctgccacaccgatgccctctgcagctatgtgggccccgggcagagccgatgcacctgcaagctgggctttgccggggatggctaccagtgcagccccatcgacccctgccgggcaggcaatggcggctgccacggcctggccacctgccgggcagtggggggaggtcagcgggtctgcacgtgcccccctggctttgggggtgatggcttcagctgttatggagacatcttccgggagctggaggcaaatgcccacttctccatcttctaccaatggcttaagagtgccggcatcacgcttcctgccgaccgccgagtcacagccctggtgccctccgaggctgcagtccgtcagctgagccccgaggaccgagctttctggctgcagccaaggacgctgccgaacctggtcagggcccattttctccagggtgccctcttcgaggaggagctggcccggctgggtgggcaggaagtggccaccctgaaccccaccacacgctgggagattcgcaacattagtgggagggtctgggtgcagaatgccagcgtggatgtggctgacctccttgccaccaacggtgtcctacacatcctcagccaggtcttactgcccccccgaggggatgtgcccggtgggcaggggttgctgcagcagctggacttggtgcctgccttcagcctcttccgggaattgctgcagcaccatgggttggtgccccagattgaggctgccactgcctacaccatctttgtgcccaccaaccgctccctggaggcccagggcaacagcagtcacctggacgcagacacagtgcggcaccatgtggtcctgggggaggccctctccatggaaaccctgcggaagggtggacaccgcaactccctcctgggccctgcccactggatcgtcttctacaaccacagtggccagcctgaggtgaaccatgtgccactggaaggccccatgctggaggcccctggccgctcgctgattggtctgtcgggggtcctgacggtgggctcaagtcgctgcctgcatagccacgctgaggccctgcgggagaaatgtgtaaactgcaccaggagattccgctgcactcagggcttccagctgcaggacacacccaggaagagctgtgtctaccgatctggcttctccttctcccggggctgctcttacacatgtgccaagaagatccaggtgccggactgctgccctggtttctttggcacgctgtgtgagccatgcccagggggtctagggggggtgtgctcaggccatgggcagtgccaggacaggttcctgggcagcggggagtgccactgccacgagggcttccatggaacggcctgtgaggtgtgtgagctgggccgctacgggcccaactgcaccggagtgtgtgactgtgcccatgggctgtgccaggaggggctgcaaggggacggaagctgtgtctgtaacgtgggctggcagggcctccgctgtgaccagaaaatcaccagccctcagtgccctaggaagtgcgaccccaatgccaactgcgtgcaggactcggccggagcctccacctgcgcctgtgctgcgggatactccggcaatggcatcttctgttcagaggtggacccctgcgcccacggccatgggggctgctcccctcatgccaactgtaccaaggtggcacctgggcagcggacatgcacctgccaggatggctacatgggcgacggggagctgtgccaggaaattaacagctgtctcatccaccacgggggctgccacattcacgccgagtgcatccccactggcccccagcaggtctcctgcagctgccgtgagggttacagcggggatggcatccggacctgcgagctcctggacccctgctctaagaacaatggaggatgcagcccatatgccacctgcaaaagcacaggggatggccagaggacatgtacctgcgacacagcccacaccgtgggggacggcctcacctgccgtgcccgagtcggcctggagctcctgagggataagcatgcctcattcttcagcctccgcctcctggaatataaggagctcaagggcgatgggcctttcaccatcttcgtgccgcacgcagatctaatgagcaacctgtcgcaggatgagctggcccggattcgtgcgcatcgccagctggtgtttcgctaccacgtggttggctgtcggcggctgcggagcgaggacctgctggagcaggggtacgccacggccctctcagggcacccactgcgcttcagcgagagggagggcagcatatacctcaatgacttcgcgcgcgtggtgagcagcgaccatgaggccgtgaacggcatcctgcacttcattgaccgtgtcctgctgccccccgaggcgctgcactgggagcctgatgatgctcccatcccgaggagaaatgtcaccgccgccgcccagggcttcggttacaagatcttcagcggcctcctgaaggtggccggcctcctgcccctgcttcgagaggcatcccataggcccttcacaatgctgtggcccacagacgccgcctttcgagctctgcctccggatcgccaggcctggctgtaccatgaggaccaccgtgacaagctagcagccattctgcggggccacatgattcgcaatgtcgaggccttggcatctgacctgcccaacctgggcccacttcgaaccatgcatgggacccccatctctttctcctgcagccgaacgcgggccggtgagctcatggtgggtgaggatgatgctcgcattgtgcagcggcacttgccctttgagggtggcctggcctatggcatcgaccagctgctggagccacctggccttggtgctcgctgtgaccactttgagacccggcccctgcgactgaacacctgcagcatctgtgggctggagccaccctgtcctgaggggtcacaggagcagggcagccctgaggcctgctggcgcttctacccgaagttctggacgtcccctccgctgcactctttgggattacgcagcgtctgggtccaccccagcctttggggtaggccccaaggcctgggcaggggctgccaccgcaattgtgtcaccaccacctggaagcccagctgctgccctggtcactatggcagtgagtgccaagcttgccctggcggccccagcagcccttgtagtgaccgtggcgtgtgcatggacggcatgagtggcagtgggcagtgtctgtgccgttcaggttttgctgggacagcctgtgaactctgtgctcctggtgcctttgggccccattgtcaagcctgccgctgcactgtgcatggccgctgtgatgagggccttgggggctctggctcctgcttctgtgatgaaggctggactgggccacgctgtgaggtgcaactggagctgcagcctgtgtgtaccccaccctgtgcacccgaggctgtgtgccgtgcaggcaacagctgtgagtgcagcctgggctatgaaggggatggccgtgtgtgtacagtggcagacctgtgccaggacgggcatggtggctgcagtgagcacgccaactgtagccaggtaggaacaatggtcacttgtacctgcctgcccgactacgagggtgatggctggagctgccgggcccgcaacccctgcacagatggccaccgcgggggctgcagcgagcacgccaactgcttgagcaccggcctgaacacacggcgctgtgagtgccacgcaggctacgtaggcgatggactgcagtgtctggaggagtcggaaccacctgtggaccgctgcttgggccagccaccgccctgccactcagatgccatgtgcactgacctgcacttccaggagaaacgggctggcgttttccacctccaggccaccagcggcccttatggtctgaacttttcggaggctgaggcggcatgcgaagcacagggagccgtccttgcttcattccctcagctctctgctgcccagcagctgggcttccacctgtgcctcatgggctggctggccaatggctccactgcccaccctgtggttttccctgtggcggactgtggcaatggtcgggtgggcatagtcagcctgggtgcccgcaagaacctctcagaacgctgggatgcctactgcttccgtgtgcaagatgtggcctgccgatgccgaaatggcttcgtgggtgacgggatcagcacgtgcaatgggaagctgctggatgtgctggctgccactgccaacttctccaccttctatgggatgctattgggctatgccaatgccacccagcggggtctcgacttcctggacttcctggatgatgagctcacgtataagacactcttcgtccctgtcaatgaaggctttgtggacaacatgacgctgagtggcccagacttggagctgcatgcctccaacgccaccctcctaagtgccaacgccagccaggggaagttgcttccggcccactcaggcctcagcctcatcatcagtgacgcaggccctgacaacagttcctgggcccctgtggccccagggacagttgtggttagccgtatcattgtgtgggacatcatggccttcaatggcatcatccatgctctggccagccccctcctggcacccccacagccccaggcagtgctggcgcctgaagccccacctgtggcggcaggcgtgggggctgtgcttgccgctggagcactgcttggcttggtggccggagctctctacctccgtgcccgaggcaagcccatgggctttggcttctctgccttccaggcggaagatgatgctgatgacgacttctcaccgtggcaagaagggaccaaccccaccctggtctctgtccccaaccctgtctttggcagcgacaccttttgtgaacccttcgatgactcactgctggaggaggacttccctgacacccagaggatcctcacagtcaagtgacgaggctggggctgaaagcagaagcatgcacagggaggagaccacttttattgcttgtctgggtggatggggcaggaggggctgagggcctgtcccagacaataaaggtgccctcagcggatgtgggccatgtcaccaa

SEQ ID NO: 186585 - DNA, 671 bp, Homo sapiens
  Payload ID: 16740
  Gene Symbol: STAB1
  Gene Name: stabilin 1
  ENST ID: ENST00000469989
  CDS Start-End: 1-532
ggatgatgagctcacgtataagacactcttcgtccctgtcaatgaaggctttgtggacaacatgacgctgagtggcccagacttggagctgcatgcctccaacgccaccctcctaagtgccaacgccagccaggggaagttgcttccggcccactcaggcctcagcctcatcatcagtgacgcaggccctgacaacagttcctgggcccctgtgcaggcagtgctggcgcctgaagccccacctgtggcggcaggcgtgggggctgtgcttgccgctggagcactgcttggcttggtggccggagctctctacctccgtgcccgaggcaagcccatgggctttggcttctctgccttccaggcggaagatgatgctgatgacgacttctcaccgtggcaagaagggaccaaccccaccctggtctctgtccccaaccctgtctttggcagcgacaccttttgtgaacccttcgatgactcactgctggaggaggacttccctgacacccagaggatcctcacagtcaagtgacgaggctggggctgaaagcagaagcatgcacagggaggagaccacttttattgcttgtctgggtggatggggcaggaggggctgagggcctgtcccagacaataaaggtgccctcagcggatgtgggccatgtcaccaa

SEQ ID NO: 186586 - DNA, 8251 bp, Homo sapiens
  Payload ID: 16741
  Gene Symbol: STAB2
  Gene Name: stabilin 2
  Uniprot ID: Q8WWQ8
  ENST ID: ENST00000388887
  CDS Start-End: 205-7860
accaagactcctggatttgccatttttcctttctgaaggcaggtctcacctatctcctggttcgatctaggaaaaaggaaaggaagggatttaaaagtaaacagtgaaatgagaaagaattcactgggagtttatcaaactaagttaaaatagctaagtcagcctgacaggtgcttggcacagagaaggagcaaatatttcctcatgatgctacaacatttagtaattttttgtcttggattggttgtacaaaatttctgctccccagctgaaaccacagggcaggcaagaagatgtgataggaagtctcttcttacaattaggaccgagtgccgatcctgcgctctcaaccttggagtcaagtgcccggatggttacaccatgattaccagtggctctgtaggggttcgagattgcaggtacacctttgaggtcagaacatactctctgtctctccccggatgccgccatatttgtaggaaggactatctccaacctcggtgttgtcctggccgctggggcccagactgtatagagtgcccaggtggagcggggtcaccctgcaatggcagaggcagttgtgctgaaggcatggaaggaaatggaacctgctcctgccaagaagggtttggtggaacagcctgtgaaacctgtgctgacgacaacttatttggacccagctgttcatcagtgtgcaactgtgtgcatggggtgtgcaacagtggactagatggcgatggaacctgtgagtgctactctgcgtacactggccccaagtgtgacaagcccatccctgaatgtgcagccttgctctgcccagaaaattccagatgttcgccttccactgaagatgaaaacaaactggaatgcaaatgccttcccaattaccgaggcgatggcaaatactgcgaccccatcaatccatgtttacgaaaaatctgccaccctcatgctcattgtacgtacctgggaccaaatcggcacagttgtacatgccaagaaggctaccgtggggatggccaagtgtgcttgcctgtggacccctgccaaattaactttggaaactgccctacaaagtctacagtgtgcaaatatgatgggcctggacagtctcactgcgagtgtaaggagcattaccagaatttcgtacctggagtggggtgcagtatgactgatatatgtaaatcagataacccgtgtcataggaatgcaaattgcaccaccgtcgcaccaggccgaactgaatgcatttgccagaaaggttacgtgggtgatggcttaacgtgttatggaaacattatggagcgactcagagaattaaatactgaacccagaggaaaatggcaaggaaggctgacctctttcatctcactcctagacaaagcttatgcctggccactgagtaagctgggacccttcacggtgctgttacctacagacaagggactgaaaggattcaatgtaaatgagcttttggtggataataaagctgctcaatactttgtgaaactccacataattgctggtcagatgaacatcgaatatatgaataacacagacatgttctacaccttgactggaaagtcgggggaaatcttcaacagcgataaggacaatcaaataaagcttaaactccatggaggcaaaaagaaggtaaaaattatacaaggggacatcattgcttccaatgggcttctgcacatccttgacagagccatggacaagttagaacccacatttgagagcaacaatgagcaaaccataatgacaatgctacaaccaaggtacagcaagttcagatctttgttagaggaaaccaatttgggacatgccttagatgaggatggagttggtggaccatacaccatttttgttccaaataatgaagcattgaataacatgaaggacggcactctcgattacctcctttctccagagggatctcggaagcttctggaactcgtcagataccacattgtcccatttacccagcttgaagtggccactctcatctccacccctcacatcaggagcatggccaaccagctcatacagttcaacaccaccgacaatggacagattctggcaaatgatgtggcaatggaagaaattgagatcactgccaaaaatggccgaatttacacactgacaggagttctcattcctccctccattgtcccgattctgccccatcgatgtgatgaaacaaagagagagatgaaactgggcacttgtgtgagctgttctctggtgtactggagcagatgtcctgctaactctgagcccacagcactcttcacacacagatgtgtctacagtggcaggtttgggagcctgaagagcggctgtgcccggtactgcaatgccactgtgaagattccaaagtgctgcaaaggcttctatggacctgactgcaaccagtgtccaggaggcttctcaaatccatgctcaggaaatggacagtgtgcagatagcctcggcggcaacgggacatgcatttgtgaggagggcttccaaggctcccagtgtcagttctgctctgatcccaataaatacggacctcggtgtaacaaaaaatgcctgtgcgttcacggaacatgcaataacaggatagacagcgatggggcctgcctcactggcacatgcagagacggctctgccgggagactctgtgataagcagacctcagcctgtgggccctacgtgcagttctgtcacatccacgccacctgtgaatacagcaatgggacagccagttgtatttgcaaagcaggatatgaaggagatggaactctgtgttctgagatggacccttgcacaggactaactccaggaggctgtagccgcaatgcagaatgcatcaaaactggcacgggcacccacacctgcgtgtgtcagcagggttggacagggaatgggagagactgctcggagatcaacaactgcctgctgcccagtgcaggcggctgccacgacaacgcatcctgtttgtatgtgggtcccgggcagaatgagtgtgagtgcaagaaaggatttcgaggaaatgggattgactgtgaaccaataacttcatgcttggaacaaaccgggaaatgtcatccattggcaagctgtcaatctacttcgtctggtgtctggagctgtgtttgtcaagagggctatgaaggagatggctttctgtgctatggaaacgcagcagtggaattgtcatttctctccgaagcagctatatttaaccgatggataaataatgcttctctacaacccacactgtcagccacctcaaacctcactgtcctcgtgccttcccaacaagctactgaggacatggaccaggatgagaaaagcttctggttgtcacagagcaatattccagccctaataaagtaccatatgctactaggcacatacagagtggcagatctgcagaccctgtcttcttctgacatgttggcaacatctttgcagggcaacttccttcacttggcaaaggtggatgggaatatcacaattgaaggggcctccattgtcgatggggacaacgcagccacaaatggagtgatacacatcatcaacaaggtgctggtcccacaaagacgtctaactggctccttaccaaacctgctcatgcggctggaacagatgcctgactattccatcttccggggctacatcattcaatataatctggcgaatgcaattgaggctgccgatgcctacacagtgtttgctccaaacaacaatgccatcgagaattacatcagggagaagaaagtcttgtctctagaggaggacgtcctccggtatcatgtggtcctggaggagaaactcctgaagaatgacctgcacaatggcatgcatcgtgagaccatgctgggtttctcctatttccttagcttctttctccataatgaccagctctatgtaaatgaggctccaataaactacaccaatgtagccactgataagggagtgatccatggcttgggaaaagttctggaaattcagaagaacagatgtgataataatgacactactattatacgaggaagatgtaggacatgctcctcagagctgacctgcccattcggaactaaatctctaggtaatgagaagaggagatgcatctatacctcctatttcatgggaagacgaaccctgtttattgggtgccagccaaaatgtgtgagaaccgtcattacgagagaatgctgtgccggcttctttggcccccaatgccagccctgcccagggaatgcccagaatgtctgctttggtaatggcatctgtttggatggagtgaatggcacaggtgtgtgtgagtgtggggagggcttcagcggcacagcctgcgagacctgcaccgagggcaagtacggcatccactgtgaccaagcatgttcttgtgtccatgggagatgcaaccaaggacccttgggagatggctcctgtgactgtgatgttggctggcgaggagtgcattgtgacaatgcaaccacagaagacaactgcaatgggacatgccataccagcgccaactgcctcaccaactcagatggtacagcttcatgcaagtgtgcagcaggattccaaggaaacgggaccatctgcacagcaatcaatgcctgtgagatcagcaatggaggttgctctgccaaggctgactgtaagagaaccaccccaggaaggcgagtgtgcacgtgcaaagcaggctacacgggtgatggcattgtgtgcctggaaatcaacccgtgtttggagaaccatggtggctgtgacaagaatgcggagtgcacacagacaggacccaaccaggctgcctgtaactgtttgccagcatacactggagatggaaaggtctgcacactcatcaatgtctgcttaactaaaaatggcggctgtagtgaatttgccatctgcaaccacactgggcaagtagaaaggacttgtacttgcaagccaaactacattggagatggatttacctgccgcggcagcatttatcaggagcttcccaagaacccgaaaacttcccagtatttcttccagttgcaggagcatttcgtgaaagatctggtcggcccaggccccttcactgtttttgcacctttatctgcagcctttgatgaggaagctcgggttaaagactgggacaaatacggtttaatgccccaggttcttcggtaccatgtggtcgcctgccaccagctgcttctggaaaacctgaaattgatctcaaatgctacttccctccaaggagagccaatagtcatctccgtctctcagagcacggtgtatataaacaataaggctaagatcatatccagtgatatcatcagtactaatgggattgttcatatcatagacaaattgctatctcccaaaaatttgcttatcactcccaaagacaactctggaagaattctgcaaaatcttacgactttggcaacaaacaatggctacatcaaatttagcaacttaatacaggactcaggtttgctgagtgtcatcaccgatcccatccacaccccagtcactctcttctggcccaccgaccaagccctccatgccctacctgctgaacaacaggacttcctgttcaaccaagacaacaaggacaagctgaaggagtatttgaagtttcatgtgatacgagatgccaaggttttagctgtggatcttcccacatccactgcctggaagaccctgcaaggttcagagctgagtgtgaaatgtggagctggcagggacatcggtgacctctttctgaatggccaaacctgcagaattgtgcagcgggagctcttgtttgacctgggtgtggcctacggcattgactgtctgctgattgatcccaccctggggggccgctgtgacacctttactactttcgatgcctcgggggagtgtgggagctgtgtcaatactcccagctgcccaaggtggagtaaaccaaagggtgtgaagcagaagtgtctctacaacctgcccttcaagaggaacctggaaggctgccgggagcggtgcagcctggtgatacagatccccaggtgctgcaagggctacttcgggcgagactgtcaggcctgccctggaggaccagatgccccgtgtaataaccggggtgtctgccttgatcagtactcggccaccggagagtgtaaatgcaacaccggcttcaatgggacggcgtgtgagatgtgctggccggggagattcgggcctgattgtctgccctgtggctgctcagaccacggacagtgcgatgatggcatcacgggctccgggcagtgcctctgtgaaacggggtggacaggcccctcgtgtgacactcaggcagttttgcctgcagtgtgtacgcctccttgttctgctcatgccacctgtaaggagaacaacacgtgtgagtgtaacctggattatgaaggtgacggaatcacatgcacagttgtggatttctgcaaacaggacaacgggggctgtgcaaaggtggccagatgctcccagaagggcacgaaggtctcctgcagctgccagaagggatacaaaggggacgggcacagctgcacagagatagacccctgtgcagacggccttaacggagggtgtcacgagcacgccacctgtaagatgacaggcccgggcaagcacaagtgtgagtgtaaaagtcactatgtcggagatgggctgaactgtgagccggagcagctgcccattgaccgctgcttacaggacaatgggcagtgccatgcagacgccaaatgtgtcgacctccacttccaggataccactgttggggtgttccatctacgctccccactgggccagtataagctgacctttgacaaagccagagaggcctgtgccaacgaagctgcgaccatggcaacctacaaccagctctcctatgcccagaaggccaagtaccacctgtgctcagcaggctggctggagaccgggcgggttgcctaccccacagccttcgcctcccagaactgtggctctggtgtggttgggatagtggactatggacctagacccaacaagagtgaaatgtgggatgtcttctgctatcggatgaaagatgtgaactgcacctgcaaggtgggctatgtgggagatggcttctcatgcagtgggaacctgctgcaggtcctgatgtccttcccctcactcacaaacttcctgacggaagtgctggcctattccaacagctcagctcgaggccgtgcatttctagaacacctgactgacctgtccatccgcggcaccctctttgtgccacagaacagtgggctgggggagaatgagaccttgtctgggcgggacatcgagcaccacctcgccaatgtcagcatgtttttctacaatgaccttgtcaatggcaccaccctgcaaacgaggctgggaagcaagctgctcatcactgccagccaggacccactccaaccgacggagaccaggtttgttgatggaagagccattctgcagtgggacatctttgcctccaatgggatcattcatgtcatttccaggcctttaaaagcaccccctgcccccgtgaccttgacccacactggcttgggagcagggatcttctttgccatcatcctggtgactggggctgttgccttggctgcttactcctactttcggataaaccggagaacaatcggcttccagcattttgagtcggaagaggacattaatgttgcagctcttggcaagcagcagcctgagaatatctcgaaccccttgtatgagagcacaacctcagctcccccagaaccttcctacgaccccttcacggactctgaagaacggcagcttgagggcaatgaccccttgaggacactgtgagggcctggacgggagatgccagccatcactcactgccacctgggccatcaactgtgaattctcagcaccagttgccttttaggaacgtaaagtcctttaagcactcagaagccatacctcatctctctggctgatctgggggttgtttctgtgggtgagagatgtgttgctgtgcccacccagtacagcttcctcctctgaccctttggctcttcttcctttgtactcttcagctggcacctgctccattctgccctacatgatgggtaactgtgatctttcttccctgttagattgtaagcctccgtctttgtatcccagcccctagcccagtgcctgacacaggaactgtgcacaataaaggtttatggaacagaaacaaagtcaacag

SEQ ID NO: 186587 - DNA, 499 bp, Homo sapiens
  Payload ID: 16741
  Gene Symbol: STAB2
  Gene Name: stabilin 2
  ENST ID: ENST00000552777
  CDS Start-End: 1-408
gaggacattaatgttgcagctcttggcaagcagcagcctgagaatatctcgaaccccttgtatgagagcacaacctcagctcccccagaaccttcctacgaccccttcacgatgaagaaactgcagccgagttgggatgatttgtcttgggccacccagcttcaagcaggagagactaaaacaggtggccctacccccagcccatcctgcctcccaacacaaggcagcagcacaaacaaacacgcccagcacatacgtgttcacagtgctcagggagagtcatgcctcagaccagtggccaccagaaagattcaactaggactcaacacacagaatgccctgcccccttacaaccctctcttttccaggactctgaagaacggcagcttgagggcaatgaccccttgaggacactgtgagggcctggacgggagatgccagccatcactcactgccacctgggccatcaactgtgaattctcagcaccagttgcctttt

SEQ ID NO: 186588 - DNA, 310 bp, Homo sapiens
  Payload ID: 16741
  Gene Symbol: STAB2
  Gene Name: stabilin 2
  ENST ID: ENST00000549474
  CDS Start-End: 1-102
cagaagaacagatgtgataataatgacactactattatacgaggaagatgtaggacatgctcctcagagctgacctgcccattcggaactaaatctctatagccagttgaggaccgcagcaagaaatcttgtcagagaagagagattccatatccaaaaccatatccagcctggatatattccacctgcctgatttccttttatagttgaagttgcaactaactttctcaaagaaacagatggcagggtaatgagaagaggagatgcatctatacctcctatttcatgggaagacgaaccctgtttattg

SEQ ID NO: 186589 - DNA, 1727 bp, Homo sapiens
  Payload ID: 16742
  Gene Symbol: SAXO1
  Gene Name: stabilizer of axonemal microtubules 1
  ENST ID: ENST00000380530
  CDS Start-End: 346-567
cacagaggctacctgggcacggaccccgcagcttcctggggcccagtcagccgctccaggtgcttaagtctggactgcggaggccggggcggtggcgtgcagggtgaggtctcccgggctggcgcgcgtgcaagccccctgctgctacctcgcgctaggccagctccaggagggcaacagacgacaggacattgcaaaagggccacttaaattttccttcgagtaaacagaacacctgccaagaccctcgagcctgggcgtgccccaagacaggtggttggggtctaggagtcggctgcagctggcgatgctctgaggggacgtcagggcctcaggatcgcccctatgaagacgaagtgcatctgtgaactgtgctcctgcgggcggcatcactgtccacatctccctaccaagatttatgataaaacagagaaaccatgtcttctctccgaatataccgagaactaccctttctatcactcctacctgcccagagagtccttcaagccaaggcgggagtaccagaaagggcctataccaatggaaggcctgactacatcaagctgattatttgccttggaaccaaccaaggcgagagccacttcgtctggaacacaaataccagccggcatcagtcaggtttgataacagaaccacacaccaggacgattaccccataaaaggccttgtgaagaccataagctgtaaacctctggccatgccaaagctctgtaacatccccttggaggatgtgactaactacaagatgagctatgtggcccaccccgtggagaagcgctttgtgcatgaagcagagaagttcaggccctgtgaaatcccctttgaaagccttaccactcaaaaacaatcctaccggggcctgatgggggagcctgccaagagcttgaaacctctagccaggcctcctgggctagacatgcctttctgtaacaccactgagtttcgagataagtaccaagcttggccaatgccccggatgttctccaaagctcccatcacctacgtccctcccgaagacaggatggatcttctgacaacagtgcaggcccattacacatgccctaagggtgccccagctcagtcctgccgacctgcacttcagattaagaagtgcggtcgctttgaaggctcttccaccaccaaggatgactacaagcagtggtccagcatgcgcacagagccagtcaagcccgttccccagctggacttgcccaccgagcccctggactgcctgaccaccactcgggcccactatgtgccccacctgcctatcaataccaaaagctgtaagcctcattggtctggccctcgaggaaatgtccctgtggaaagccagaccacctacaccatcagctttactcccaaggaaatgggcaggtgcctagcttcatatcctgagcctcctggctacacctttgaggaagtggatgctttgggtcacaggatatacaaaccagtttcccaggcaggctctcagcagagcagccatctttctgtagatgattcagaaaaccccaaccagagggagttggaagtgttagcctgattttgaaaaatagtaatttagaaattacacagtacttttaaaagcagacaactgagaattatttgttggacaaaaaagaattccctaaaatgacaaaaaacaaaaaacaaaaaaccttcaccacttccagagcacttgaataaaatgagaatcacttgac

SEQ ID NO: 186590 - DNA, 2099 bp, Homo sapiens
  Payload ID: 16742
  Gene Symbol: SAXO1
  Gene Name: stabilizer of axonemal microtubules 1
  Uniprot ID: Q8IYX7
  ENST ID: ENST00000380534
  CDS Start-End: 281-1705
aagtctggactgcggaggccggggcggtggcgtgcagggtgaggtctcccgggctggcgcgcgtgcaagccccctgctgctacctcgcgctaggccagctccaggagggcaacagacgacaggacattgcaaaagggccacttaaattttccttcgagtaaacagaacacctgccaagaccctcgagcctgggcgtgccccaagacaggtggttggggtctaggagtcggctgcagctggcgatgctctgaggggacgtcagggcctcaggatcgcccctatgaagacgaagtgcatctgtgaactgtgctcctgcgggcggcatcactgtccacatctccctaccaagatttatgataaaacagagaaaccatgtcttctctccgaatataccgagaactaccctttctatcactcctacctgcccagagagtccttcaagccaaggcgggagtaccagaaagggcctataccaatggaaggcctgactacatcaaggagagattttgggcctcacaaagtggcaccagtgaaggtccaccagtatgaccagttcgtcccgagtgaagagaatatggatttgctcacgacgtataagaaagattacaatccctaccctgtctgtcgagtggaccccatcaaacctcgggacagtaaatatccatgtagcgacaagatggagtgtttgcctacttataaagctgattatttgccttggaaccaaccaaggcgagagccacttcgtctggaacacaaataccagccggcatcagtcaggtttgataacagaaccacacaccaggacgattaccccataaaaggccttgtgaagaccataagctgtaaacctctggccatgccaaagctctgtaacatccccttggaggatgtgactaactacaagatgagctatgtggcccaccccgtggagaagcgctttgtgcatgaagcagagaagttcaggccctgtgaaatcccctttgaaagccttaccactcaaaaacaatcctaccggggcctgatgggggagcctgccaagagcttgaaacctctagccaggcctcctgggctagacatgcctttctgtaacaccactgagtttcgagataagtaccaagcttggccaatgccccggatgttctccaaagctcccatcacctacgtccctcccgaagacaggatggatcttctgacaacagtgcaggcccattacacatgccctaagggtgccccagctcagtcctgccgacctgcacttcagattaagaagtgcggtcgctttgaaggctcttccaccaccaaggatgactacaagcagtggtccagcatgcgcacagagccagtcaagcccgttccccagctggacttgcccaccgagcccctggactgcctgaccaccactcgggcccactatgtgccccacctgcctatcaataccaaaagctgtaagcctcattggtctggccctcgaggaaatgtccctgtggaaagccagaccacctacaccatcagctttactcccaaggaaatgggcaggtgcctagcttcatatcctgagcctcctggctacacctttgaggaagtggatgctttgggtcacaggatatacaaaccagtttcccaggcaggctctcagcagagcagccatctttctgtagatgattcagaaaaccccaaccagagggagttggaagtgttagcctgattttgaaaaatagtaatttagaaattacacagtacttttaaaagcagacaactgagaattatttgttggacaaaaaagaattccctaaaatgacaaaaaacaaaaaacaaaaaaccttcaccacttccagagcacttgaataaaatgagaatcacttgactcagggaaaatgacatttaatcaccggctaattaactccccttaccttctcctttactgcatccccaccccgtttcaggtcctttactttgtgcttatggaatcaaagttggtctgtgagggtttctctgatccagatgtattttattaatttaatcattgtatgaactgacataatgattaacccttgccaagtatgaagcgccaaagaataaattttattttggggggaatg

SEQ ID NO: 186591 - DNA, 1923 bp, Homo sapiens
  Payload ID: 16742
  Gene Symbol: SAXO1
  Gene Name: stabilizer of axonemal microtubules 1
  ENST ID: ENST00000542071
  CDS Start-End: 304-1533
ctcgctccgccctccgtgcccgacgagccttgaaaagccgctgctctaatgaaacctaaccggggcggcgtgagccctaagatggaagggaagctcgaggacttcggtcttttgttctgttgcagctgggtttgctgttgctaggggcggcatcactgtccacatctccctaccaagatttatgataaaacagagaaaccatgtcttctctccgaatataccgagaactaccctttctatcactcctacctgcccagagagtccttcaagccaaggcgggagtaccagaaagggcctataccaatggaaggcctgactacatcaaggagagattttgggcctcacaaagtggcaccagtgaaggtccaccagtatgaccagttcgtcccgagtgaagagaatatggatttgctcacgacgtataagaaagattacaatccctaccctgtctgtcgagtggaccccatcaaacctcgggacagtaaatatccatgtagcgacaagatggagtgtttgcctacttataaagctgattatttgccttggaaccaaccaaggcgagagccacttcgtctggaacacaaataccagccggcatcagtcaggtttgataacagaaccacacaccaggacgattaccccataaaaggccttgtgaagaccataagctgtaaacctctggccatgccaaagctctgtaacatccccttggaggatgtgactaactacaagatgagctatgtggcccaccccgtggagaagcgctttgtgcatgaagcagagaagttcaggccctgtgaaatcccctttgaaagccttaccactcaaaaacaatcctaccggggcctgatgggggagcctgccaagagcttgaaacctctagccaggcctcctgggctagacatgcctttctgtaacaccactgagtttcgagataagtaccaagcttggccaatgccccggatgttctccaaagctcccatcacctacgtccctcccgaagacaggatggatcttctgacaacagtgcaggcccattacacatgccctaagggtgccccagctcagtcctgccgacctgcacttcagattaagaagtgcggtcgctttgaaggctcttccaccaccaaggatgactacaagcagtggtccagcatgcgcacagagccagtcaagcccgttccccagctggacttgcccaccgagcccctggactgcctgaccaccactcgggcccactatgtgccccacctgcctatcaataccaaaagctgtaagcctcattggtctggccctcgaggaaatgtccctgtggaaagccagaccacctacaccatcagctttactcccaaggaaatgggcaggtgcctagcttcatatcctgagcctcctggctacacctttgaggaagtggatgctttgggtcacaggatatacaaaccagtttcccaggcaggctctcagcagagcagccatctttctgtagatgattcagaaaaccccaaccagagggagttggaagtgttagcctgattttgaaaaatagtaatttagaaattacacagtacttttaaaagcagacaactgagaattatttgttggacaaaaaagaattccctaaaatgacaaaaaacaaaaaacaaaaaaccttcaccacttccagagcacttgaataaaatgagaatcacttgactcagggaaaatgacatttaatcaccggctaattaactccccttaccttctcctttactgcatccccaccccgtttcaggtcctttactttgtgcttatggaatcaaagttggtctgtgagggtttctctgatccagatgtattttattaatttaatcattgtatgaactgacataatgattaacccttgccaagtatgaagcgccaaagaataaattttattttgggggg

SEQ ID NO: 186592 - DNA, 3134 bp, Homo sapiens
  Payload ID: 16743
  Gene Symbol: SAXO2
  Gene Name: stabilizer of axonemal microtubules 2
  Uniprot ID: Q658L1
  ENST ID: ENST00000339465
  CDS Start-End: 70-1266
ttgccttgactacggcgggcgctgtgggagtggagaagctgcaagtgctgaggcgcggtggaggaaagcatgggagccaagagtatgaggagctggtgtctgtgtcagatttgtagctgcgggtcggattattgtccttatgaaatagttaaacagcctcgccatgtgccagaagaatataaaccaaaacaagggaagattgatcttggtactacctacaaacgggatttgaattcgtataaagtgcagcctgtggcaatagtccggcctttggagagacaagttaaaaaaggaaaattggacactgtcccaacctataaagacgattatagagcttgggaccttcataaaagtgaactttataagccagaacaaacttaccacccgcctactgtgaaatttggaaattcaactacatttcaggatgattttgttcctcaggagataaagcctaggcaaagctttaaaccctcctctgtggtcaaacgttctacagccccttttaatggtattacaagtcatcgccttgattatatacctcatcagcttgaactcaagtttgaaaggccaaaagaagtttacaaaccaactgaccaacgctttgaggatctcacaactcaccggtgtgactttcagggtctcattggtgaaactgcaaaactctgcagacctgtacacaccagagtgacccagaatgctctgtttgaaggaagcactgaattccgtgaaagttttcaaccatgggaaatcccaccacctgaggtcaagaaagtaccagagtatgtgcctcctacaggtagcatgctgttaaacagcacaagccatcttgactatgttccatatcaggccaaccatgttgttcccatcaggccagtttctcaaaaaagaagtaacaattttcctttccaaggaaaaagcatcatgaaagaagattttccagcatgggaaagttgtcgtcaaggacttattaagaagcagcagcagattcccaacccatctggaaaatttgatggtttgagcactttcagatctcactatgtgccacatgaattgatcccaacagagagttgcaaacctttaaatattgcttttaagagttctgttccatttgatgatgtaaccatgtactctgtagagtacacaccgaaaagacaggaaatttgcccagccagctatccctctcctccaggttatattttcgacaatacaaattcccaaggtcataaattcttccgcaagattattcctgcagtgaaggccttctaataaccaaaatgtgcttaaaaggaaggtactagcaagttgttgtttttccaagagaaaactcaatttttatagttaaaaaatttatgatataataaatcattttttatatttttaaacaagaaaattggaaaatatattataagaaatcagaatcttaaaaccattttttattgatattttaatcaagattgttctttaatgtgcatttcagaaggttgaataatatgcattcccatgagaactattttagtattcaacatactgcttagtagcttgtccccagtctattatcatttgtaattctgtttataattatggcaattgtatggttattcacataccatttgtcatttatcaagcacatcaggattatctagaacaacattgaaaatgatacatggattcctcttccaaggcaacaggattcattatactcagacttcacggcatctacatagcatccactgaatcaagttttggttggtggtatacagactgctgcactgctcctcaccatgttcaagttagcaagaggcactgtggtgtggcaaggaaaggctctgtgtgctgggaatcgaaggacttgagttcaagttctgactaataattattattatttttagagacagggtctcactgtcacccgtgctggagtccagtggcataatcacagcttactgcagcctcagcctcctgagctcaagtgatcctcctgcctcagcctcccaaatagctgggactacaagggtgtgccaccacacctggctattttttttaaacatactttgtagagacaggttcttgctgtattagtcaggctgttcaatctattggccaggctgctattgaatcccaccttggcttcccaaagcactgggattacaggcatgagccactatacccaacctgagtttaagttctaataatatagatttctatttgtactaccttaggcagtgactcatatctctgagcctcagtgtctttatttgtaaaatgatgtctgttctcaaaaagagtttgttttgagcatcagactgtatggtacattttaatccttaaagtacaaatgtggaggatttttttttaaaattgctcaatctctttttgtacttgttttctccttttcaaattaggataattacttactcaatgctcattttctggcctgtagcaaggattgtaaaataacctaatttgctttgagcttatgagtagtatatacttctgagaggagtcttgtcctttaaaacttcatgagcacctgagaaattcttaacagagaatggaaagcttggaatggggtaaatacagtggtttgaataacagtatttgcagaaaggaaaaagtattatttgctagggtagttttaggaagactgacagctctgaagaaatctttagggtaaatgtaggtaattttgcacctaattgccaggccaagtcactgtttagaggaagaaccagccccagcagggggcataatcacctggttcacctcttccggtgtgaagataagtgataaggtaaagaatgatgccagtaagtatagtagaaacactctattgcatttataaatgctaaaaatttccgaatgaattaaactcttattgggtggtttctttttttaaaaaaattaaataattgcattatgggagaatatgatttattttagcataaagtgaattttagtcttttatggcttcagaattatttcaaaatatactttattgaaaatcaatatttggttattttaattgttcaaaagtaatttgttctttacatttattagtaaaagtatggtgtgtgaaactatatttccatgcaacataataaaatcaataaaaggaatggattttcaagaaatca

SEQ ID NO: 186593 - DNA, 340 bp, Homo sapiens
  Payload ID: 16743
  Gene Symbol: SAXO2
  Gene Name: stabilizer of axonemal microtubules 2
  ENST ID: ENST00000566205
  CDS Start-End: 71-160
gttgccttgactacggcgggcgctgtgggagtggagaagctgcaagtgctgaggcgcggtggaggaaagcatgggagccaagagtatgaggagctggtgtctgtgtcagatttgtagctgcggaccaggactgacaagggagccactgcctctgccataatcagaaaattgcaacagagctgtagactccagaatcactcgtctcttccaaggtcaagaagctgccaagttaggaaaccagcttgcaaatcaagatgccgcctaacaacttctagctccaatctcttgttgcctctattatgttccatgcaagcaaaataaatgttgtgccttgactctc

SEQ ID NO: 186594 - DNA, 551 bp, Homo sapiens
  Payload ID: 16743
  Gene Symbol: SAXO2
  Gene Name: stabilizer of axonemal microtubules 2
  ENST ID: ENST00000569120
  CDS Start-End: 460-551
gactacggcgggcgctgtgggagtggagaagctgcaagtgctgaggcgcggtggaggaaagcatgggagccaagagtatgaggagctggtgtctgtgtcagatttgtagctgcgggtaagaaacggctggtgtagcggcgggcccgggcttgggagccgacctagggcctaggtgcacggagccggctcctcgggaaccctgagagtggccgtcccccggagatgaagggacgagggcgcagcgacatccccacttatcccgctccgcgaatactcgctcctcacccgcctgctacccgggggtaaaacgtttgttcgtagcccctgagactcccaatcaaggatgcaaagtaaaatgccacccgggccaggcgacatcattgtccacgtggaaccacaaggatttatgaaaattctggggtgttttgccctacaactgaatatttggaaaaatatcctatgtatgacaatgttcttccacctcagagtcttaaagccaagcaagaaattcgagcatgccatggtaaaatggaaggaataactacatttaa

SEQ ID NO: 186595 - DNA, 404 bp, Homo sapiens
  Payload ID: 16743
  Gene Symbol: SAXO2
  Gene Name: stabilizer of axonemal microtubules 2
  ENST ID: ENST00000566861
  CDS Start-End: 55-180
cgggcgctgtgggagtggagaagctgcaagtgctgaggcgcggtggaggaaagcatgggagccaagagtatgaggagctggtgtctgtgtcagatttgtagctgcggctttctgtcctcccagccagaccatattcccattcccgtccaggcagcagttctttgggatccgcctgactgaaaagtcaaccaggactgacaagggagccactgcctctgccataatcagaaaattgcaacagagctgtagactccagaatcactcgtctcttccaaggtcaagaagctgccaagttaggaaaccagcttgcaaatcaagatgccgcctaacaacttctagctccaatctcttgttgcctctattatgttccatgcaagcaaaataaatgttgtgccttgactctc

SEQ ID NO: 186596 - DNA, 811 bp, Homo sapiens
  Payload ID: 16743
  Gene Symbol: SAXO2
  Gene Name: stabilizer of axonemal microtubules 2
  ENST ID: ENST00000565432
  CDS Start-End: 228-542
agaagctgcaagtgctgaggcgcggtggaggaaagcatgggagccaagagtatgaggagctggtgtctgtgtcagatttgtagctgcggcccctgagactcccaatcaaggatgcaaagtaaaatgccacccgggccaggcgacatcattgtccacgtggaaccacaaggatttatgaaaattctggggtgttttgccctacaactgaatatttggaaaaatatcctatgtatgacaatgttcttccacctcagagtcttaaagccaagcaagaaattcgagcatgccatggtaaaatggaaggaataactacatttaagtcggattattgtccttatgaaatagttaaacagcctcgccatgtgccagaagaatataaaccaaaacaagggaagattgatcttggtactacctacaaacgggatttgaattcgtataaagtgcagcctgtggcaatagtccggcctttggagagacaagttaaaaaaggaaaattggacactgtcccaacctataaaggtaacttgctgtttcatacatgaaggagccaaaaaactaaaactcacttccagctttaacatctaatatcaaattataactttggtgtgctgccaaacttagcctccatggcttaggaaagaacatttctctctttggcaaaatagtattgtatagtaacaaaagaaaataggccatttgtctgattgagtggtaaaagacccacaatcccatccaaattcatctactttgttagttttctgtctcaaaacatgaaaaacaaaggatgccattaaagaagcattatgtcaca

SEQ ID NO: 186597 - DNA, 6277 bp, Homo sapiens
  Payload ID: 16744
  Gene Symbol: STAMBP
  Gene Name: STAM binding protein
  Uniprot ID: O95630
  ENST ID: ENST00000339566
  CDS Start-End: 94-1368
atagacagacgaacgggagtgggcggagcgggcgccggatgtgacgtttccggaacctccgggtgtcatccgcggggaaagaacttggtcctgatgtctgaccatggagatgtgagcctcccgcccgaagaccgggtgagggctctctcccagctgggtagtgcggtagaggtgaatgaagacattccaccccgtcggtacttccgctctggagttgagattatccgaatggcatccatttactctgaggaaggcaacattgaacatgccttcatcctctataacaagtatatcacgctctttattgagaaactaccaaaacatcgagattacaaatctgctgtcattcctgaaaagaaagacacagtaaagaaattaaaggagattgcatttcccaaagcagaagagctgaaggcagagctgttaaaacgatataccaaagaatatacagaatataatgaagaaaagaagaaggaagcagaggaattggcccggaacatggccatccagcaagagctggaaaaggaaaaacagagggtagcacaacagaagcagcagcaattggaacaggaacagttccatgccttcgaggagatgatccggaaccaggagctagaaaaagagcgactgaaaattgtacaggagtttgggaaggtagaccctggcctaggtggcccgctagtgcctgacttggagaagccctccttagatgtgttccccaccttaacagtctcatccatacagccttcagactgtcacacaactgtaaggccagctaagccacctgtggtggacaggtccttgaaacctggagcactgagcaactcagaaagtattcccacaatcgatggattgcgccatgtggtggtgcctgggcggctgtgcccacagtttctccagttagccagtgccaacactgcccggggagtggagacatgtggaattctctgtggaaaactgatgaggaatgaatttaccattacccatgttctcatccccaagcaaagtgctgggtctgattactgcaacacagagaacgaagaagaacttttcctcatacaggatcagcagggcctcatcacactgggctggattcatactcaccccacacagaccgcgtttctctccagtgtcgacctacacactcactgctcttaccagatgatgttgccagagtcagtagccattgtttgctcccccaagttccaggaaactggattctttaaactaactgaccatggactagaggagatttcttcctgtcgccagaaaggatttcatccacacagcaaggatccacctctgttctgtagctgcagccacgtgactgttgtggacagagcagtgaccatcacagaccttcgatgagcgtttgagtccaacaccttccaagaacaacaaaaccatatcagtgtactgtagccccttaatttaagctttctagaaagctttggaagtttttgtagatagtagaaaggggggcatcacctgagaaagagctgattttgtatttcaggtttgaaaagaaataactgaacatattttttaggcaagtcagaaagagaacatggtcacccaaaagcaactgtaactcagaaattaagttactcagaaattaagtagctcagaaattaagaaagaatggtataatgaacccccatatacccttccttctggattcaccaattgttaacatttttttcctctcagctatccttctaatttctctctaatttcaatttgtttatatttacctctgggctcaataagggcatctgtgcagaaatttggaagccatttagaaaatcttttggattttcctgtggtttatggcaatatgaatggagcttattactggggtgagggacagcttactccatttgaccagattgtttggctaacacatcccgaagaatgattttgtcaggaattattgttatttaataaatatttcaggatatttttcctctacaataaagtaacaattaacttatgtttttgtgcttcagagtgatccatttgatcaagcattgtataaacaggttaaaaaaaaggtatggttgttttggaaaggtgaaggaaaaatggaatttgagatatactgacactgatggtgtgtcccagttcacttttaattactccttgttttttatctgcctgttgccatcttccagaggtgttgtgaagtcatctctgttcttttggtgctgtctcaaatgggtcaaccattcacttcctccttatgccctccatgcttttggctgaggataatgaagcctttgtttggagtaccaggttacactccaataaatgattacatttcccagccaccccaccctaccaatttcattgtgttggctgttcttttctgactaaggcaatacctaggaaaacgcttgaagcagcaattgttactgcaattttctgtgagctgagcctggtgttctaggtggcctagaaataatggtgtcatttgtgacacctcgagtgagggcaggagagtaaatactttggctaggagaagagtgatttattctttatcagaattctaggtgggggagggagaatctgtgaatgcataaagttttcttcatttttaaattttgtctcagtctttattgcttaggttagtggtccttgaacttgtcccctgaaagagcccagttctctatattctttttcttctcttgggttcttaattccccatatagtggaaattccttctttgctgttttggtatgggtgggtctgggggccagctgggcttggacaagccatttcctgctgcagcccagagcagcctggctgttccaccttgctctaaacagtcctgaaattgcccagtcctctgcttttgggaaatccatccccttcttcccattctttgtctaccacttagcttagggctttcttaccttttatttcgactgtagccgttggcttttaccaagtctctttgtttttagcatttcttcattccagtctgttctgcacactttgatcaggagaagcttctcacattccagccatgttcatgttttctctcttgctcaaaaacctgcaatagcttcccattgctgaaaatctaaatttagcttttagtcagaactttccacttaaagttcttacccctggctatatattcaaatatctagggagcaatttaaaaaatactgatgcctgtgttctaccccccaccaattaaagctgaatctctagggtggagcctcagatgttgtttctgcatttgtctttcaagctgctagaattctcaagtacaaccagggttgacaaccactgcattggtctttgatacctaagaattgtgagctctcttatccgtctctgcccaccaaagacattcagccaggtcaacaacatatcatacgttgcaaccacattgatcacagactgatcaccaaactgctatattttcttttctcttcctctaggcacaagatatcttagtggctagatgggtgcaggaaatcagtctgtagatccctcttcatatctgctgcagcctagccactgcagaggcactctgcataggatggtctaagtgtctctgtcttcatcttacctctgtggaggagacgtggaatcaagccagcccacaagccctgagactggataggccggagagaaagaggagtagccagagcggtcgggaaaagaggaaaggaatactgtgggtaaaagggacaaagaccacgcaacctgaggaaagacattgtattgaaagggtaatgactatttggctaaagggactgactcctgggttcccgaggctcaaagaccaggagacttttccactcttgcaagctgcacaagtaccatacttagtgttctgggctgagaggggagacaaaagcatcgtcaggttgccaaacaatgtcccagttgccctgggaggcacaaacctaccaaagtgccataggccaggtgcagagagaatcagaggagctgatttgcttggggtcagagcagagctgggttttttcagatgatcactttcacatactccttgttaaatgggaccaaaggggaagaagaagaaacccttaagcttttgtaatattgtcttgggtaccagataccataaaaggcagcatgagagaaacattcccttgggccagtgtcatggtggattttcttgcttgagaggcaaggatttcagctttcatttggtaccacagaatttaaaattgtaagtgcctatcccttttgactgttgatggcttctttggggttttagttaccccagttgaaagagaaatttttcatattggggttgagaagaatggaggctattaggagcaaagctttaatgagtgaaagtctggtgaatcctgcaattttgatatgtttccagtggattttgagaacacagttttaggaccagagtagatgttgttccctagaaaatagagtcagctattgatattgtgcctcccatccctcatatctcagtgttttaaccccacctgagtttggagaccagtttgtccaaggatctttcaaacatgtgagcccagagtagaacttctgagtcaaggatcatgtctttttctgaggagctttgcttggggcactggaaatcctgtttagatcaggactattggaatattatcctctccaggggaagtgccaggttgaacatttaaggctttgcttctaggcccagctatacattcaccagcaaatcacttaacttcctaaatttctttaaaatctgtaaaatgggatcagtctaatatgcctacctcaaatgatgacagaatgacatctatatgcatatgaggcctacgttagttgaaagatgctataaagatataagggatttgttacttgtctttcttgaaatgttacagttggggtgcggttgcttctatcttctggacctctgcccattcagcatacagctagaggaatctttgggcagatccacattctttagcactagctaggctttgactccaaagctatctggtctaccttgatgttctgagcaggaaaactgaggacctcaagaaccattccaaatttctactcattctccctaagacccagagcagacccaggacctaaagaaattacatcatctctattttcccttggctccagcccactcttgtttgaacctcccacttttgttgttccaactacttcttgagatgaaggaagggcagaacattggccctcttcactgaagtcttcaccccttaatccagggttcaatttttagttcaccttagcctgtttgagattagaagctgggccttaacttacaggtgtgtccggcatcattcaatcagcctgttagatccagaatccagcactgtgacgctacataaccatgggctctgtccttccagttcctttagtgccttccctcactggtaggttcactctgagggcttccttccttgaactccagtggcaactatagtctgtttcccacaatttgttgtgtgtgttttttgttgttttgcagcgttttcatattgtcttttatgtaagtcatgtttctgaactatcgtataaatttcattagggtaagaatcatgtttgctttatgcactgtgtaacatgccttgcagtcagtataggcacttaaccttattgatcagttgttccttggtgttgaataatgtgttaggtagccaggtggacctgtgtcctagcctggagaagctctatgtcaccttgtaggaagccatctgaatttgactcagcatcatatgctgggcctgtgctgcacttgagctttctttccagccgccaggagggatggttgtcctggccaacagcgaatttaatgggtggtcaaaagaagatgtgcctgcatagaaggctgaaagagggagctggaagtaggaggagacaaggagatagtgacaccagtatcttgtcacagaaatcaaggaaggcaacagtttaaaggaggggagggagatcagtggtgccaactggctcagaagaggtttgctgggttaaatctcaagatgagcccatgagatctggtggttagcagaggcctttcctgacaaccccattttaagcacctcttccccatcactctatctcatcactgttactgtctgtgtagccctgtcatgagctaaaatcatcctgtttgtttattgctagcttatgtgtctaaagtatactccttgagaacagcaactttgtctttttcacctttgtactgagtcccctgacatggaataagatatgaataaatgcacagacttgtccaaaatcatccaattaa

SEQ ID NO: 186598 - DNA, 6691 bp, Homo sapiens
  Payload ID: 16744
  Gene Symbol: STAMBP
  Gene Name: STAM binding protein
  Uniprot ID: O95630
  ENST ID: ENST00000394070
  CDS Start-End: 504-1778
ggtggggcagggcctccgagcgtggttggactttgaaggggatcggccgccgtgagtgtggggcctgcagcctactctccccgagtcccctgcccggcctgcctcgctcgaggcacccgacggcttctgtctccgcgggctggcgcctgaccagccaggcccagcggttccccgcctactgcatttgaaagatcccgaaaaccctggatgattgtgcctggggttggcaagttcgtcttgagtgccttcaagaagggttcctcaagcagttgtcgatagagccctccctactgtatacgccccctccgctcattcctgctacttcctttctcctcctcgtatttccccctcggtcctttacgccgcctttccccctcatttgcagatgctgcatcccctttttggaattgctcaaccaggtggtaaccggcgccgcttcctggccttgggaggtggttcctttcttaacccacaagaacctctcccaagagaacttggtcctgatgtctgaccatggagatgtgagcctcccgcccgaagaccgggtgagggctctctcccagctgggtagtgcggtagaggtgaatgaagacattccaccccgtcggtacttccgctctggagttgagattatccgaatggcatccatttactctgaggaaggcaacattgaacatgccttcatcctctataacaagtatatcacgctctttattgagaaactaccaaaacatcgagattacaaatctgctgtcattcctgaaaagaaagacacagtaaagaaattaaaggagattgcatttcccaaagcagaagagctgaaggcagagctgttaaaacgatataccaaagaatatacagaatataatgaagaaaagaagaaggaagcagaggaattggcccggaacatggccatccagcaagagctggaaaaggaaaaacagagggtagcacaacagaagcagcagcaattggaacaggaacagttccatgccttcgaggagatgatccggaaccaggagctagaaaaagagcgactgaaaattgtacaggagtttgggaaggtagaccctggcctaggtggcccgctagtgcctgacttggagaagccctccttagatgtgttccccaccttaacagtctcatccatacagccttcagactgtcacacaactgtaaggccagctaagccacctgtggtggacaggtccttgaaacctggagcactgagcaactcagaaagtattcccacaatcgatggattgcgccatgtggtggtgcctgggcggctgtgcccacagtttctccagttagccagtgccaacactgcccggggagtggagacatgtggaattctctgtggaaaactgatgaggaatgaatttaccattacccatgttctcatccccaagcaaagtgctgggtctgattactgcaacacagagaacgaagaagaacttttcctcatacaggatcagcagggcctcatcacactgggctggattcatactcaccccacacagaccgcgtttctctccagtgtcgacctacacactcactgctcttaccagatgatgttgccagagtcagtagccattgtttgctcccccaagttccaggaaactggattctttaaactaactgaccatggactagaggagatttcttcctgtcgccagaaaggatttcatccacacagcaaggatccacctctgttctgtagctgcagccacgtgactgttgtggacagagcagtgaccatcacagaccttcgatgagcgtttgagtccaacaccttccaagaacaacaaaaccatatcagtgtactgtagccccttaatttaagctttctagaaagctttggaagtttttgtagatagtagaaaggggggcatcacctgagaaagagctgattttgtatttcaggtttgaaaagaaataactgaacatattttttaggcaagtcagaaagagaacatggtcacccaaaagcaactgtaactcagaaattaagttactcagaaattaagtagctcagaaattaagaaagaatggtataatgaacccccatatacccttccttctggattcaccaattgttaacatttttttcctctcagctatccttctaatttctctctaatttcaatttgtttatatttacctctgggctcaataagggcatctgtgcagaaatttggaagccatttagaaaatcttttggattttcctgtggtttatggcaatatgaatggagcttattactggggtgagggacagcttactccatttgaccagattgtttggctaacacatcccgaagaatgattttgtcaggaattattgttatttaataaatatttcaggatatttttcctctacaataaagtaacaattaacttatgtttttgtgcttcagagtgatccatttgatcaagcattgtataaacaggttaaaaaaaaggtatggttgttttggaaaggtgaaggaaaaatggaatttgagatatactgacactgatggtgtgtcccagttcacttttaattactccttgttttttatctgcctgttgccatcttccagaggtgttgtgaagtcatctctgttcttttggtgctgtctcaaatgggtcaaccattcacttcctccttatgccctccatgcttttggctgaggataatgaagcctttgtttggagtaccaggttacactccaataaatgattacatttcccagccaccccaccctaccaatttcattgtgttggctgttcttttctgactaaggcaatacctaggaaaacgcttgaagcagcaattgttactgcaattttctgtgagctgagcctggtgttctaggtggcctagaaataatggtgtcatttgtgacacctcgagtgagggcaggagagtaaatactttggctaggagaagagtgatttattctttatcagaattctaggtgggggagggagaatctgtgaatgcataaagttttcttcatttttaaattttgtctcagtctttattgcttaggttagtggtccttgaacttgtcccctgaaagagcccagttctctatattctttttcttctcttgggttcttaattccccatatagtggaaattccttctttgctgttttggtatgggtgggtctgggggccagctgggcttggacaagccatttcctgctgcagcccagagcagcctggctgttccaccttgctctaaacagtcctgaaattgcccagtcctctgcttttgggaaatccatccccttcttcccattctttgtctaccacttagcttagggctttcttaccttttatttcgactgtagccgttggcttttaccaagtctctttgtttttagcatttcttcattccagtctgttctgcacactttgatcaggagaagcttctcacattccagccatgttcatgttttctctcttgctcaaaaacctgcaatagcttcccattgctgaaaatctaaatttagcttttagtcagaactttccacttaaagttcttacccctggctatatattcaaatatctagggagcaatttaaaaaatactgatgcctgtgttctaccccccaccaattaaagctgaatctctagggtggagcctcagatgttgtttctgcatttgtctttcaagctgctagaattctcaagtacaaccagggttgacaaccactgcattggtctttgatacctaagaattgtgagctctcttatccgtctctgcccaccaaagacattcagccaggtcaacaacatatcatacgttgcaaccacattgatcacagactgatcaccaaactgctatattttcttttctcttcctctaggcacaagatatcttagtggctagatgggtgcaggaaatcagtctgtagatccctcttcatatctgctgcagcctagccactgcagaggcactctgcataggatggtctaagtgtctctgtcttcatcttacctctgtggaggagacgtggaatcaagccagcccacaagccctgagactggataggccggagagaaagaggagtagccagagcggtcgggaaaagaggaaaggaatactgtgggtaaaagggacaaagaccacgcaacctgaggaaagacattgtattgaaagggtaatgactatttggctaaagggactgactcctgggttcccgaggctcaaagaccaggagacttttccactcttgcaagctgcacaagtaccatacttagtgttctgggctgagaggggagacaaaagcatcgtcaggttgccaaacaatgtcccagttgccctgggaggcacaaacctaccaaagtgccataggccaggtgcagagagaatcagaggagctgatttgcttggggtcagagcagagctgggttttttcagatgatcactttcacatactccttgttaaatgggaccaaaggggaagaagaagaaacccttaagcttttgtaatattgtcttgggtaccagataccataaaaggcagcatgagagaaacattcccttgggccagtgtcatggtggattttcttgcttgagaggcaaggatttcagctttcatttggtaccacagaatttaaaattgtaagtgcctatcccttttgactgttgatggcttctttggggttttagttaccccagttgaaagagaaatttttcatattggggttgagaagaatggaggctattaggagcaaagctttaatgagtgaaagtctggtgaatcctgcaattttgatatgtttccagtggattttgagaacacagttttaggaccagagtagatgttgttccctagaaaatagagtcagctattgatattgtgcctcccatccctcatatctcagtgttttaaccccacctgagtttggagaccagtttgtccaaggatctttcaaacatgtgagcccagagtagaacttctgagtcaaggatcatgtctttttctgaggagctttgcttggggcactggaaatcctgtttagatcaggactattggaatattatcctctccaggggaagtgccaggttgaacatttaaggctttgcttctaggcccagctatacattcaccagcaaatcacttaacttcctaaatttctttaaaatctgtaaaatgggatcagtctaatatgcctacctcaaatgatgacagaatgacatctatatgcatatgaggcctacgttagttgaaagatgctataaagatataagggatttgttacttgtctttcttgaaatgttacagttggggtgcggttgcttctatcttctggacctctgcccattcagcatacagctagaggaatctttgggcagatccacattctttagcactagctaggctttgactccaaagctatctggtctaccttgatgttctgagcaggaaaactgaggacctcaagaaccattccaaatttctactcattctccctaagacccagagcagacccaggacctaaagaaattacatcatctctattttcccttggctccagcccactcttgtttgaacctcccacttttgttgttccaactacttcttgagatgaaggaagggcagaacattggccctcttcactgaagtcttcaccccttaatccagggttcaatttttagttcaccttagcctgtttgagattagaagctgggccttaacttacaggtgtgtccggcatcattcaatcagcctgttagatccagaatccagcactgtgacgctacataaccatgggctctgtccttccagttcctttagtgccttccctcactggtaggttcactctgagggcttccttccttgaactccagtggcaactatagtctgtttcccacaatttgttgtgtgtgttttttgttgttttgcagcgttttcatattgtcttttatgtaagtcatgtttctgaactatcgtataaatttcattagggtaagaatcatgtttgctttatgcactgtgtaacatgccttgcagtcagtataggcacttaaccttattgatcagttgttccttggtgttgaataatgtgttaggtagccaggtggacctgtgtcctagcctggagaagctctatgtcaccttgtaggaagccatctgaatttgactcagcatcatatgctgggcctgtgctgcacttgagctttctttccagccgccaggagggatggttgtcctggccaacagcgaatttaatgggtggtcaaaagaagatgtgcctgcatagaaggctgaaagagggagctggaagtaggaggagacaaggagatagtgacaccagtatcttgtcacagaaatcaaggaaggcaacagtttaaaggaggggagggagatcagtggtgccaactggctcagaagaggtttgctgggttaaatctcaagatgagcccatgagatctggtggttagcagaggcctttcctgacaaccccattttaagcacctcttccccatcactctatctcatcactgttactgtctgtgtagccctgtcatgagctaaaatcatcctgtttgtttattgctagcttatgtgtctaaagtatactccttgagaacagcaactttgtctttttcacctttgtactgagtcccctgacatggaataagatatgaataaatgcacagacttgtccaaaatcatccaattaataaa

SEQ ID NO: 186599 - DNA, 6386 bp, Homo sapiens
  Payload ID: 16744
  Gene Symbol: STAMBP
  Gene Name: STAM binding protein
  Uniprot ID: O95630
  ENST ID: ENST00000394073
  CDS Start-End: 203-1477
gcggggaaaggtggggaagggtcccgggaacgtggtggggcagggcctccgagcgtggttggactttgaaggggatcggccgccatgctgcatcccctttttggaattgctcaaccaggtggtaaccggcgccgcttcctggccttgggaggtggttcctttcttaacccacaagaacctctcccaagagaacttggtcctgatgtctgaccatggagatgtgagcctcccgcccgaagaccgggtgagggctctctcccagctgggtagtgcggtagaggtgaatgaagacattccaccccgtcggtacttccgctctggagttgagattatccgaatggcatccatttactctgaggaaggcaacattgaacatgccttcatcctctataacaagtatatcacgctctttattgagaaactaccaaaacatcgagattacaaatctgctgtcattcctgaaaagaaagacacagtaaagaaattaaaggagattgcatttcccaaagcagaagagctgaaggcagagctgttaaaacgatataccaaagaatatacagaatataatgaagaaaagaagaaggaagcagaggaattggcccggaacatggccatccagcaagagctggaaaaggaaaaacagagggtagcacaacagaagcagcagcaattggaacaggaacagttccatgccttcgaggagatgatccggaaccaggagctagaaaaagagcgactgaaaattgtacaggagtttgggaaggtagaccctggcctaggtggcccgctagtgcctgacttggagaagccctccttagatgtgttccccaccttaacagtctcatccatacagccttcagactgtcacacaactgtaaggccagctaagccacctgtggtggacaggtccttgaaacctggagcactgagcaactcagaaagtattcccacaatcgatggattgcgccatgtggtggtgcctgggcggctgtgcccacagtttctccagttagccagtgccaacactgcccggggagtggagacatgtggaattctctgtggaaaactgatgaggaatgaatttaccattacccatgttctcatccccaagcaaagtgctgggtctgattactgcaacacagagaacgaagaagaacttttcctcatacaggatcagcagggcctcatcacactgggctggattcatactcaccccacacagaccgcgtttctctccagtgtcgacctacacactcactgctcttaccagatgatgttgccagagtcagtagccattgtttgctcccccaagttccaggaaactggattctttaaactaactgaccatggactagaggagatttcttcctgtcgccagaaaggatttcatccacacagcaaggatccacctctgttctgtagctgcagccacgtgactgttgtggacagagcagtgaccatcacagaccttcgatgagcgtttgagtccaacaccttccaagaacaacaaaaccatatcagtgtactgtagccccttaatttaagctttctagaaagctttggaagtttttgtagatagtagaaaggggggcatcacctgagaaagagctgattttgtatttcaggtttgaaaagaaataactgaacatattttttaggcaagtcagaaagagaacatggtcacccaaaagcaactgtaactcagaaattaagttactcagaaattaagtagctcagaaattaagaaagaatggtataatgaacccccatatacccttccttctggattcaccaattgttaacatttttttcctctcagctatccttctaatttctctctaatttcaatttgtttatatttacctctgggctcaataagggcatctgtgcagaaatttggaagccatttagaaaatcttttggattttcctgtggtttatggcaatatgaatggagcttattactggggtgagggacagcttactccatttgaccagattgtttggctaacacatcccgaagaatgattttgtcaggaattattgttatttaataaatatttcaggatatttttcctctacaataaagtaacaattaacttatgtttttgtgcttcagagtgatccatttgatcaagcattgtataaacaggttaaaaaaaaggtatggttgttttggaaaggtgaaggaaaaatggaatttgagatatactgacactgatggtgtgtcccagttcacttttaattactccttgttttttatctgcctgttgccatcttccagaggtgttgtgaagtcatctctgttcttttggtgctgtctcaaatgggtcaaccattcacttcctccttatgccctccatgcttttggctgaggataatgaagcctttgtttggagtaccaggttacactccaataaatgattacatttcccagccaccccaccctaccaatttcattgtgttggctgttcttttctgactaaggcaatacctaggaaaacgcttgaagcagcaattgttactgcaattttctgtgagctgagcctggtgttctaggtggcctagaaataatggtgtcatttgtgacacctcgagtgagggcaggagagtaaatactttggctaggagaagagtgatttattctttatcagaattctaggtgggggagggagaatctgtgaatgcataaagttttcttcatttttaaattttgtctcagtctttattgcttaggttagtggtccttgaacttgtcccctgaaagagcccagttctctatattctttttcttctcttgggttcttaattccccatatagtggaaattccttctttgctgttttggtatgggtgggtctgggggccagctgggcttggacaagccatttcctgctgcagcccagagcagcctggctgttccaccttgctctaaacagtcctgaaattgcccagtcctctgcttttgggaaatccatccccttcttcccattctttgtctaccacttagcttagggctttcttaccttttatttcgactgtagccgttggcttttaccaagtctctttgtttttagcatttcttcattccagtctgttctgcacactttgatcaggagaagcttctcacattccagccatgttcatgttttctctcttgctcaaaaacctgcaatagcttcccattgctgaaaatctaaatttagcttttagtcagaactttccacttaaagttcttacccctggctatatattcaaatatctagggagcaatttaaaaaatactgatgcctgtgttctaccccccaccaattaaagctgaatctctagggtggagcctcagatgttgtttctgcatttgtctttcaagctgctagaattctcaagtacaaccagggttgacaaccactgcattggtctttgatacctaagaattgtgagctctcttatccgtctctgcccaccaaagacattcagccaggtcaacaacatatcatacgttgcaaccacattgatcacagactgatcaccaaactgctatattttcttttctcttcctctaggcacaagatatcttagtggctagatgggtgcaggaaatcagtctgtagatccctcttcatatctgctgcagcctagccactgcagaggcactctgcataggatggtctaagtgtctctgtcttcatcttacctctgtggaggagacgtggaatcaagccagcccacaagccctgagactggataggccggagagaaagaggagtagccagagcggtcgggaaaagaggaaaggaatactgtgggtaaaagggacaaagaccacgcaacctgaggaaagacattgtattgaaagggtaatgactatttggctaaagggactgactcctgggttcccgaggctcaaagaccaggagacttttccactcttgcaagctgcacaagtaccatacttagtgttctgggctgagaggggagacaaaagcatcgtcaggttgccaaacaatgtcccagttgccctgggaggcacaaacctaccaaagtgccataggccaggtgcagagagaatcagaggagctgatttgcttggggtcagagcagagctgggttttttcagatgatcactttcacatactccttgttaaatgggaccaaaggggaagaagaagaaacccttaagcttttgtaatattgtcttgggtaccagataccataaaaggcagcatgagagaaacattcccttgggccagtgtcatggtggattttcttgcttgagaggcaaggatttcagctttcatttggtaccacagaatttaaaattgtaagtgcctatcccttttgactgttgatggcttctttggggttttagttaccccagttgaaagagaaatttttcatattggggttgagaagaatggaggctattaggagcaaagctttaatgagtgaaagtctggtgaatcctgcaattttgatatgtttccagtggattttgagaacacagttttaggaccagagtagatgttgttccctagaaaatagagtcagctattgatattgtgcctcccatccctcatatctcagtgttttaaccccacctgagtttggagaccagtttgtccaaggatctttcaaacatgtgagcccagagtagaacttctgagtcaaggatcatgtctttttctgaggagctttgcttggggcactggaaatcctgtttagatcaggactattggaatattatcctctccaggggaagtgccaggttgaacatttaaggctttgcttctaggcccagctatacattcaccagcaaatcacttaacttcctaaatttctttaaaatctgtaaaatgggatcagtctaatatgcctacctcaaatgatgacagaatgacatctatatgcatatgaggcctacgttagttgaaagatgctataaagatataagggatttgttacttgtctttcttgaaatgttacagttggggtgcggttgcttctatcttctggacctctgcccattcagcatacagctagaggaatctttgggcagatccacattctttagcactagctaggctttgactccaaagctatctggtctaccttgatgttctgagcaggaaaactgaggacctcaagaaccattccaaatttctactcattctccctaagacccagagcagacccaggacctaaagaaattacatcatctctattttcccttggctccagcccactcttgtttgaacctcccacttttgttgttccaactacttcttgagatgaaggaagggcagaacattggccctcttcactgaagtcttcaccccttaatccagggttcaatttttagttcaccttagcctgtttgagattagaagctgggccttaacttacaggtgtgtccggcatcattcaatcagcctgttagatccagaatccagcactgtgacgctacataaccatgggctctgtccttccagttcctttagtgccttccctcactggtaggttcactctgagggcttccttccttgaactccagtggcaactatagtctgtttcccacaatttgttgtgtgtgttttttgttgttttgcagcgttttcatattgtcttttatgtaagtcatgtttctgaactatcgtataaatttcattagggtaagaatcatgtttgctttatgcactgtgtaacatgccttgcagtcagtataggcacttaaccttattgatcagttgttccttggtgttgaataatgtgttaggtagccaggtggacctgtgtcctagcctggagaagctctatgtcaccttgtaggaagccatctgaatttgactcagcatcatatgctgggcctgtgctgcacttgagctttctttccagccgccaggagggatggttgtcctggccaacagcgaatttaatgggtggtcaaaagaagatgtgcctgcatagaaggctgaaagagggagctggaagtaggaggagacaaggagatagtgacaccagtatcttgtcacagaaatcaaggaaggcaacagtttaaaggaggggagggagatcagtggtgccaactggctcagaagaggtttgctgggttaaatctcaagatgagcccatgagatctggtggttagcagaggcctttcctgacaaccccattttaagcacctcttccccatcactctatctcatcactgttactgtctgtgtagccctgtcatgagctaaaatcatcctgtttgtttattgctagcttatgtgtctaaagtatactccttgagaacagcaactttgtctttttcacctttgtactgagtcccctgacatggaataagatatgaataaatgcacagacttgtccaaaatcatccaattaa

SEQ ID NO: 186600 - DNA, 1649 bp, Homo sapiens
  Payload ID: 16744
  Gene Symbol: STAMBP
  Gene Name: STAM binding protein
  Uniprot ID: O95630
  ENST ID: ENST00000409707
  CDS Start-End: 48-1322
tttccggaacctccgggtgtcatccgcggggaaagaacttggtcctgatgtctgaccatggagatgtgagcctcccgcccgaagaccgggtgagggctctctcccagctgggtagtgcggtagaggtgaatgaagacattccaccccgtcggtacttccgctctggagttgagattatccgaatggcatccatttactctgaggaaggcaacattgaacatgccttcatcctctataacaagtatatcacgctctttattgagaaactaccaaaacatcgagattacaaatctgctgtcattcctgaaaagaaagacacagtaaagaaattaaaggagattgcatttcccaaagcagaagagctgaaggcagagctgttaaaacgatataccaaagaatatacagaatataatgaagaaaagaagaaggaagcagaggaattggcccggaacatggccatccagcaagagctggaaaaggaaaaacagagggtagcacaacagaagcagcagcaattggaacaggaacagttccatgccttcgaggagatgatccggaaccaggagctagaaaaagagcgactgaaaattgtacaggagtttgggaaggtagaccctggcctaggtggcccgctagtgcctgacttggagaagccctccttagatgtgttccccaccttaacagtctcatccatacagccttcagactgtcacacaactgtaaggccagctaagccacctgtggtggacaggtccttgaaacctggagcactgagcaactcagaaagtattcccacaatcgatggattgcgccatgtggtggtgcctgggcggctgtgcccacagtttctccagttagccagtgccaacactgcccggggagtggagacatgtggaattctctgtggaaaactgatgaggaatgaatttaccattacccatgttctcatccccaagcaaagtgctgggtctgattactgcaacacagagaacgaagaagaacttttcctcatacaggatcagcagggcctcatcacactgggctggattcatactcaccccacacagaccgcgtttctctccagtgtcgacctacacactcactgctcttaccagatgatgttgccagagtcagtagccattgtttgctcccccaagttccaggaaactggattctttaaactaactgaccatggactagaggagatttcttcctgtcgccagaaaggatttcatccacacagcaaggatccacctctgttctgtagctgcagccacgtgactgttgtggacagagcagtgaccatcacagaccttcgatgagcgtttgagtccaacaccttccaagaacaacaaaaccatatcagtctcaccaagatggaggaacagagcccatggcccacttactacatggattcccactttacagtggagaaggagcttgcagtaaccacaaaagtttctgtataagcaaatttagggaattgaacttcagacagtgtggttgtctccttacttatgaacttgggaatacttacttaggtaacaactaacatcagaggtttttgatctgtagcctttctttctgtccataattagctaatagcttctgctgtacaaacacaaaccattccctgtccaagaaaatta

SEQ ID NO: 186601 - DNA, 583 bp, Homo sapiens
  Payload ID: 16744
  Gene Symbol: STAMBP
  Gene Name: STAM binding protein
  ENST ID: ENST00000424659
  CDS Start-End: 94-583
gggaaaggtggggaagggtcccgggaacgtggtggggcagggcctccgagcgtggttggactttgaaggggatcggccgccaacttggtcctgatgtctgaccatggagatgtgagcctcccgcccgaagaccgggtgagggctctctcccagctgggtagtgcggtagaggtgaatgaagacattccaccccgtcggtacttccgctctggagttgagattatccgaatggcatccatttactctgaggaaggcaacattgaacatgccttcatcctctataacaagtatatcacgctctttattgagaaactaccaaaacatcgagattacaaatctgctgtcattcctgaaaagaaagacacagtaaagaaattaaaggagattgcatttcccaaagcagaagagctgaaggcagagctgttaaaacgatataccaaagaatatacagaatataatgaagaaaagaagaaggaagcagaggaattggcccggaacatggccatccagcaagagctggaaaaggaaaaacagagggtagcacaacagaagcagcagcaattggaacaggaacagttccatg

SEQ ID NO: 186602 - DNA, 560 bp, Homo sapiens
  Payload ID: 16744
  Gene Symbol: STAMBP
  Gene Name: STAM binding protein
  ENST ID: ENST00000452725
  CDS Start-End: 149-560
ggaacctccgggtgtcatccgcggggaaagatgctgcatcccctttttggaattgctcaaccaggtggtaaccggcgccgcttcctggccttgggaggtggttcctttcttaacccacaagaacctctcccaagagaacttggtcctgatgtctgaccatggagatgtgagcctcccgcccgaagaccgggtgagggctctctcccagctgggtagtgcggtagaggtgaatgaagacattccaccccgtcggtacttccgctctggagttgagattatccgaatggcatccatttactctgaggaaggcaacattgaacatgccttcatcctctataacaagtatatcacgctctttattgagaaactaccaaaacatcgagattacaaatctgctgtcattcctgaaaagaaagacacagtaaagaaattaaaggagattgcatttcccaaagcagaagagctgaaggcagagctgttaaaacgatataccaaagaatatacagaatataatgaagaaaagaagaaggaagcagaggaattggcccggaacatggcca

SEQ ID NO: 186603 - DNA, 1156 bp, Homo sapiens
  Payload ID: 16744
  Gene Symbol: STAMBP
  Gene Name: STAM binding protein
  ENST ID: ENST00000432295
  CDS Start-End: 203-1156
gcggggaaaggtggggaagggtcccgggaacgtggtggggcagggcctccgagcgtggttggactttgaaggggatcggccgccatgctgcatcccctttttggaattgctcaaccaggtggtaaccggcgccgcttcctggccttgggaggtggttcctttcttaacccacaagaacctctcccaagagaacttggtcctgatgtctgaccatggagatgtgagcctcccgcccgaagaccgggtgagggctctctcccagctgggtagtgcggtagaggtgaatgaagacattccaccccgtcggtacttccgctctggagttgagattatccgaatggcatccatttactctgaggaaggcaacattgaacatgccttcatcctctataacaagtatatcacgctctttattgagaaactaccaaaacatcgagattacaaatctgctgtcattcctgaaaagaaagacacagtaaagaaattaaaggagattgcatttcccaaagcagaagagctgaaggcagagctgttaaaacgatataccaaagaatatacagaatataatgaagaaaagaagaaggaagcagaggaattggcccggaacatggccatccagcaagagctggaaaaggaaaaacagagggtagcacaacagaagcagcagcaattggaacaggaacagttccatgccttcgaggagatgatccggaaccaggagctagaaaaagagcgactgaaaattgtacaggagtttgggaaggtagaccctggcctaggtggcccgctagtgcctgacttggagaagccctccttagatgtgttccccaccttaacagtctcatccatacagccttcagactgtcacacaactgtaaggccagctaagccacctgtggtggacaggtccttgaaacctggagcactgagcaactcagaaagtattcccacaatcgatggattgcgccatgtggtggtgcctgggcggctgtgcccacagtttctccagttagccagtgccaacactgcccggggagtggagacatgtggaattctctgtggaaaactgatgaggaatgaatttaccattacccatgttctcatccccaagcaaagtgctgggtctgattactgcaacacagagaacgaagaagaa

SEQ ID NO: 186604 - DNA, 845 bp, Homo sapiens
  Payload ID: 16744
  Gene Symbol: STAMBP
  Gene Name: STAM binding protein
  ENST ID: ENST00000536064
  CDS Start-End: 159-788
gcctccgagcgtggttggactttgaaggggatcggccgccatgctgcatcccctttttggaattgctcaaccaggtggtaaccggcgccgcttcctggccttgggaggtggttcctttcttaacccacaagaacctctcccaagagaacttggtcctgatgtctgaccatggagatgtgagcctcccgcccgaagaccgggtgagggctctctcccagctgggtagtgcggtagaggtgaatgaagacattccaccccgtcggtacttccgctctggagttgagattatccgaatggcatccatttactctgaggaaggcaacattgaacatgccttcatcctctataacaagtatatcacgctctttattgagaaactaccaaaacatcgagattacaaatctgctgtcattcctgaaaagaaagacacagtaaagaaattaaaggagattgcatttcccaaagcagaagagctgaaggcagagctgttaaaacgatataccaaagaatatacagaatataatgaagaaaagaagaaggaagcagaggaattggcccggaacatggccatccagcaagagctggaaaaggaaaaacagagggtagcacaacagaagcagcagcaattggaacaggaacagttccatgccttcgaggagatgatccggaaccaggagctagaaaaagagcgactgaaaattgtacaggagtttgggaagttcccacaatcgatggattgcgccatgtggtggtgcctgggcggctgtgcccacagtttctccagttagccagtgccaacactgcccggggagtggagacatgtggaattctctgtggaaaactgg

SEQ ID NO: 186605 - DNA, 1899 bp, Homo sapiens
  Payload ID: 16745
  Gene Symbol: STAMBPL1
  Gene Name: STAM binding protein-like 1
  ENST ID: ENST00000371922
  CDS Start-End: 824-1636
atattatctgacctaataagcctggatattttgttagaactggagagcttgggactcctcctttttagcaaaactctgggttagtggtgacagagaaggttggaacacattttaataaccattttttagtgattccttcttatccataaatttccagcagagtatgagttctagagtcaaatgcgaaaggttctagggcagcactgttcaatagaactcctgtgatgatggaagtgttctgtttggcactttccaatatggtatccactagccacatgtggcttctgggtacttaaatgtgactgactagtgtccctgaggtactgaatttctaattttgtttaattttaatcaagttcaaataaccacatgtggctagtggccactatattagaagtgcagtaggggtgagatattttgtttcatatggtcttgttggtctgactgagcaaacaaccttgacgttgattttccagtatttaaaagcattagggaatgaagggatcctgattgtcatggcctgtctctggtaaaatatcagtggatttagaactgctatgttaatcagatcaaggggcttttgccctgatgttatgtatttctctcactgttccatgagtgtccctgtgggcatatcacagtatctagcattttctctgtctgcttgaagactgaaaatgtctaattccagttcaatgtttctccttggaaactaaccttctcttctggctgccacactttttagaacaaatataaagctgaaattctcaaaaaattggagcatcagagattgatagaggcagaaaggaagcggattgctcagatgcgccagcagcagctagaatcggagcagtttctgtttttcgaagatcaactcaagaagcaagagttagcccgaggtcaaatgcgaagtcagcaaacctcagggctgtcagagcagattgatgggagcgctttgtcctgcttttccacacaccagaacaattccttgctgaatgtatttgcagatcaacctaataaaagtgatgcaaccaattatgctagccactctcctcctgtaaacagggccttaacgccagctgctactctaagtgctgttcagaatttagtggttgaaggactgcgatgtgtagttttgccagaagatctttgccacaaatttctgcaactggcagaatctaatacagtgagaggaatagaaacctgtggaatactctgtggaaaactgacacataatgaatttactattacccatgtaattgtgccaaagcagtctgcgggaccagactattgtgacatggagaatgtagaggaattattcaatgttcaggatcaacatgatctcctcactctaggatggatccatacacatcccactcaaactgcatttttatccagcgttgatcttcacactcactgttcctatcaactcatgttgccagaggccattgccattgtttgctcaccaaagcataaagacactggcatcttcaggctcaccaatgctggcatgcttgaggtttctgcttgtaaaaaaaagggctttcatccacacaccaaggagcccaggctgttcagtatatgcaaacatgtgttggtaaaagacataaaaataattgtgttggatctgaggtgatatgttctgaatgtaagcaccgtcaacatcagacacctactcatggacatgtggttgccggattttcttaagatgtttccagaaatgactgatattttatatttatacattttagatgacaaagcttgatatttattgctgttgcacattttaaagttttctttttgggttgctctgtgtcaagagaggttacatggtgttaaatcggtacctgataatgtacccaaatactatggccagataataaattgtgctgcaaacaa

SEQ ID NO: 186606 - DNA, 2208 bp, Homo sapiens
  Payload ID: 16745
  Gene Symbol: STAMBPL1
  Gene Name: STAM binding protein-like 1
  Uniprot ID: Q96FJ0
  ENST ID: ENST00000371924
  CDS Start-End: 635-1945
ctcttcatctttgtcatgtgattcaacatattcatgggaataatattccatgacctttgctgtcttctattggttagaagccaactacaggtcttaaacacactcaagtggagaggattacacaaacctacagatatcaaggggcaggaatcacagagctatcttagaattctgcctgttatagttctaaggttgagtttaaatccagactggctctaagtttaacagtccatgcttctaatcagtattatcttctttattcctttgaagaaagcaaacctactttataaccttgcatagagttctaagtaaggtatcccgcagcagattcatactgggtgtcagtcaaatgtgaattattttcacaccttcacttttaaagatcagcttcaggaaactataaccacttgcagttttgtattttcaggaagagatttccaacagtctctctaaacactcaggttatataggttatttcaatttgttcctgtttgtctgaggcagagataaccctggggtttgggatttcaaacttgggtctcaaaaaataactttagttctgcttcttgtttttgaaacagatgaagtgattgagaagaaacagtgaacatcctcatttcacagataagacaacatggatcagccttttactgtgaattctctgaaaaagttagctgctatgcctgaccatacagatgtttccctaagcccagaagagcgagtccgtgccctaagcaagcttggttgtaatatcaccatcagtgaagacatcactccacgacgttactttaggtctggagtagagatggagaggatggcgtctgtgtatttggaagaaggaaatttggaaaatgcctttgttctttataataaatttataaccttatttgtagaaaagcttcctaaccatcgagattaccagcaatgtgcagtacctgaaaagcaggatattatgaagaaactgaaggagattgcattcccaaggacagatgaattgaaaaacgaccttttaaagaaatataacgtagaataccaagaatatttgcaaagcaaaaacaaatataaagctgaaattctcaaaaaattggagcatcagagattgatagaggcagaaaggaagcggattgctcagatgcgccagcagcagctagaatcggagcagtttctgtttttcgaagatcaactcaagaagcaagagttagcccgaggtcaaatgcgaagtcagcaaacctcagggctgtcagagcagattgatgggagcgctttgtcctgcttttccacacaccagaacaattccttgctgaatgtatttgcagatcaacctaataaaagtgatgcaaccaattatgctagccactctcctcctgtaaacagggccttaacgccagctgctactctaagtgctgttcagaatttagtggttgaaggactgcgatgtgtagttttgccagaagatctttgccacaaatttctgcaactggcagaatctaatacagtgagaggaatagaaacctgtggaatactctgtggaaaactgacacataatgaatttactattacccatgtaattgtgccaaagcagtctgcgggaccagactattgtgacatggagaatgtagaggaattattcaatgttcaggatcaacatgatctcctcactctaggatggatccatacacatcccactcaaactgcatttttatccagcgttgatcttcacactcactgttcctatcaactcatgttgccagaggccattgccattgtttgctcaccaaagcataaagacactggcatcttcaggctcaccaatgctggcatgcttgaggtttctgcttgtaaaaaaaagggctttcatccacacaccaaggagcccaggctgttcagtatatgcaaacatgtgttggtaaaagacataaaaataattgtgttggatctgaggtgatatgttctgaatgtaagcaccgtcaacatcagacacctactcatggacatgtggttgccggattttcttaagatgtttccagaaatgactgatattttatatttatacattttagatgacaaagcttgatatttattgctgttgcacattttaaagttttctttttgggttgctctgtgtcaagagaggttacatggtgttaaatcggtacctgataatgtacccaaatactatggccagataataaattgtgctgcaaacaa

SEQ ID NO: 186607 - DNA, 2532 bp, Homo sapiens
  Payload ID: 16745
  Gene Symbol: STAMBPL1
  Gene Name: STAM binding protein-like 1
  Uniprot ID: Q96FJ0
  ENST ID: ENST00000371926
  CDS Start-End: 959-2269
taacatccaggagatattctaatacttcttattttccaagtacacacaaattgggggtagggggaagggctaagatgcttaatagtgggcgtagccagttgtggataaatatcaaaaagggaatcctaacatgaagtataagtgggattttcaccaaaaccctatccttccccagactccagtgacagtttaacggtcagctgcatcaaggcttgtgtactgtgcagtcttaaaaggcaccactcctgtccatctcggtgaaattgatggtggagcaaaagggagtttaggtggttccggtctggggagaagacgtgcagggtttcagatgcgaaagtcgcacccaaccgcttcactcgggctctaggccatccgcaggggccctgcttccttccacctgcgagctttttctgcagaatgcgggaagccgccgccgccgccacagaggagggggcggaggcagaggcggaggcggcacccaggggccggggcaggggaggccgggaccatcgcagtgacaatttattttcctgcagcagcggcagcagggacggttgctgcaggttcggggtcggccggcctgcgcgtgggcttgcgaggacgctgttcgtcccctgcgctggggtgtccgacagcgaggaggagaacgacgcacggagcccgcgcgactggaaccagcaaagctccatctgtcggcagaggagaagggggaggaggcacggccgaggcaaacgagcggacgcctcgtcgccgggtgccggtatcaccccgctgcaacgccttccagcaaaagccaccgcggcccgggttgcagcagccggacggatgccaaggccacacggcagccacgggggcagccgtcgcagtcgccgtcccacacgggctgcggacaccaagggttgctaatgaagtgattgagaagaaacagtgaacatcctcatttcacagataagacaacatggatcagccttttactgtgaattctctgaaaaagttagctgctatgcctgaccatacagatgtttccctaagcccagaagagcgagtccgtgccctaagcaagcttggttgtaatatcaccatcagtgaagacatcactccacgacgttactttaggtctggagtagagatggagaggatggcgtctgtgtatttggaagaaggaaatttggaaaatgcctttgttctttataataaatttataaccttatttgtagaaaagcttcctaaccatcgagattaccagcaatgtgcagtacctgaaaagcaggatattatgaagaaactgaaggagattgcattcccaaggacagatgaattgaaaaacgaccttttaaagaaatataacgtagaataccaagaatatttgcaaagcaaaaacaaatataaagctgaaattctcaaaaaattggagcatcagagattgatagaggcagaaaggaagcggattgctcagatgcgccagcagcagctagaatcggagcagtttctgtttttcgaagatcaactcaagaagcaagagttagcccgaggtcaaatgcgaagtcagcaaacctcagggctgtcagagcagattgatgggagcgctttgtcctgcttttccacacaccagaacaattccttgctgaatgtatttgcagatcaacctaataaaagtgatgcaaccaattatgctagccactctcctcctgtaaacagggccttaacgccagctgctactctaagtgctgttcagaatttagtggttgaaggactgcgatgtgtagttttgccagaagatctttgccacaaatttctgcaactggcagaatctaatacagtgagaggaatagaaacctgtggaatactctgtggaaaactgacacataatgaatttactattacccatgtaattgtgccaaagcagtctgcgggaccagactattgtgacatggagaatgtagaggaattattcaatgttcaggatcaacatgatctcctcactctaggatggatccatacacatcccactcaaactgcatttttatccagcgttgatcttcacactcactgttcctatcaactcatgttgccagaggccattgccattgtttgctcaccaaagcataaagacactggcatcttcaggctcaccaatgctggcatgcttgaggtttctgcttgtaaaaaaaagggctttcatccacacaccaaggagcccaggctgttcagtatatgcaaacatgtgttggtaaaagacataaaaataattgtgttggatctgaggtgatatgttctgaatgtaagcaccgtcaacatcagacacctactcatggacatgtggttgccggattttcttaagatgtttccagaaatgactgatattttatatttatacattttagatgacaaagcttgatatttattgctgttgcacattttaaagttttctttttgggttgctctgtgtcaagagaggttacatggtgttaaatcggtacctgataatgtacccaaatactatggccagataataaattgtgctgcaaacaa

SEQ ID NO: 186608 - DNA, 4184 bp, Homo sapiens
  Payload ID: 16745
  Gene Symbol: STAMBPL1
  Gene Name: STAM binding protein-like 1
  Uniprot ID: Q96FJ0
  ENST ID: ENST00000371927
  CDS Start-End: 959-2344
taacatccaggagatattctaatacttcttattttccaagtacacacaaattgggggtagggggaagggctaagatgcttaatagtgggcgtagccagttgtggataaatatcaaaaagggaatcctaacatgaagtataagtgggattttcaccaaaaccctatccttccccagactccagtgacagtttaacggtcagctgcatcaaggcttgtgtactgtgcagtcttaaaaggcaccactcctgtccatctcggtgaaattgatggtggagcaaaagggagtttaggtggttccggtctggggagaagacgtgcagggtttcagatgcgaaagtcgcacccaaccgcttcactcgggctctaggccatccgcaggggccctgcttccttccacctgcgagctttttctgcagaatgcgggaagccgccgccgccgccacagaggagggggcggaggcagaggcggaggcggcacccaggggccggggcaggggaggccgggaccatcgcagtgacaatttattttcctgcagcagcggcagcagggacggttgctgcaggttcggggtcggccggcctgcgcgtgggcttgcgaggacgctgttcgtcccctgcgctggggtgtccgacagcgaggaggagaacgacgcacggagcccgcgcgactggaaccagcaaagctccatctgtcggcagaggagaagggggaggaggcacggccgaggcaaacgagcggacgcctcgtcgccgggtgccggtatcaccccgctgcaacgccttccagcaaaagccaccgcggcccgggttgcagcagccggacggatgccaaggccacacggcagccacgggggcagccgtcgcagtcgccgtcccacacgggctgcggacaccaagggttgctaatgaagtgattgagaagaaacagtgaacatcctcatttcacagataagacaacatggatcagccttttactgtgaattctctgaaaaagttagctgctatgcctgaccatacagatgtttccctaagcccagaagagcgagtccgtgccctaagcaagcttggttgtaatatcaccatcagtgaagacatcactccacgacgttactttaggtctggagtagagatggagaggatggcgtctgtgtatttggaagaaggaaatttggaaaatgcctttgttctttataataaatttataaccttatttgtagaaaagcttcctaaccatcgagattaccagcaatgtgcagtacctgaaaagcaggatattatgaagaaactgaaggagattgcattcccaaggacagatgaattgaaaaacgaccttttaaagaaatataacgtagaataccaagaatatttgcaaagcaaaaacaaatataaagctgaaattctcaaaaaattggagcatcagagattgatagaggcagaaaggaagcggattgctcagatgcgccagcagcagctagaatcggagcagtttctgtttttcgaagatcaactcaagaagcaagagttagcccgaggtcaaatgcgaagtcagcaaacctcagggctgtcagagcagattgatgggagcgctttgtcctgcttttccacacaccagaacaattccttgctgaatgtatttgcagatcaacctaataaaagtgatgcaaccaattatgctagccactctcctcctgtaaacagggccttaacgccagctgctactctaagtgctgttcagaatttagtggttgaaggactgcgatgtgtagttttgccagaagatctttgccacaaatttctgcaactggcagaatctaatacagtgagaggaatagaaacctgtggaatactctgtggaaaactgacacataatgaatttactattacccatgtaattgtgccaaagcagtctgcgggaccagactattgtgacatggagaatgtagaggaattattcaatgttcaggatcaacatgatctcctcactctaggatggatccatacacatcccactcaaactgcatttttatccagcgttgatcttcacactcactgttcctatcaactcatgttgccagaggccattgccattgtttgctcaccaaagcataaagacactggcatcttcaggctcaccaatgctggcatgcttgaggtttctgcttgtaaaaaaaagggctttcatccacacaccaaggagcccaggctgttcagtattcagaaattcctttctgggataatttctggcactgctttggagatggagcccctgaaaattggctatggaccaaatggattcccactcttggggatctctaggtcatcatcaccatctgaacagctctgagagagacaagaagtggaatggagaaggtgattaggtaatccaagaattgccaggcgaacaattgtgaaaatctttcatagagttcccgatgaaaacaactctttcttgttagccattatctctgcctttcctttctaaagaaaaacacgtcatttcatcttgattatcagtttctcaagtactcatggatgtgaggccaggtaccctgtcaccttggctctgtttgggatgcaatgttgtgtttgtcaccacttcccattccccaaaagcatctttaacatagaccattcattcttcagattcaaaatgcttaagctgaactaacctcaaagggccctcattaatttacagacatttgaataacacccatattcatttctgctactgaaccaaagccttttccaaaaaaatcatctagcaaactgtttttgccaggccaaatattaacaggtatatatatttgcatacataaatatttacctctatgtcttgtgtgtttttgttatgagacagagtctcactctgtcgcccaggctggagtgcagtggcacagtctcagctcactgcaacctccacctcccaggttcaagcgattctcatgcctcagcctcccgagtagcgaggactacaggcgtgcaccaccacgcccagctaatttttgtatttttagtagagatggggttttaccctgttggccagggtggtctcgaattcctgacctctgatgatctacccgcctggacctctcaaagtgctgggattacagacatgagccactgtgccctgcctctgttttgtgtatttacataaatacatgtctccagagctttaaattcttcttaaattttaaaactagaactaaaccagacattgagaggacccagaaatataccctgactaacgtgggtggaatttcatttggcttgactctttggtgaaaaaaaaaaaaatcaggctctcaaggactcaatttggtgaaccaatgccaaatagaaaaatgttcttgacattttccccaaaatagatgtctaaagattttgcacttcaaattggtactttatgtattaaaagtgatattgaaactaaattcctacccaattagttgaaaaatatgaaaaaagcaattgctagagaatgcaatttattaaatgttggtggtcttttaaaaaatgaattcctcttgtagccagtgagatcagttatttatttatttattttaatagtaacaaggtctcactatattgtccaggctgatcttgaactcctggcctcaagctgtcctcccatctcagcttcccaaagtgctgagattataggcatgagccaccatgcctggctagttaatggttattaagtaatacaaacatttctgtgaattccaccagatcattgactttggcatagttcacttaagactttgtttgataaaataaatctctttcactctaattaggaagcatttttgggatcctgattaatgctctaatattgtggggccaaaaaatatgtggaacgtggccctgcagttagatgagctgagatcactatagtactatatagcgctctaaatcctaaatgctagatcactgtaatactgtacagatcagccacttgctggcttgtgactctgggccatttacttcacctctcaaaaggcatatttaaagtgaggaaaataataagtttattttggaaattcagttagatgatgcaaattgtttactgtaatttctagcatgtagttcgtgctccatgcatttaactgttattacaggttgtattagtatcacattaaattacccactgaagtgaaagtgaaaccagaatgctgtcaacgatt

SEQ ID NO: 186609 - DNA, 3312 bp, Homo sapiens
  Payload ID: 16746
  Gene Symbol: SNN
  Gene Name: stannin
  Uniprot ID: O75324
  ENST ID: ENST00000329565
  CDS Start-End: 213-479
agccgggccccgcccgccgcagcgcggggctcctgcgtcccgagtgcgcggcggccggaccgggcgggcggagccgggcccgcggggctgctgcggggcgatcgggccgggccgctgccgcgccatggactcccgtgtccagcctgagttccagcctcactgagtggccacccccaaagtgctgccagccgaggaagcccccagcactgaccatgtctattatggaccacagccccaccacgggcgtggtcacagtcatcgtcatcctcattgccatcgcggccctgggggccttgatcctgggctgctggtgctacctgcggctgcagcgcatcagccagtcagaggacgaggagagcatcgtgggggatggggagaccaaggaacccttcctgctggtgcagtattcggccaagggaccgtgcgtggagagaaaggccaagctgatgactcccaacggcccggaagtccacggctgagccaggatgcaaggctcctggtcctgtttgcagccggccaagaggcgctgggaggggcaaaaccatacggatgcgctgctgtctgagaggaagggctgacacttgctggcatggcctctgcgggcttcgtcatcgcatgcactgatgcccggggacctggctgtcctgggcttcccctcggcctccaggtgaggctgcccattgcaggcactgggcaggcctgaccttgctggggctcatggccctgtagcgcttttgttacttgaatgtctagctgagcctgtttttgatggagctactactgtaatgcgtgaactaacaaacctgtgaactgtaaataggcccctggaagcacgtgcttaagcccttttgctgatttttaaaaatatcatctagcgcacacgggactggtattctggctgtactaatgacaagctgagtcaagaccctggagggtcataggcttgtaaaggcccacgccacactcggcaggggtctctcatgtgtgtccatctgcgtgtatgtcaaggaagtgagatgccaatttggggtcttgaggctgaccagttggggtgcttgggtgatctctgcttcattagtcatgggtggaagaaaaaccacaccccccgcacccctccgttctttctgcatagactcacttgttaaatagcagttctgttgagagtggagttactgcagggaagctaccggacctgcctgggagccagtgaagggcgagtcagggcacgcgtcctggaggctgccagcgtccttgtagcagagcagtttcttgccgcttgggtcttcagcacgccaagccccccaccaaccctccaccccgagtgaaggcttcgctgaaattgctttggtcctcatagagcctgtggtggctacttttggtctgaaacccacttggcccaggaaagagaaaaggttgtatgttttgtgttggtgtttcctattttctgcactggaggggaggggactgttgaggttctgtcttttttcttcttttcctcttccctcttcacatcacttggcttcctttcctctctgatgaccgtccgcctatggggttctgacttcactttcctcagcgggtctccagtcccctgacccagctctaaaggcacttaggacccagggaacatttctcacgtgcacattcccctaagagccaccagactgcttcctgccagcctgtgcttgcggcagggagccggggcagggcagaggtgaacttgaagttcaggacttgactctcccacaggtggtgagctggtggctctctggtgagctagtgtctccacagcctgtctccaaggcctcccctatgtacatttcagtgagctcactttgatttttaatcccaccacaagcacatactaattttatttatgattcaaatgtgactcgtgcctgcccatccctgtaatagatggaaggtcagccccggcttaaccacagagcactggcccttcatggctgagctcagagctctggcctcctgctcagactaaaggcacctcctctggcctcacccaagcctcttctaaaaaccatgttgaatgaatccacgttctggaaccccgaggcgggagaagtagggagctgttcgtttaagcagcatacacctaaattgggggtttaaacattaagtaggagcttggggtggaagagggacagccggctgggccacctgagcagaaggtggtaatgaaacacctcagctgggctcttgggagaccttaggaagcaggagaggcaacacctctggctactgatggtgtggcaagttcagaagaggtggtggtggggtaggcgtgatgtcagcagaagccctgcaggctgggtgggcaggacacgtggtgggggccactgaaaccaggcctaggagggagaacaagttccaaaggtgccgactggaagaagggggtaaaagtttgctttggtgagtgagaaaaggctggggcgtgtgatccatcccctcacgtttcagaacttccaggctttctacctcgactctcaccacagccagcacatacacctaggctgtttttccttcctccacacctgagggacgcagcaacagctaggatctgcattttcaggttccgagcctgacccctggaactgaccagcgctcgattgtcagccttggcctggggttttgaccttgccagtgaagtttcggttttgaagtgattaaatgtcacttcctcatcagtttcacttctggaggttttcttatcctactccctggtgccagggacgtacctgggagtttgaatcaggcccatttgagcgtggcagccgtgttgggtgaaggtccggggctcggtgaggcactgggggggttttcgggaggaaaatgaaaatgcttctagaatgagtgaaccacatcatagctctcactgttttttcaatagctactttttttagcagacaccagagccacactcaaatggctaagtaggttatgacctctctggattatttttgaatgcccaactgttgcattcaagttttctgactaataagaaattaagcattcatccttcgtatcactgcagaagcaacagtgggggcacagggagggaactcttgacactgagccactaaaatatggactaattttttggacaaatcttcaaacggactgtgctactgtatttgtctcaaagctaccaagtttgtgcaataagtggaagggatgtcatccttcttcaataaatgctgaatgacattcaagctgattttctagaccactgagaaaatctttatttacaataaatttcaataaaatttgcataaatatattcccaatgtacaa

SEQ ID NO: 186610 - DNA, 3883 bp, Homo sapiens
  Payload ID: 16747
  Gene Symbol: STC1
  Gene Name: stanniocalcin 1
  Uniprot ID: P52823
  ENST ID: ENST00000290271
  CDS Start-End: 285-1028
cagtttgcaaaagccagaggtgcaagaagcagcgactgcagcagcagcagcagcagcggcggtggcagcagcagcagcagcggcggcagcagcagcagcagcggaggcaccggtggcagcagcagcatcaccagcaacaacaacaaaaaaaaatcctcatcaaatcctcacctaagctttcagtgtatccagatccacatcttcactcaagccaggagagggaaagaggaaaggggggcaggaaaaaaaaaaaacccaacaacttagcggaaacttctcagagaatgctccaaaactcagcagtgcttctggtgctggtgatcagtgcttctgcaacccatgaggcggagcagaatgactctgtgagccccaggaaatcccgagtggcggctcaaaactcagctgaagtggttcgttgcctcaacagtgctctacaggtcggctgcggggcttttgcatgcctggaaaactccacctgtgacacagatgggatgtatgacatctgtaaatccttcttgtacagcgctgctaaatttgacactcagggaaaagcattcgtcaaagagagcttaaaatgcatcgccaacggggtcacctccaaggtcttcctcgccattcggaggtgctccactttccaaaggatgattgctgaggtgcaggaagagtgctacagcaagctgaatgtgtgcagcatcgccaagcggaaccctgaagccatcactgaggtcgtccagctgcccaatcacttctccaacagatactataacagacttgtccgaagcctgctggaatgtgatgaagacacagtcagcacaatcagagacagcctgatggagaaaattgggcctaacatggccagcctcttccacatcctgcagacagaccactgtgcccaaacacacccacgagctgacttcaacaggagacgcaccaatgagccgcagaagctgaaagtcctcctcaggaacctccgaggtgaggaggactctccctcccacatcaaacgcacatcccatgagagtgcataaccagggagaggttattcacaacctcaccaaactagtatcattttaggggtgttgacacaccagttttgagtgtactgtgcctggtttgatttttttaaagtagttcctattttctatcccccttaaagaaaattgcatgaaactaggcttctgtaatcaatatcccaacattctgcaatggcagcattcccaccaacaaaatccatgtgaccattctgcctctcctcaggagaaagtaccctcttttaccaacttcctctgccatgtttttcccctgctcccctgagaccacccccaaacacaaaacattcatgtaactctccagccattgtaatttgaagatgtggatccctttagaacggttgccccagtagagttagctgataaggaaactttatttaaatgcatgtcttaaatgctcataaagatgttaaatggaattcgtgttatgaatctgtgctggccatggacgaatatgaatgtcacatttgaattcttgatctctaatgagctagtgtcttatggtcttgatcctccaatgtctaattttctttccgacacatttaccaaattgcttgagcctggctgtccaaccagactttgagcctgcatcttcttgcatctaatgaaaaacaaaaagctaacatctttacgtactgtaactgctcagagctttaaaagtatctttaacaattgtcttaaaaccagagaatcttaaggtctaactgtggaatataaatagctgaaaactaatgtactgtacataaattccagaggactctgcttaaacaaagcagtatataataactttattgcatatagatttagttttgtaacttagctttatttttcttttcctgggaatggaataactatctcacttccagatatccacataaatgctccttgtggccttttttataactaagggggtagaagtagttttaattcaacatcaaaacttaagatgggcctgtatgagacaggaaaaaccaacaggtttatctgaaggaccccaggtaagatgttaatctcccagcccacctcaacccagaggctactcttgacttagacctatactgaaagatctctgtcacatccaactggaaattccaggaaccaaaaagagcatccctatgggcttggaccacttacagtgtgataaggcctactatacattaggaagtggcagttctttactcgtcccctttcatcggtgcctggtactctggcaaatgatgatggggtgggagactttccattaaatcaatcaggaatgagtcaatcagcctttaggtctttagtccgggggacttggggctgagagagtataaataaccctgggctgtccagccttaatagacttctcttacattttcgtcctgtagcacgctgcctgccaaagtagtcctggcagctggaccatctctgtaggatcgtaaaaaaatagaaaaaaagaaaaaaaaaagaaagaaagagggaaaaagagctggtggtttgatcatttctgccatgatgtttacaagatggcgaccaccaaagtcaaacgactaacctatctatgaacaacagtagtttctcagggtcactgtccttgaacccaacagtcccttatgagcgtcactgcccaccaaaggtcaatgtcaagagaggaagagagggaggaggggtaggactgcaggggccactccaaactcgcttaggtagaaactattggtgcttgactctcactaggctaaactcaagatttgaccaaatcgagtgatagggatcctggtgggaggagagagggcacatctccagaaaaatgaaaagcaatacaactttaccataaagcctttaaaaccagtaacgtgctgctcaaggaccaagagcaattgcagcagacccagcagcagcagcagcagcacaaacattgctgcctttgtccccacacagcctctaagcgtgctgacatcagattgttaagggcatttttatactcagaactgtcccatccccaggtccccaaacttatggacactgccttagcctcttggaaatcaggtagaccatattctaagttagactcttcccctccctcccacacttcccacccccaggcaaggctgacttctctgaatcagaaaagctattaaagtttgtgtgttgtgtccattttgcaaacccaactaagccaggaccccaatgcgacaagtagttcatgagtattcctagcaaatttctctctttcttcagttcagtagatttccttttttcttttctttttttttttttttttttttggctgtgacctcttcaaaccgtggtacccccccttttctccccacgatgatatctatatatgtatctacaatacatatatctacacatacagaaagaagcagttctcacaatgttgctagttttttgcttctctttcccccaccctactccctccaattcccccttaaacttccaaagcttcgtcttgtgtttgctgcagagtgattcgggggctgacctagaccagtttgcatgattcttctcttgtgatttggttgcactttagacatttttgtgccattatatttgcattatgtatttataatttaaatgatatttaggtttttggctgagtactggaataaacagtgagcatatctggtatatgtcattatttattgttaaattacatttttaagctccatgtgcatataaaggttatgaaacatatcatggtaatgacagatgcaagttattttatttgcttatttttataattaaagatgccatagcataatatgaagcctttggtgaattccttctaagataaaaataataataaagtgttacgttttattggtttcccccca

SEQ ID NO: 186611 - DNA, 1748 bp, Homo sapiens
  Payload ID: 16747
  Gene Symbol: STC1
  Gene Name: stanniocalcin 1
  Uniprot ID: P52823
  ENST ID: ENST00000524323
  CDS Start-End: 356-892
aataaatgtgcttcatgcctgatggcaataaactgccagtgtaatccaatagccttaggcagtggagctcctttgtttaataaattgcatgcaactaaacgaagaagctggacgctctgctgagggtatttcattgcataagcctagcctgattgcctgaaatctggcacgtaccctcttggagggggaggggtgagaggggaggaaaggcttgaatgttggcatgcttcaaagcgctctctatactttccagaagctgatctaagctgaagtggttcgttgcctcaacagtgctctacaggtcggctgcggggcttttgcatgcctggaaaactccacctgtgacacagatgggatgtatgacatctgtaaatccttcttgtacagcgctgctaaatttgacactcagggaaaagcattcgtcaaagagagcttaaaatgcatcgccaacggggtcacctccaaggtcttcctcgccattcggaggtgctccactttccaaaggatgattgctgaggtgcaggaagagtgctacagcaagctgaatgtgtgcagcatcgccaagcggaaccctgaagccatcactgaggtcgtccagctgcccaatcacttctccaacagatactataacagacttgtccgaagcctgctggaatgtgatgaagacacagtcagcacaatcagagacagcctgatggagaaaattgggcctaacatggccagcctcttccacatcctgcagacagaccactgtgcccaaacacacccacgagctgacttcaacaggagacgcaccaatgagccgcagaagctgaaagtcctcctcaggaacctccgaggtgaggaggactctccctcccacatcaaacgcacatcccatgagagtgcataaccagggagaggttattcacaacctcaccaaactagtatcattttaggggtgttgacacaccagttttgagtgtactgtgcctggtttgatttttttaaagtagttcctattttctatcccccttaaagaaaattgcatgaaactaggcttctgtaatcaatatcccaacattctgcaatggcagcattcccaccaacaaaatccatgtgaccattctgcctctcctcaggagaaagtaccctcttttaccaacttcctctgccatgtttttcccctgctcccctgagaccacccccaaacacaaaacattcatgtaactctccagccattgtaatttgaagatgtggatccctttagaacggttgccccagtagagttagctgataaggaaactttatttaaatgcatgtcttaaatgctcataaagatgttaaatggaattcgtgttatgaatctgtgctggccatggacgaatatgaatgtcacatttgaattcttgatctctaatgagctagtgtcttatggtcttgatcctccaatgtctaattttctttccgacacatttaccaaattgcttgagcctggctgtccaaccagactttgagcctgcatcttcttgcatctaatgaaaaacaaaaagctaacatctttacgtactgtaactgctcagagctttaaaagtatctttaacaattgtcttaaaaccagagaatcttaaggtctaactgtggaatataaatagctgaaaactaatgtactgtacataaattccagaggactctgcttaaacaaagcagtatataataactttattgcatatagatttagttttgtaacttagctttatttttctttt

SEQ ID NO: 186612 - DNA, 5353 bp, Homo sapiens
  Payload ID: 16748
  Gene Symbol: STC2
  Gene Name: stanniocalcin 2
  Uniprot ID: O76061
  ENST ID: ENST00000265087
  CDS Start-End: 1311-2219
tttctccttccctccacgggccgggtgagaaagtagccgggggctatcccgacccggcggttcttggggagggggccgaacaagaaaagggaggagatggagataacttccccggatttagcttttttgtctttgtttttgttctcaccacttccatcggatgactggagagtaaaagggaacccggagcggggtggcgagcagcgctttgagaaaatgcaggagtgtgtttggagacgcgtaaagttgcctttcaagctctggcctccgggcacgcgatgctccgcggcgggctgactcagggctgccttgggcctccctgccaccctcctggaaatgatgcaagtcctgactgtcacctggatccctgcagcccagcctggaatgcgtctggattaggggaaagacgagaaacgacactccaggtgttgcacggcccaccaaagcgggaagatagggcagttgctcagaccaaatactgtatctagtgcttctgctcctatcttcaatcgtggggttctttttaatgcaaagtgtcacaaggccaggaattcccatgtgtgctcagttggcccacagcatcattgtgcctaggaaactgcttcaatttatcaagtcctctgggctgggaatctcactgaattccaaacggcggaaagaggaaactttcccaacccgatgtgggtgtgacgcgagccaggggccccagggacactgtcccagagcacaccgtccccctttaacagcaactggagcttggattcgctcttatattgtacagtcctttcgaccattgccctggagcacccgcacacgcgcacgcatctccggccgcgctcacacacactcatacacacgcacgcaaacgcgtggccgccgccaggtcggcaactttgtccggcgctcccagcggcgctcggcttcctcctgtagtagttgagcgcaggccccgcctcccggccgtgttgtcaaaagggccggggtctcggattggtccagccgccgggacaacacctgctcgactccttcattcaagtgacaccagagcttccagggatatttgaggcaccatccctgccattgccgggcactcgcggcgctgctaacggcctggtcacatgctctccggagagctacgggagggcgctgggtaacctctatccgagccgcggccgcgaggaggagggaaaaggcgagcaaaaaggaagagtgggaggaggaggggaagcggcgaaggaggaagaggaggaggaggaagaggggagcacaaaggatccaggtctcccgacgggaggttaataccaagaaccatgtgtgccgagcggctgggccagttcatgaccctggctttggtgttggccacctttgacccggcgcgggggaccgacgccaccaacccacccgagggtccccaagacaggagctcccagcagaaaggccgcctgtccctgcagaatacagcggagatccagcactgtttggtcaacgctggcgatgtggggtgtggcgtgtttgaatgtttcgagaacaactcttgtgagattcggggcttacatgggatttgcatgacttttctgcacaacgctggaaaatttgatgcccagggcaagtcattcatcaaagacgccttgaaatgtaaggcccacgctctgcggcacaggttcggctgcataagccggaagtgcccggccatcagggaaatggtgtcccagttgcagcgggaatgctacctcaagcacgacctgtgcgcggctgcccaggagaacacccgggtgatagtggagatgatccatttcaaggacttgctgctgcacgaaccctacgtggacctcgtgaacttgctgctgacctgtggggaggaggtgaaggaggccatcacccacagcgtgcaggttcagtgtgagcagaactggggaagcctgtgctccatcttgagcttctgcacctcggccatccagaagcctcccacggcgccccccgagcgccagccccaggtggacagaaccaagctctccagggcccaccacggggaagcaggacatcacctcccagagcccagcagtagggagactggccgaggtgccaagggtgagcgaggtagcaagagccacccaaacgcccatgcccgaggcagagtcgggggccttggggctcagggaccttccggaagcagcgagtgggaagacgaacagtctgagtattctgatatccggaggtgaaatgaaaggcctggccacgaaatctttcctccacgccgtccattttcttatctatggacattccaaaacatttaccattagagaggggggatgtcacacgcaggattctgtggggactgtggacttcatcgaggtgtgtgttcgcggaacggacaggtgagatggagacccctggggccgtggggtctcaggggtgcctggtgaattctgcacttacacgtactcaagggagcgcgcccgcgttatcctcgtacctttgtcttctttccatctgtggagtcagtgggtgtcggccgctctgttgtgggggaggtgaaccagggaggggcagggcaaggcagggcccccagagctgggccacacagtgggtgctgggcctcgccccgaagcttctggtgcagcagcctctggtgctgtctccgcggaagtcagggcggctggattccaggacaggagtgaatgtaaaaataaatatcgcttagaatgcaggagaagggtggagaggaggcaggggccgagggggtgcttggtgccaaactgaaattcagtttcttgtgtggggccttgcggttcagagctcttggcgagggtggagggaggagtgtcatttctatgtgtaatttctgagccattgtactgtctgggctgggggggacactgtccaagggagtggcccctatgagtttatattttaaccactgcttcaaatctcgatttcactttttttatttatccagttatatctacatatctgtcatctaaataaatggctttcaaacaaagcaactgggtcattaaaaccagctcaaagggggtttaaaaaaaaaaaaccagcccatcctttgaggctgatttttcttttttttaagttctattttaaaagctatcaaacagcgacatagccatacatctgactgcctgacatggactcctgcccacttgggggaaaccttatacccagaggaaaatacacacctggggagtacatttgacaaatttcccttaggatttcgttatctcaccttgaccctcagccaagattggtaaagctgcgtcctggcgattccaggagacccagctggaaacctggcttctccatgtgaggggatgggaaaggaaagaagagaatgaagactacttagtaattcccatcaggaaatgctgaccttttacataaaatcaaggagactgctgaaaatctctaagggacaggattttccagatcctaattggaaatttagcaataaggagaggagtccaaggggacaaataaaggcagagagaagagacagaactaaaaatacgaggaaaggagagtgaggattttcattaaaagtctcagcagtgggtttcttgggttatttaaaacatcacctaaataggccttttcttcctaattggccatcaaattaaagcctatcctttctcaagcaggagctggtattgtagggagtggccgggtattctgggctgggctcttctggagtagggggtcagcaaacattgtctgcaaagggccagatactgaatccagtactttcagtttggcgagccgtgaggtctctgtcgaaactactcaactctgccgtcctagcacaaaagcagccatagacaacacacaaacgagagggcttggctcccttccaggaagatttatttaacaggctcccagctgaatttcactcacaggacacagtttactgatctctgttctagtgagtgggtcaaaaagcatatgcatccttatccgtcaactcatcagctcttcctcaaggcaacctgaggccagacaccaagaaaccaagcgtatctgctctaaaatgacttgttcctggggaatgccttcaaccaaaacacagctagtatttctatgccccaaatccaatcccagtctttcatgatccatgccggcggttgggtggggaggggaatcattggttgggggaagggaggaaaccccacctccagcccccgccaccgggctccctgggcacccagcaagatctggggctgcagagaacagaagagctggtgcacttaatccagctctgcccttggggggaggaggacctgtgtgtcaggctctgccatgggaacgagtgtaaaccgtggctgtctcctgcagtgagccaccgcggcaggcacgttgactgttttactgacatcactcaaaagctaaagcaataacattctcctgcgttgctgagtcagctgttcatttgtccgccagctcctggactggatgtgtgaaaggcatcacatttccattttcctccgtgtaaatgttttatgtgttcgcctactgatcccattcgttgcttctattgtaaatatttgtcatttgtatttattatctctgtgttttccccctaaggcataaaatggtttactgtgttcatttgaacccatttactgatctctgttgtatatttttcatgccactgctttgttttctcctcagaagtcgggtagatagcatttctatcccatccctcacgttattggaagcatgcaacagtatttattgctcagggtcttctgcttaaaactgaggaaggtccacattcctgcaagcattgattgagacatttgcacaatctaaaatgtaagcaaagtagtcattaaaaatacaccctctacttgggctttatactgcatacaaatttactcatgagccttcctttgaggaaggatgtggatctccaaataaagatttagtgtttattttgagctctgcatcttaacaagatgatctgaacacctctcctttgtatcaataaatagccctgttattctgaagtgagaggaccaagtatagtaaaatgctgacatctaaaactaaataaatagaaaacaccaggccagaactatagtcatactcacacaaagggagaaatttaaactcgaaccaagcaaaaggcttcacggaaatagcatggaaaaacaatgcttccagtggccacttcctaaggaggaacaaccccgtctgatctcagaattggcaccacgtgagcttgctaagtgataatatctgtttctactacggatttaggcaacaggacctgtacattgtcacattgcattatttttcttcaagcgttaataaaagttttaaataaatggcttccacttga

SEQ ID NO: 186613 - DNA, 473 bp, Homo sapiens
  Payload ID: 16748
  Gene Symbol: STC2
  Gene Name: stanniocalcin 2
  ENST ID: ENST00000518455
  CDS Start-End: 314-473
tgccccttccgagagaggactgggggccacattcggtgaagggctgcaagcttcctcccgggctgcgggaattctaggggattgggtgatacctcacccggatccctaattaaaaggagcctgcaacctctgatagtggcgtttctgaaggctcgcccccagctgactccactcctaagcctgctcgccaaccgcagcttccctagctgcggagatccagcactgtttggtcaacgctggcgatgtggggtgtggcgtgtttgaatgtttcgagaacaactcttgtgagattcggggcttacatgggatttgcatgacttttctgcacaacgctggaaaatttgatgcccagggcaagtcattcatcaaagacgccttgaaatgtaaggcccacgctctgcggcacaggttcggctgcataagccggaagtgcccggccatcagggaaatggtgtcccagttgcagcgggaat

SEQ ID NO: 186614 - DNA, 616 bp, Homo sapiens
  Payload ID: 16748
  Gene Symbol: STC2
  Gene Name: stanniocalcin 2
  ENST ID: ENST00000520648
  CDS Start-End: 1-370
gcagaatacagcggagatccagcactgtttggtcaacgctggcgatgtggggtgtggcgtgtttgaatgtttcgagaacaactcttgtgagattcggggcttacatgggatttgcatgacttttctgcacaacgctggaaaatttgatgcccagggcaagtcattcatcaaagacgccttgaaatgtaaggcccacgctctgcggcacaggttcggctgcataagccggaagtgcccggccatcagggaaatggtgtcccagttgcagcgggaatgctacctcaagcacgacctgtgcgcggctgcccaggagaacacccgggtgatagtggagatgatccatttcaaggacttgctgctgcacgagtgagtactgccccgcagagggcctgggtgaaggggccacccagcaaggatggcaatgtgtatgggaggagagccgcgttgcttctagaggctgaatgcctgtcaaatggagaaggcttccatttacttcagaaagctacactgactctactaaaaggcccctttcctgctggcttttaggaaaagagagaattccctcatcagtctcaaaatcacaagcaacagaaatgggaaatcgttttactaagaa

SEQ ID NO: 186615 - DNA, 3476 bp, Homo sapiens
  Payload ID: 16749
  Gene Symbol: SND1
  Gene Name: staphylococcal nuclease and tudor domain containing 1
  Uniprot ID: Q7KZF4
  ENST ID: ENST00000354725
  CDS Start-End: 195-2927
ggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcgcagagcggcggctcctccgggggacccgcggtccccaccgtgcagcggggcatcatcaagatggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgagccctgggcatttccagctcgagagttccttcgaaagaagctgattgggaaggaagtctgtttcacgatagaaaacaagactccccaggggcgagagtatggcatgatctaccttggaaaagataccaatggggaaaacattgcagaatcactggttgcagagggcttagccacccggagagaaggcatgagagctaataatcctgagcagaaccggctttcagaatgtgaagaacaagcaaaggcagccaagaaagggatgtggagtgaggggaacggttcacatactatccgggatctcaagtataccattgaaaacccaaggcactttgtggactcacaccaccagaagcctgttaatgctatcatcgagcatgtgcgggacggcagtgtggtcagggccctgctcctcccagattactacctggttacagtcatgctgtcaggcatcaagtgcccaacttttcgacgggaagcagatggcagtgaaactccagagccttttgctgcagaagccaaatttttcactgagtcgcgactgcttcagagagatgttcagatcattctggagagctgccacaaccagaacattctgggtaccatccttcatccaaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgactgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagcccttattgatca

SEQ ID NO: 186616 - DNA, 695 bp, Homo sapiens
  Payload ID: 16749
  Gene Symbol: SND1
  Gene Name: staphylococcal nuclease and tudor domain containing 1
  ENST ID: ENST00000486037
  CDS Start-End: 1-695
gaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtctgggcccactatgaggagcagcccgtggaggaggtgatgccagtgctggaggagaaggagcgatctgctagctacaagcccgtgtttgtgactgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggta

SEQ ID NO: 186617 - DNA, 3420 bp, Homo sapiens
  Payload ID: 16750
  Gene Symbol: STBD1
  Gene Name: starch binding domain 1
  Uniprot ID: O95210
  ENST ID: ENST00000237642
  CDS Start-End: 745-1821
gagctgactggcatctttagatggatggtcctcagtccagtccttccattttacaggcgaggaggcggaagcttggggaggctaagcgcgctgagctggcggcggagcggagcttccactagggctcccagtttccccgcaccgcgcccgccgtcctccgggccacccatcccacccgaacgcgccaccgctctagcccgcgctccagcccgcgcgtcaccgacgcccgcggcctctcccacctctaagttccaggaagctctcggcctctagctgaccgcgttgctgctgagcttccctggggagaaggcgccgaggtgcccggtgcgggccgaggcagggctgggcctcgcgggcagcaggcggaagaaggaagggcggtggggcaggtcccggctgcgcggggcagttgtgcgcacttgggttcttcacgcgggacacacgtggaacgccgacccctgcgcccctggccgctggcaactggcaaggccgggaacagaaagtgtagggacagaagagcgctggagtcttccccgggagggagcccggggctgcagcccaggggcggggagcggggcggggctgggaaagttgagtactggtcgctcagggccgggctccgccggagtgcccggcgcagaaaccgtaaaaggctggagcgggcggggtaggtgtggctctgtgtgcgtgacctgagccccggtcccagtccctgtagtctcctgcggccgcggcctctcagccatgggcgccgtctggtccgccctgctggttggagggggtctggccggagcacttttcgtttggctgctgcggggcggccctggcgacaccgggaaggacggggatgcggagcaggagaaagacgcccctcttgggggagctgcgattccgggaggccatcagagtggcagcagcggactgagccctggaccttccgggcaggagctggtcaccaaaccagagcatcttcaagaaagcaatggacatttgatttctaagaccaaagaccttggtaaactgcaagcagcatcatggagattgcagaatccttccagggaagtctgtgacaattcaagagaacatgttccttctggacagtttccagacacagaagctccagctacctctgagaccagtaactctaggagttactctgaagtttcaagaaatgaaagccttgaatctcctatgggagaatggggattccaaaaaggacaagagatatctgctaaagcagctacatgttttgcagagaagttgccttctagcaacctgctcaagaacagagctaaagaagaaatgagcctctctgatttgaacagtcaggaccgggttgaccacgaggagtgggaaatggtgcctaggcactcatcttggggggatgttggtgtgggtggcagtcttaaggctccagtgttaaacctaaaccagggaatggacaatggaagaagcactttggtggaagcaagaggtcagcaagtgcatgggaaaatggaaagggtagcagtgatgcctgcagggtctcagcaagttagtgtcaggttccaggtccattatgtcacaagcactgatgtgcaattcattgcagtaactggagaccatgagtgtcttgggagatggaacacttacatcccactccactataacaaggatgggttctggtctcattccattttcctgcctgcagatacagtggtggagtggaagtttgtgttggtagagaatgggggagttacccgctgggaagaatgcagcaatagattcctagaaactggccatgaggataaagtggttcacgcatggtgggggattcactgattcagtttgcaaagtaatggagaagctgtagaacaatgtggaagaggctgaggttgtggaacacactgaataaaataaaggcagtgtgactccaaattcagccatctgaattgtttaaatttgctagtggattttgtctaatgtgcagaaatatatatgtctaatgtgcagaaatatatatgtgtgtatgtgtgtatatatatgcacacacacacagataatgcttccagtgaatgtgaacttcttttccctgtggcactgattgacagacttgtgctgatccattattactttagggcttgattctcttggggagtgacttggctaagcttcaggtgtaaactgtggtcacggagcaaaaacattaaccagctgcccagggttcaagcttgagcctttaggtgatctttaaactatggtagtaaaataagcctcactcaaacatagctgacttcctattggtacagcttgaaaagcactttttactacatacacattttatgcttaaaaagttaacatgatacgaaactgtgattagaaaatatctggtctggatgtgattagtaaggatacaagataatgttctaagactgcctaatgctttttgtttgattttcatctgccaggcgttgttatgtgctatgagggtagcaagtacgtctttgtcttaatgatctaaggctggtgtagaaacaaagggcctaatgagaaccaatcatcatggaagtcagttgcgggggcagcccataaggaaagggaaagtgagtggggttgggcataggctgagtgaggtggcctgaatgacacctcttagaggactgtgaagtacaggcacagcccgactgcagggagggatgcacccatcatttacccatgggagcatctgtaggaccatctctctcccacttcttctcccctcccccaccgcatctggccagatggactgtcctacagcaatcgtttccatctgtcaccctcttccctctcctttcataccagtcactatcttgggtaacaaatttatacaggacagtggtacagaaatacatctttgctctgagaatacagcaaatattaacttaaattattataactgaacaaataataaaacctgaattttaatatcttcatttgatgtctgaattatttgtctaaattttagtatcacaatagcctagatgtaaaataaaatacaaatattttcctccactaataagagacatatacagaaaagcaaacatcaaaaggtacagaagacatgaagattctgtttttctcctccctttggagaaaaagttgacaatatttattctcaaagttcacctttgactggagggaaattcagcacgcctgtacttgaaaatgaattcttacatgttaaaataacttttaataagtttaacatctatcagtgaaataatgtttaatccttttaaacagatggtctttgctgaaaagaataaacccaactgaaaatagcattagaaagtacttaaaagaactatgtttgacagtttttggctcatagcacttttatgttaaattcatgtatactgtttacagacttcataatgaattttatattgtaccagtaagctc

SEQ ID NO: 186618 - DNA, 1728 bp, Homo sapiens
  Payload ID: 16751
  Gene Symbol: STARD3NL
  Gene Name: STARD3 N-terminal like
  Uniprot ID: O95772
  ENST ID: ENST00000009041
  CDS Start-End: 258-962
gtgtgcgtcgacgtcagcgtgctgacgtcacgggccggaggtcccggggctgctgggtgcgggcggtgggctgcgcgttgtccgctggactgggtcccggtcacgccccgccaagccccgcccctcaggccggggcgcgaccgcggatccgcagttcccgggccagcctggggcggccggccaggaaccacccgttaaggtgtcttctctttagggatggtgaggttggaaaaaggctcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattcttcatattttgatatatttcttctggcagtttttcgatttaaagtgttaatacttgcatatgctgtgtgcagactgcgccattggtgggcaatagcgttgacaacggcagtgaccagtgcctttttactagcaaaagtgatcctttcgaagcttttctctcaaggggcttttggctatgtgctgcccatcatttcattcatccttgcctggattgagacgtggttcctggatttcaaagtgttacctcaagaagcagaagaagaaaacagactcctgatagttcaggatgcttcagagagggcagcacttatacctggtggtctttctgatggtcagttttattcccctcctgaatccgaagcaggatctgaagaagctgaagaaaaacaggacagtgagaaaccacttttagaactatgagtactacttttgttaaatgtgaaaaaccctcacagaaagtcatcgaggcaaaaagaggcaggcagtggagtctccctgtcgacagtaaagttgaaatggtgacgtccactgctggctttattgaacagctaataaagatttatttattgtaatacctcacagacgttgtaccatatccatgcacatttagttgcctgcctgtggctggtaaggtaatgtcatgattcatcctctcttcagtgagactgagcctgatgtgttaacaaataggtgaagaaagtcttgtgctgtattcctaatcaaaagacttaatatattgaagtaacacttttttagtaagcaagatacctttttatttcaattcacagaatggaatttttttgtttcatgtctcagatttattttgtatttcttttttaacactctacatttcccttgttttttaactcatgcacatgtgctctttgtacagttttaaaaagtgtaataaaatctgacatgtcaatgtggctagttttatttttcttgttttgcattatgtgtatggcctgaagtgttggacttgcaaaaggggaagaaaggaattgcgaatacatgtaaaatgtcaccagacatttgtattatttttatcatgaaatcatgtttttctctgattgttctgaaatgttctaaatactcttattttgaatgcacaaaatgacttaaaccattcatatcatgtttcctttgcgttcagccaatttcaattaaaatgaactaaattata

SEQ ID NO: 186619 - DNA, 1365 bp, Homo sapiens
  Payload ID: 16751
  Gene Symbol: STARD3NL
  Gene Name: STARD3 N-terminal like
  Uniprot ID: O95772
  ENST ID: ENST00000396013
  CDS Start-End: 185-889
ccggggcgcgaccgcggatccgcagttcccgggccagcctggggcggccggccaggaaccacccgttaagatggaatcactgaattcatcacttgacacagtactagtttggataagtttagcaaggtgtcttctctttagggatggtgaggttggaaaaaggctcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattcttcatattttgatatatttcttctggcagtttttcgatttaaagtgttaatacttgcatatgctgtgtgcagactgcgccattggtgggcaatagcgttgacaacggcagtgaccagtgcctttttactagcaaaagtgatcctttcgaagcttttctctcaaggggcttttggctatgtgctgcccatcatttcattcatccttgcctggattgagacgtggttcctggatttcaaagtgttacctcaagaagcagaagaagaaaacagactcctgatagttcaggatgcttcagagagggcagcacttatacctggtggtctttctgatggtcagttttattcccctcctgaatccgaagcaggatctgaagaagctgaagaaaaacaggacagtgagaaaccacttttagaactatgagtactacttttgttaaatgtgaaaaaccctcacagaaagtcatcgaggcaaaaagaggcaggcagtggagtctccctgtcgacagtaaagttgaaatggtgacgtccactgctggctttattgaacagctaataaagatttatttattgtaatacctcacagacgttgtaccatatccatgcacatttagttgcctgcctgtggctggtaaggtaatgtcatgattcatcctctcttcagtgagactgagcctgatgtgttaacaaataggtgaagaaagtcttgtgctgtattcctaatcaaaagacttaatatattgaagtaacacttttttagtaagcaagatacctttttatttcaattcacagaatggaatttttttgtttcatgtctcagatttattttgtatttcttttttaacactctacatttcccttgttttttaactcatgcacatgtgctctttgtacagtttt

SEQ ID NO: 186620 - DNA, 1341 bp, Homo sapiens
  Payload ID: 16751
  Gene Symbol: STARD3NL
  Gene Name: STARD3 N-terminal like
  ENST ID: ENST00000434197
  CDS Start-End: 217-867
tcccggggctgctgggtgcgggcggtgggctgcgcgttgtccgctggactgggtcccggtcacgccccgccaagccccgcccctcaggccggggcgcgaccgcggatccgcagttcccgggccagcctggggcggccggccaggaaccacccgttaaggtgtcttctctttagggatggtgaggttggaaaaaggctcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattcttcatattttgatatatttcttctggcagtttttcgatttaaagtgttaatacttgcatatgctgtgtgcagactgcgccattggtgggcaatagcgcttttctctcaaggggcttttggctatgtgctgcccatcatttcattcatccttgcctggattgagacgtggttcctggatttcaaagtgttacctcaagaagcagaagaagaaaacagactcctgatagttcaggatgcttcagagagggcagcacttatacctggtggtctttctgatggtcagttttattcccctcctgaatccgaagcaggatctgaagaagctgaagaaaaacaggacagtgagaaaccacttttagaactatgagtactacttttgttaaatgtgaaaaaccctcacagaaagtcatcgaggcaaaaagaggcaggcagtggagtctccctgtcgacagtaaagttgaaatggtgacgtccactgctggctttattgaacagctaataaagatttatttattgtaatacctcacagacgttgtaccatatccatgcacatttagttgcctgcctgtggctggtaaggtaatgtcatgattcatcctctcttcagtgagactgagcctgatgtgttaacaaataggtgaagaaagtcttgtgctgtattcctaatcaaaagacttaatatattgaagtaacacttttttagtaagcaagatacctttttatttcaattcacagaatggaatttttttgtttcatgtctcagatttattttgtatttcttttttaacactctacatttcccttgttttttaactcatgcacatgtgctctttgtacagtt

SEQ ID NO: 186621 - DNA, 859 bp, Homo sapiens
  Payload ID: 16751
  Gene Symbol: STARD3NL
  Gene Name: STARD3 N-terminal like
  ENST ID: ENST00000453225
  CDS Start-End: 343-859
tggggcggccggccaggaaccacccgttaagggtcttactctgttgcccaggctggagtgcagtggcaccatctcagctcactggagcgtctgcctccaggttcaagtgattctcctgcctcagcatcccaagtagctgggactacaggtgtgcactaccactcctgtctaatgtttgtattttttggtagagacagggtttccctatgttggccagtctggtcttgaactgctggcctcaagtgatctgcccgcctcggcctcctaaagtgctgggattacaggtgtcttctctttagggatggtgaggttggaaaaaggctcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattcttcatattttgatatatttcttctggcagtttttcgatttaaagtgttaatacttgcatatgctgtgtgcagactgcgccattggtgggcaatagcgttgacaacggcagtgaccagtgcctttttactagcaaaagtgatcctttcgaagcttttctctcaaggggcttttggctatgtgctgcccatcatttcattcatccttgcctggattgagacgtggttcctggatt

SEQ ID NO: 186622 - DNA, 857 bp, Homo sapiens
  Payload ID: 16751
  Gene Symbol: STARD3NL
  Gene Name: STARD3 N-terminal like
  ENST ID: ENST00000429075
  CDS Start-End: 240-857
cggccggccaggaaccacccgttaagatggatccatgtaggccccaccgtttttgcctgtaaaaagagtcagaaagatcaggctggcaaagtcaattgcctccaggctaggtgaagattgaggccaactggagagtgcgtgccccactgaaagtggtcagcagcttggctttattatcatggtgtcttctctttagggatggtgaggttggaaaaaggctcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattcttcatattttgatatatttcttctggcagtttttcgatttaaagtgttaatacttgcatatgctgtgtgcagactgcgccattggtgggcaatagcgttgacaacggcagtgaccagtgcctttttactagcaaaagtgatcctttcgaagcttttctctcaaggggcttttggctatgtgctgcccatcatttcattcatccttgcctggattgagacgtggttcctggatttcaaagtgttacctcaagaagcagaagaagaaaacagactcctgatagttcaggatgcttcagagagggcagcacttatacctggtggtctttctgatggt

SEQ ID NO: 186623 - DNA, 784 bp, Homo sapiens
  Payload ID: 16751
  Gene Symbol: STARD3NL
  Gene Name: STARD3 N-terminal like
  ENST ID: ENST00000440144
  CDS Start-End: 232-784
ttcccgggccagcctggggcggccggccaggaaccacccgttaagaattaactcctagaattctgacaggcggtagtgctttgcaagctttgtgttaagagctgctactggggaatatgttgttgctgtaccttccactagggtggcattgatctcattaagacagaaattatgtgtcttctctttagggatggtgaggttggaaaaaggctcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattcttcatattttgatatatttcttctggcagtttttcgatttaaagtgttaatacttgcatatgctgtgtgcagactgcgccattggtgggcaatagcgttgacaacggcagtgaccagtgcctttttactagcaaaagtgatcctttcgaagcttttctctcaaggggcttttggctatgtgctgcccatcatttcattcatccttgcctggattgagacgtggttcctggatttcaaagtgttacctcaagaagcagaagaagaaaaca

SEQ ID NO: 186624 - DNA, 1963 bp, Homo sapiens
  Payload ID: 16752
  Gene Symbol: STARD10
  Gene Name: StAR-related lipid transfer (START) domain containing 10
  Uniprot ID: Q9Y365
  ENST ID: ENST00000334805
  CDS Start-End: 921-1796
acgtgggggcgcctgagcgaagataaccgtaataaatagtaacctaacggtccagtcatcgttctgtggtcctttcttttatgattcacaaggaatgaccctcttcatcgcctctcctaattcagtcctcacaacagtccttttacaaatgggacaacaggttagaggaagtcaggcagatttccagcatcatagagagtaaaggaccagggaaggatcaggattcaaggactgcacccaggctctgcttccagcttgctgtgtgactttgggtaattttgttcccttagggaactgagctttctcatttgtaaatgcaaacaggctgttgggaggatcaaatgagatccaggggtgaaaacagcttagtttactttcaggaatttacccacgcggtatataaaggcaaaatattattatagtcaggtgattgtagattgaggaacccatttcctcattctgcaaattgcaaacctgagggcccaaagagggacaggggcttgccccaggtctcagcaggctgtgagcaagagctaaagcctaatcctcctgcctttgggcctggagcccttccttgtaccccaggggtcagtgtctttgttggatacaggcttagattgactgactgtaccctgagaacctaggggagtccctgttcccaattcttctcctacccccaccttggcctgatggaggaagaccctgctgtgttgagatgagcaccagagccaagaagctgaggaggatctggagaattctggaggaagaggagagtgttgctggagctgtacagaccctgcttctcaggtcccaggaaggtggcgtcagcatctgcagccgcgtcgacgttgtcggagcctccgcggaggacccaggagagccggactaggaccagggccctgggcctccccacactccccatggagaagctggcggcctctacagagccccaagggcctcggccggtcctgggccgtgagagtgtccaggtgcccgatgaccaagactttcgcagcttccggtcagagtgtgaggctgaggtgggctggaacctgacctatagcagggctggggtgtctgtctgggtgcaggctgtggagatggatcggacgctgcacaagatcaagtgccggatggagtgctgtgatgtgccagccgagacactctacgacgtcctacacgacattgagtaccgcaagaaatgggacagcaacgtcattgagacttttgacatcgcccgcttgacagtcaacgctgacgtgggctattactcctggaggtgtcccaagcccctgaagaaccgtgatgtcatcaccctccgctcctggctccccatgggcgctgattacatcattatgaactactcagtcaaacatcccaaatacccacctcggaaagacttggtccgagctgtgtccatccagacgggctacctcatccagagcacagggcccaagagctgcgtcatcacctacctggcccaggtggaccccaaaggctccttacccaagtgggtggtgaataaatcttctcagttcctggctcccaaggccatgaagaagatgtacaaggcgtgcctcaagtaccccgagtggaaacagaagcacctgcctcacttcaagccgtggctgcacccggagcagagcccgttgccgagcctggcgctgtcggagctgtcggtgcagcatgcggactcactggagaacatcgacgagagcgcggtggccgagagcagagaggagcggatgggcggcgcgggcggcgagggcagcgacgacgacacctcgctcacctgagcgccgcaccgcttcagggacggagacaggaccgggcgagccctggggcggcggccgctcctgcactttctcccctcccccacccggcacctggtggcaccgggccaggcccaggcgggtgctgcagcctggctggacagagccccaataaacgatcccacagcctc

SEQ ID NO: 186625 - DNA, 509 bp, Homo sapiens
  Payload ID: 16752
  Gene Symbol: STARD10
  Gene Name: StAR-related lipid transfer (START) domain containing 10
  ENST ID: ENST00000544767
  CDS Start-End: 1-509
tgccggatggagtgctgtgatgtgccagccgagacactctacgacgtcctacacgacattgagtaccgcaagaaatgggacagcaacgtcattgagacttttgacatcgcccgcttgacagtcaacgctgacgtgggctattactcctggaggtgtcccaagcccctgaagaaccgtgatgtcatcaccctccgctcctggctccccatgggcgctgattacatcattatgaactactcagtcaaacatcccaaatacccacctcggaaagacttggtccgagctgtgtccatccagacgggctacctcatccagagcacagggcccaagagctgcgtcatcacctacctggcccaggtggaccccaaaggctccttacccaagtgggtggtgaataaatcttctcagttcctggctcccaagccgtggctgcacccggagcagagcccgttgccgagcctggcgctgtcggagctgtcggtgcagcatgcggactcactggagaacat

SEQ ID NO: 186626 - DNA, 1513 bp, Homo sapiens
  Payload ID: 16752
  Gene Symbol: STARD10
  Gene Name: StAR-related lipid transfer (START) domain containing 10
  Uniprot ID: Q9Y365
  ENST ID: ENST00000543304
  CDS Start-End: 470-1345
aaccgtaataaatagtaacctaacggtccagtcatcgttctgtggtcctttcttttatgattcacaaggaatgaccctcttcatcgcctctcctaattcagtcctcacaacagtccttttacaaatgggacaacaggttagaggaagtcaggcagatttccagcatcatagagagtaaaggaccagggaaggatcaggattcaaggactgcacccaggctctgcttccagcttgctgtgtgactttggaccctgctgtgttgagatgagcaccagagccaagaagctgaggaggatctggagaattctggaggaagaggagagtgttgctggagctgtacagaccctgcttctcaggtcccaggaaggtggcgtcagcatctgcagccgcgtcgacgttgtcggagcctccgcggaggacccaggagagccggactaggaccagggccctgggcctccccacactccccatggagaagctggcggcctctacagagccccaagggcctcggccggtcctgggccgtgagagtgtccaggtgcccgatgaccaagactttcgcagcttccggtcagagtgtgaggctgaggtgggctggaacctgacctatagcagggctggggtgtctgtctgggtgcaggctgtggagatggatcggacgctgcacaagatcaagtgccggatggagtgctgtgatgtgccagccgagacactctacgacgtcctacacgacattgagtaccgcaagaaatgggacagcaacgtcattgagacttttgacatcgcccgcttgacagtcaacgctgacgtgggctattactcctggaggtgtcccaagcccctgaagaaccgtgatgtcatcaccctccgctcctggctccccatgggcgctgattacatcattatgaactactcagtcaaacatcccaaatacccacctcggaaagacttggtccgagctgtgtccatccagacgggctacctcatccagagcacagggcccaagagctgcgtcatcacctacctggcccaggtggaccccaaaggctccttacccaagtgggtggtgaataaatcttctcagttcctggctcccaaggccatgaagaagatgtacaaggcgtgcctcaagtaccccgagtggaaacagaagcacctgcctcacttcaagccgtggctgcacccggagcagagcccgttgccgagcctggcgctgtcggagctgtcggtgcagcatgcggactcactggagaacatcgacgagagcgcggtggccgagagcagagaggagcggatgggcggcgcgggcggcgagggcagcgacgacgacacctcgctcacctgagcgccgcaccgcttcagggacggagacaggaccgggcgagccctggggcggcggccgctcctgcactttctcccctcccccacccggcacctggtggcaccgggccaggcccaggcgggtgctgcagcctggctggacagagccccaataaacgatcccacagcctca

SEQ ID NO: 186627 - DNA, 798 bp, Homo sapiens
  Payload ID: 16752
  Gene Symbol: STARD10
  Gene Name: StAR-related lipid transfer (START) domain containing 10
  ENST ID: ENST00000536377
  CDS Start-End: 405-798
aaggaatgaccctcttcatcgcctctcctaattcagtcctcacaacagtccttttacaaatgggacaacaggttagaggaagtcaggcagatttccagcatcatagagagtaaaggaccagggaaggatcaggattcaaggactgcacccaggctctgcttccagcttgctgtgtgactttggaccctgctgtgttgagatgagcaccagagccaagaagctgaggaggatctggagaattctggaggaagaggagagtgttgctggagctgtacagaccctgcttctcaggtcccaggaaggtggcgtcagcatctgcagccgcgtcgacgttgtcggagcctccgcggaggacccaggagagccggactaggaccagggccctgggcctccccacactccccatggagaagctggcggcctctacagagccccaagggcctcggccggtcctgggccgtgagagtgtccaggtgcccgatgaccaagactttcgcagcttccggtcagagtgtgaggctgaggtgggctggaacctgacctatagcagggctggggtgtctgtctgggtgcaggctgtggagatggatcggacgctgcacaagatcaagcctcctgcagggactcaggattgtggctggcagatcctgaaggcagggctccaatacccctgccttgcacagagccaggctacagggcaggcttggggtttgggaccctgggaacgcatatcccccaggggaccagatggggcaggggctcgtgaagactctggtttaagggcctcaatagctgccc

SEQ ID NO: 186628 - DNA, 1678 bp, Homo sapiens
  Payload ID: 16752
  Gene Symbol: STARD10
  Gene Name: StAR-related lipid transfer (START) domain containing 10
  ENST ID: ENST00000538536
  CDS Start-End: 883-1620
gtaacctaacggtccagtcatcgttctgtggtcctttcttttatgattcacaaggaatgaccctcttcatcgcctctcctaattcagtcctcacaacagtccttttacaaatgggacaacaggttagaggaagtcaggcagatttccagcatcatagagagtaaaggaccagggaaggatcaggattcaaggactgcacccaggctctgcttccagcttgctgtgtgactttgggtaattttgttcccttagggaactgagctttctcatttgtaaatgcaaacaggctgttgggaggatcaaatgagatccaggggtgaaaacagcttagtttactttcaggaatttacccacgcggtatataaaggcaaaatattattatagtcaggtgattgtagattgaggaacccatttcctcattctgcaaattgcaaacctgagggcccaaagagggacaggggcttgccccaggtctcagcaggctgtgagcaagagctaaagcctaatcctcctgcctttgggcctggagcccttccttgtaccccaggggtcagtgtctttgttggatacaggcttagattgactgactgtaccctgagaacctaggggagtccctgttcccaattcttctcctacccccaccttggcctgatggaggaagaccctgctgtgttgagatgagcaccagagccaagaagctgaggaggatctggagaattctggaggaagaggagagtgttgctggagctgtacagaccctgcttctcaggtcccaggaaggtggcgtcagcatctgcagccgcgtcgacgttgtcggagcctccgcggaggacccaggagagccggactaggaccagggccctgggcctccccacactccccatggagaagctggcggcctctacagagccccaagggcctcggccggtcctgggccgtgagagtgtccagtgccggatggagtgctgtgatgtgccagccgagacactctacgacgtcctacacgacattgagtaccgcaagaaatgggacagcaacgtcattgagacttttgacatcgcccgcttgacagtcaacgctgacgtgggctattactcctggaggtgtcccaagcccctgaagaaccgtgatgtcatcaccctccgctcctggctccccatgggcgctgattacatcattatgaactactcagtcaaacatcccaaatacccacctcggaaagacttggtccgagctgtgtccatccagacgggctacctcatccagagcacagggcccaagagctgcgtcatcacctacctggcccaggtggaccccaaaggctccttacccaagtgggtggtgaataaatcttctcagttcctggctcccaaggccatgaagaagatgtacaaggcgtgcctcaagtaccccgagtggaaacagaagcacctgcctcacttcaagccgtggctgcacccggagcagagcccgttgccgagcctggcgctgtcggagctgtcggtgcagcatgcggactcactggagaacatcgacgagagcgcggtggccgagagcagagaggagcggatgggcggcgcgggcggcgagggcagcgacgacgacacctcgctcacctgagcgccgcaccgcttcagggacggagacaggaccgggcgagccctggggcggcggccgc

SEQ ID NO: 186629 - DNA, 558 bp, Homo sapiens
  Payload ID: 16752
  Gene Symbol: STARD10
  Gene Name: StAR-related lipid transfer (START) domain containing 10
  ENST ID: ENST00000540587
  CDS Start-End: 524-558
aaccgtaataaatagtaacctaacggtccagtcatcgttctgtggtcctttcttttatgattcacaaggaatgaccctcttcatcgcctctcctaattcagtcctcacaacagtccttttacaaatgggacaacaggttagaggaagtcaggcagatttccagcatcatagagagtaaaggaccagggaaggatcaggattcaaggactgcacccaggctctgcttccagcttgctgtgtgactttggaccctgctgtgttgagatgagcaccagagccaagaagctgaggaggatctggagaattctggaggaagaggagagtgttgctggagctgtacagaccctgcttctcagaggaggaaagagaatcccagagaggccagaactcactgagagccccacggcgaggtcccaggaaggtggcgtcagcatctgcagccgcgtcgacgttgtcggagcctccgcggaggacccaggagagccggactaggaccagggccctgggcctccccacactccccatggagaagctggcggcctctacagagccccaagg

SEQ ID NO: 186630 - DNA, 460 bp, Homo sapiens
  Payload ID: 16752
  Gene Symbol: STARD10
  Gene Name: StAR-related lipid transfer (START) domain containing 10
  ENST ID: ENST00000535054
  CDS Start-End: 286-460
ccccagcctagccgggaggggcgcgcggggctggggcccggggcggggccgggcggcgggacccactgctcctcccaccagagcccccgcgcggccccgggtctcccgggcagctgcggcggcggcgctggcaccccggccccggcgggccccggcggagcggcgggcaaaggtcccaggaaggtggcgtcagcatctgcagccgcgtcgacgttgtcggagcctccgcggaggacccaggagagccggactaggaccagggccctgggcctccccacactccccatggagaagctggcggcctctacagagccccaagggcctcggccggtcctgggccgtgagagtgtccagtgccggatggagtgctgtgatgtgccagccgagacactctacgacgtcctacacgacattgagtaccgcaagaaatgggacagcaacgtcattgagacttttgaca

SEQ ID NO: 186631 - DNA, 511 bp, Homo sapiens
  Payload ID: 16752
  Gene Symbol: STARD10
  Gene Name: StAR-related lipid transfer (START) domain containing 10
  ENST ID: ENST00000539138
  CDS Start-End: 266-511
ccttgttgccctgcacaacctgtgaatttgctccatcaaaactggcaggcagggttacccctgaggagggggtgggggagaaggggtaggggtgggaccctatcatctcccagaggggagatcaaggcagccatcatctgtcgaactagatggtcccaggaaggtggcgtcagcatctgcagccgcgtcgacgttgtcggagcctccgcggaggacccaggagagccggactaggaccagggccctgggcctccccacactccccatggagaagctggcggcctctacagagccccaagggcctcggccggtcctgggccgtgagagtgtccaggtgcccgatgaccaagactttcgcagcttccggtcagagtgtgaggctgagtgccggatggagtgctgtgatgtgccagccgagacactctacgacgtcctacacgacattgagtaccgcaagaaatgggacagcaacgtcattgagacttttgacatcgcccgcttgacagtcaac

SEQ ID NO: 186632 - DNA, 451 bp, Homo sapiens
  Payload ID: 16752
  Gene Symbol: STARD10
  Gene Name: StAR-related lipid transfer (START) domain containing 10
  ENST ID: ENST00000536728
  CDS Start-End: 1-451
tgccggatggagtgctgtgatgtgccagccgagacactctacgacgtcctacacgacattgagtaccgcaagaaatgggacagcaacgtcattgagacttttgacatcgcccgcttgacagtcaacgctgacgtgggctattactcctggaggtgtcccaagcccctgaagaaccgtgatgtcatcaccctccgctcctggctccccatgggcgctgattacatcattatgaactactcagtcaaacatcccaaatacccacctcggaaagacttggtccgagctgtgtccatccagacgggctacctcatccagagcacagggcccaagagctgcgtcatcacctacctggcccaggtggaccccaaaggccatgaagaagatgtacaaggcgtgcctcaagtaccccgagtggaaacagaagcacctgcctcacttcaagccgtggctg

SEQ ID NO: 186633 - DNA, 438 bp, Homo sapiens
  Payload ID: 16752
  Gene Symbol: STARD10
  Gene Name: StAR-related lipid transfer (START) domain containing 10
  ENST ID: ENST00000536290
  CDS Start-End: 172-438
tgctggtggacaagggccagagtgtggggctggagggagtcccggttcaagctcccaggtcccaggaaggtggcgtcagcatctgcagccgcgtcgacgttgtcggagcctccgcggaggacccaggagagccggactaggaccagggccctgggcctccccacactccccatggagaagctggcggcctctacagagccccaagggcctcggccggtcctgggccgtgagagtgtccaggtgcccgatgaccaagactttcgcagcttccggtcagagtgtgaggctgaggtgggctggaacctgacctatagcagggctggggtgtctgtctgggtgcaggctgtggagatggatcggacgctgcacaagatcaagtgccggatggagtgctgtgatgtgccagccgagacactctacgacgtcctacacgacatt

SEQ ID NO: 186634 - DNA, 1085 bp, Homo sapiens
  Payload ID: 16752
  Gene Symbol: STARD10
  Gene Name: StAR-related lipid transfer (START) domain containing 10
  ENST ID: ENST00000545082
  CDS Start-End: 293-1081
cccgagcccccagcctagccgggaggggcgcgcggggctggggcccggggcggggccgggcggcgggacccactgctcctcccaccagagcccccgcgcggccccgggtctcccgggcagctgcggcggcggcgctggcaccccggccccggcgggccccggcggagcggcgggcaaaggtcccaggaaggtggcgtcagcatctgcagccgcgtcgacgttgtcggagcctccgcggaggacccaggagagccggactaggaccagggccctgggcctccccacactccccatggagaagctggcggcctctacagagccccaagggcctcggccggtcctgggccgtgagagtgtccaggtgcccgatgaccaagactttcgcagcttccggtcagagtgtgaggctgagtgccggatggagtgctgtgatgtgccagccgagacactctacgacgtcctacacgacattgagtaccgcaagaaatgggacagcaacgtcattgagacttttgacatcgcccgcttgacagtcaacgctgacgtgggctattactcctggaggtgtcccaagcccctgaagaaccgtgatgtcatcaccctccgctcctggctccccatgggcgctgattacatcattatgaactactcagtcaaacatcccaaatacccacctcggaaagacttggtccgagctgtgtccatccagacgggctacctcatccagagcacagggcccaagagctgcgtcatcacctacctggcccaggtggaccccaaaggctccttacccaagtgggtggtgaataaatcttctcagttcctggctcccaaggccatgaagaagatgtacaaggcgtgcctcaagtaccccgagtggaaacagaagcacctgcctcacttcaagccgtggctgcacccggagcagagcccgttgccgagcctggcgctgtcggagctgtcggtgcagcatgcggactcactggagaacatcgacgagagcgcggtggccgagagcagagaggagcggatgggcggcgcgggcggcgagggcagcgacgacgacacctcgctcacctgagcgc

SEQ ID NO: 186635 - DNA, 839 bp, Homo sapiens
  Payload ID: 16752
  Gene Symbol: STARD10
  Gene Name: StAR-related lipid transfer (START) domain containing 10
  ENST ID: ENST00000542989
  CDS Start-End: 267-839
gccttgttgccctgcacaacctgtgaatttgctccatcaaaactggcaggcagggttacccctgaggagggggtgggggagaaggggtaggggtgggaccctatcatctcccagaggggagatcaaggcagccatcatctgtcgaactagatggtcccaggaaggtggcgtcagcatctgcagccgcgtcgacgttgtcggagcctccgcggaggacccaggagagccggactaggaccagggccctgggcctccccacactccccatggagaagctggcggcctctacagagccccaagggcctcggccggtcctgggccgtgagagtgtccaggtgcccgatgaccaagactttcgcagcttccggtcagagtgtgaggctgaggtgggctggaacctgacctatagcagggctggggtgtctgtctgggtgcaggctgtggagatggatcggacgctgcacaagatcaagtgccggatggagtgctgtgatgtgccagccgagacactctacgacgtcctacacgacattgagtaccgcaagaaatgggacagcaacgtcattgagacttttgacatcgcccgcttgacagtcaacgctgacgtgggctattactcctggaggtgtcccaagcccctgaagaaccgtgatgtcatcaccctccgctcctggctccccatgggcgctgattacatcattatgaactactcagtcaaacatcccaaatacccacctcggaaagacttggtccgagctgtgtccatccagacgggctacctcatccagagcacagggcccaagagctgcgtcatcacctacctggcccaggtggacccc

SEQ ID NO: 186636 - DNA, 541 bp, Homo sapiens
  Payload ID: 16752
  Gene Symbol: STARD10
  Gene Name: StAR-related lipid transfer (START) domain containing 10
  ENST ID: ENST00000400925
  CDS Start-End: 1-364
atacccacctcggaaagacttggtccgagctgtgtccatccagacgggctacctcatccagagcacagggcccaagagctgcgtcatcacctacctggcccaggtggaccccaaaggctccttacccaagtgggtggtgaataaatcttctcagttcctggctcccaaggtgagtggccttgggattttggggaggggtgttgaagactggaaagaggactatggaatgaggtgggtggagtcaagcctggagcctgagggccaggcgtggtggctcatgcctgtaatcccagcactttgggaggccttggcaggtggattacctgaggtcgggagttcaagaccagcctggccaacatggtgaaaccctgtctctactaaaaatacaaaaattagctgagtgtgatggtgggtgcctgtaatcccagctactcgggaggctaaggcaggagaatcacttgaacctggaaggcagaggttgcagtgagccgatatcatgccactgcactccagcctgggccacacagtgagattccgtctc

SEQ ID NO: 186637 - DNA, 1100 bp, Homo sapiens
  Payload ID: 16752
  Gene Symbol: STARD10
  Gene Name: StAR-related lipid transfer (START) domain containing 10
  ENST ID: ENST00000537947
  CDS Start-End: 344-1100
cacctccgcagcctggaaaatcccgagccgcggccgccgagcccccgagcccccgagcccccagcctagccgggaggggcgcgcggggctggggcccggggcggggccgggcggcgggacccactgctcctcccaccagagcccccgcgcggccccgggtctcccgggcagctgcggcggcggcgctggcaccccggccccggcgggccccggcggagcggcgggcaaaggtcccaggaaggtggcgtcagcatctgcagccgcgtcgacgttgtcggagcctccgcggaggacccaggagagccggactaggaccagggccctgggcctccccacactccccatggagaagctggcggcctctacagagccccaagggcctcggccggtcctgggccgtgagagtgtccaggtgcccgatgaccaagactttcgcagcttccggtcagagtgtgaggctgaggtgggctggaacctgacctatagcagggctggggtgtctgtctgggtgcaggctgtggagatggatcggacgctgcacaagatcaagtgccggatggagtgctgtgatgtgccagccgagacactctacgacgtcctacacgacattgagtaccgcaagaaatgggacagcaacgtcattgagacttttgacatcgcccgcttgacagtcaacgctgacgtgggctattactcctggaggtgtcccaagcccctgaagaaccgtgatgtcatcaccctccgctcctggctccccatgggcgctgattacatcattatgaactactcagtcaaacatcccaaatacccacctcggaaagacttggtccgagctgtgtccatccagacgggctacctcatccagagcacagggcccaagagctgcgtcatcacctacctggcccaggtggaccccaaaggctccttacccaagtgggtggtgaataaatcttctcagttcctggctcccaaggccatgaagaagatgtacaaggcgtgcctcaagtaccccgagtggaaacagaagcacctgcctcacttcaagccgtggctgcacccggagcagagcccgttgccgagcctggcgctgtcggagctgt

SEQ ID NO: 186638 - DNA, 426 bp, Homo sapiens
  Payload ID: 16752
  Gene Symbol: STARD10
  Gene Name: StAR-related lipid transfer (START) domain containing 10
  ENST ID: ENST00000537351
  CDS Start-End: 1-426
aaatgggacagcaacgtcattgagacttttgacatcgcccgcttgacagtcaacgctgacgtgggctattactcctggaggtgtcccaagcccctgaagaaccgtgatgtcatcaccctccgctcctggctccccatgggcgctgattacatcattatgaactactcagtcaaacatcccaaatacccacctcggaaagacttggtccgagctgtgtccatccagacgggctacctcatccagagcacagggcccaagagctgcgtcatcacctacctggcccaggtggaccccaaaggctccttacccaagtgggtggtgaataaatcttctcagttcctggctcccaaggccatgaagaagatgtacaaggcgggtgctgcagcctggctggacagagccccaataaacgatcccacagcctca

SEQ ID NO: 186639 - DNA, 620 bp, Homo sapiens
  Payload ID: 16752
  Gene Symbol: STARD10
  Gene Name: StAR-related lipid transfer (START) domain containing 10
  ENST ID: ENST00000546314
  CDS Start-End: 208-620
ggttgggtgtgtgtaggcttggtgtgcctctagcttggtgggggatgcaagctgtgggcatctctgagctgctgtggggctgtcatccctgcgagtcccaggaaggtggcgtcagcatctgcagccgcgtcgacgttgtcggagcctccgcggaggacccaggagagccggactaggaccagggccctgggcctccccacactccccatggagaagctggcggcctctacagagccccaagggcctcggccggtcctgggccgtgagagtgtccaggtgcccgatgaccaagactttcgcagcttccggtcagagtgtgaggctgaggtgggctggaacctgacctatagcagggctggggtgtctgtctgggtgcaggctgtggagatggatcggacgctgcacaagatcaagtgccggatggagtgctgtgatgtgccagccgagacactctacgacgtcctacacgacattgagtaccgcaagaaatgggacagcaacgtcattgagacttttgacatcgcccgcttgacagtcaacgctgacgtgggctattactcctggaggtgtcccaagcccctgaagaaccgtgatgtcatcaccctccgctcctggctccc

SEQ ID NO: 186640 - DNA, 1418 bp, Homo sapiens
  Payload ID: 16752
  Gene Symbol: STARD10
  Gene Name: StAR-related lipid transfer (START) domain containing 10
  ENST ID: ENST00000610783
  CDS Start-End: 281-1360
gattgaggaacccatttcctcattctgcaaattgcaaacctgagggcccaaagagggacaggggcttgccccaggtctcagcaggctgtgagcaagagctaaagcctaatcctcctgcctttgggcctggagcccttccttgtaccccaggggtcagtgtctttgttggatacaggcttagattgactgactgtaccctgagaacctaggggagtccctgttcccaattcttctcctacccccaccttggcctgatggaggaagaccctgctgtgttgagatgagcaccagagccaagaagctgaggaggatctggagaattctggaggaagaggagagtgttgctggagctgtacagaccctgcttctcaggtcccaggaaggtggcgtcgcatctgcagccgcgtcgacgttgtcggagcctccgcggaggacccaggagagccggactaggaccagggccctgggcctccccacactccccatggagaagctggcggcctctacagagccccaagggcctcggccggtcctgggccgtgagagtgtccaggtgcccgatgaccaagactttcgcagcttccggtcagagtgtgaggctgaggtgggctggaacctgacctatagcagggctggggtgtctgtctgggtgcaggctgtggagatggatcggacgctgcacaagatcaagtgccggatggagtgctgtgatgtgccagccgagacactctacgacgtcctacacgacattgagtaccgcaagaaatgggacagcaacgtcattgagacttttgacatcgcccgcttgacagtcaacgctgacgtgggctattactcctggaggtgtcccaagcccctgaagaaccgtgatgtcatcaccctccgctcctggctccccatgggcgctgattacatcattatgaactactcagtcaaacatcccaaatacccacctcggaaagacttggtccgagctgtgtccatccagacgggctacctcatccagagcacagggcccaagagctgcgtcatcacctacctggcccaggtggaccccaaaggctccttacccaagtgggtggtgaataaatcttctcagttcctggctcccaaggccatgaagaagatgtacaaggcgtgcctcaagtaccccgagtggaaacagaagcacctgcctcacttcaagccgtggctgcacccggagcagagcccgttgccgagcctggcgctgtcggagctgtcggtgcagcatgcggactcactggagaacatcgacgagagcgcggtggccgagagcagagaggagcggatgggcggcgcgggcggcgagggcagcgacgacgacacctcgctcacctgagcgccgcaccgcttcagggacggagacaggaccgggcgagccctggggcggcggccgc

SEQ ID NO: 186641 - DNA, 5798 bp, Homo sapiens
  Payload ID: 16753
  Gene Symbol: STARD13
  Gene Name: StAR-related lipid transfer (START) domain containing 13
  Uniprot ID: Q9Y3M8
  ENST ID: ENST00000255486
  CDS Start-End: 58-3375
cggaaacatgagagaggactatcatctgctccttgctctgaatttctttgaacctccatgctggaaccctcctcagttctccatgcaaacgttaaccaggcccctttgtggtgcttggtgctgcgctggtgcagagaatgcaaagacactgtctgtggtgggaaacagaaaagcagagtgaaccacacattccagcgccgggaaattgaggcaaaagaagcatgtgactggctccgtgctgccgggttcccgcaatacgctcagttatatgaggattcacaatttcccatcaacattgtggctgtcaagaatgatcatgattttcttgaaaaggaccttgtagaacctctttgcagacgactaaatacgttgaacaagtgtgcctcaatgaaacttgatgtgaacttccaaaggaaaaagggtgacgactccgatgaggaagatctttgtatcagcaacaaatggactttccaaagaaccagtcgcaggtggtctcgtgtggacgacctctacacgctgctccctcgaggagacagaaatgggtcaccgggaggcacggggatgaggaacacgaccagcagtgagagcgtcctcacagacctgagcgagcctgaggtctgctccattcacagcgaaagcagtggaggcagcgacagtcgcagccagccgggccagtgctgtacagacaacccggtcatgctggatgccccactcgtcagcagcagcctcccacagccccccagagatgtcctcaaccaccccttccaccccaagaatgagaagcccacgagggctagggccaaatcatttttgaaacgcatggaaacactccgagggaagggagcccacgggaggcataaggggtctgggcggacaggtggcctggtgatcagtgggcccatgttgcagcaggagccagagtcctttaaggctatgcagtgcatccaaataccaaatggagatctccagaattcgccgccacctgcctgcagaaaagggctcccatgctctggcaagtcgagtggcgagagcagcccgtcggagcacagcagcagcggggtgagcacgccctgcctgaaggaacgcaagtgccacgaggccaacaagcgcgggggcatgtacttggaggacctagatgtgctggcggggacagcactgccggatgcaggggaccaaagccgtatgcatgaatttcactcccaagagaatttggtggtgcatattcccaaggatcacaaaccaggaacattccccaaggcactttctattgaaagcctctctcccacagatagtagcaatggggttaattggaggaccggtagcatctccctgggcagagagcaggtccctggtgccagggagccccggctcatggcgtcctgccacagagccagccgagtcagtatctatgacaatgtccctggctcccatctgtatgccagcacaggagatcttttggacttggagaaagatgaccttttccctcacttggatgacattctgcagcatgtcaatgggctccaagaggtagtcgatgactggtccaaagatgtcttgcctgaactgcaaactcatgatacattggttggggaacctggcttatccacctttccatctcctaatcagatcaccttagattttgaaggtaactctgtctcagaaggtcggacgacacccagtgatgtggaaagagatgtaacatctcttaatgaatctgagcctcctggggtcagagacaggagggattctggtgtaggggcctctctgaccaggccaaacaggcgactccgatggaacagtttccagctgtcgcaccagccccggccggccccagcatcgccccacatcagcagccagacggccagccagctgagcctgctccagcgcttctcactgctccgcctcacggccatcatggagaagcactccatgtccaacaagcacggctggacatggtcagttccaaagttcatgaagaggatgaaagttcccgactacaaagacaaggctgtctttggcgttcctctcatagtccacgtccaaagaacgggacagcccctgcctcaaagtattcagcaagcactgagatatctacgcagcaactgcctcgatcaggtgggtctttttcgcaaatcaggagtgaagtctcgaatccatgcccttcgccaaatgaatgaaaacttccctgagaacgtcaactatgaagaccagtctgcttatgatgtggcggatatggtgaaacagttcttccgggacctccctgagcctcttttcaccaacaagctcagtgagacctttctccatatctatcagtatgtctccaaagagcagcggctgcaggccgtgcaggctgccatcctgctactggccgatgagaacagggaggtcctgcagacgctcttgtgtttcctgaacgacgtcgtcaacttggtggaagagaatcagatgacgcccatgaacctggcagtgtgtctggccccctccctctttcatcttaatttattgaagaaagaaagctctccacgagtcatacagaagaaatatgccactgggaagccagatcaaaaggacctcaacgagaatctggcagcagctcaggggctagcgcacatgatcatggaatgcgacagactttttgaggttccacacgagttggtggcccagtctcgtaactcgtatgtggaggctgagatccacgtgccaaccctggaagaattggggacacagctggaggagagtggggcaactttccacacttacctgaaccatctcatccagggcctccagaaagaagccaaggagaagttcaaaggatgggtcacgtgctccagcacggacaatacagatcttgctttcaaaaaggtgggcgacgggaacccgctgaagctgtggaaggcttctgtggaggtggaagcacccccctcagtggtcctgaaccgcgtgctgagagagcgccacctgtgggacgaggactttgtgcagtggaaggttgtggaaactctagacaggcaaacagagatctaccagtatgtgctgaacagcatggctccccatccttccagagactttgtggttctcaggacctggaaaactgatttgcccaaaggaatgtgtaccctggtgtccctctccgtggagcatgaggaagcccagctcctgggtggtgtgcgagcagtggtgatggactcgcagtacttgatagaaccgtgtggctctggcaagtcaagactgactcacatctgcaggatagacctgaaaggtcactccccagaatggtacagcaaaggctttggacatctgtgtgcagcagaagttgccaggattagaaactctttccagcccctcattgctgagggcccagaaactaaaatctgagttttgcccagtgtgacatcaaactcagggaagaggaagctaaagtgacgagtgtggcagagagtgtgcatgtgagaaagcgagagaaagaggaactgaaggacgcggttaatgcctaaaaatggaaacgttaagaagttggaatgttggagatgcaagaatttccaagaactttcttagccttcctggagatggctacatccctactaatataattttaaaatgagaactttatatatattacttaaaattaaatggactattccttgtgcattgcctaatttgctatttaaaggcttctaagaagcgtatacctaactgtaaataaatgtatgtatagcatatgtacatatgtgtgtatatctccatctttactgtatatatgtaaaataccaattttatatagaattgtgtgttttgaaaatgacggtgtctgactcagtgagtcccttcctcacacagttctttccaagtggctctgggccccatctctccactgtcctgtaagctgtgcagaacctgctgctaacaccaaggtgtgaacatgccctgatgcctaaccaaagatgagttaaccaaaggaaaataacattaaaggagacttatgtgttaacgctttgtttctgctattcaaaaactgagagtggagatctgggataaagcaaggaaataataattactcctccttaaagcaaatgggggggtgagaagtcattaccaaatttaaagctagatgaggagttgccactgggcccagtaagatggaatttcagtgagatatggaccaccggagtcagcgagagtgactgaaacagaagcgatacctctcgctcccatgcccatcactacagaccccaagtcaagatgaatatcatagcctttacttcttcacagccaaagggagcccctgtgttgtctcaagtttttataaatacatttcataatgttattaaatgtcattctatttgaccagtggcctatttggtcacagttaattggtgttttcttattgcactgaattcaactccagacaccatacaaagggagatgatggccattccgttcaaatcctagatcgttacagcttcagggaattcatattttgttatgtgtaggatactcttaaaatgtaattcattaaacttttacaatctgaaagacagggtttttaactaacatgagaccaaaactatgttctttgattagttttagatagtataatcgggtttattaattcttctgtgtttcttcactagccagtccaagctacctatgcatttgacccaaccttatttattattgtacagatgaagcgaattgactccctttagccaactgctaatggatcgaatgtgctttttattgtaattcaacagctatagagagaaagataacttattgtgtgtttgatttcagggagagagattttctttggtcatccataatagagattgataagatttagcaactggtgttggagaaaaaaagaaaagcaaatgagtgttttcaggtttttttgcattatatgcatttatgtaatgtttctgttatcagcaatgtgcaattattttattgagaggaataaaaaagctttctatgagtttggtatggtgcgaggaaaatcttacagtttgaattatgacctagaaatttttcattcccatatctacctaagaaggaagcagtaaatccataatttaccttttgggcaatgctttgtgagcaaaacaaagtcacttctgccataacatcttgaatttaaccatatatgccagattactttatatgcatcaacaagatcaccagtgaagtttaatctagctaaacactggtcctgctcctgagatgggatcctatgtgtttggaaaacgtgataggcacacgaggatgagtggctttgtatcgcccagagaggtgcttgtccagatttcacatgcacatgaattgcctggggatcttgtgaaactgcagactctgctccaagtaatctgggctgggcctgagattctgcatttctaaggagtctcagggatgcctatgctgctggcctaaaaccacactcagaaacgaggacctagaagatccctaaaacagaataagaacaaatgtgattgtatttctgattctccctctcttcgaattatctgacttttttgtttttgtgcacatagtaatcatatcaccgctgcataacaacacagtgcatctttttaaaacaaggaaaagggaaaaaaaggagaaaaaacgatgcatcaagcttgtttgtcaaataccacagtattttattcattgttatcttgccaatggaaataaagtatgatattgcatttaaatattatatttatacctcatgtatatttttacctcaattgttgatatcaatcatcaattgtaaataaataattgccaaggcaaataaattt

SEQ ID NO: 186642 - DNA, 5917 bp, Homo sapiens
  Payload ID: 16753
  Gene Symbol: STARD13
  Gene Name: StAR-related lipid transfer (START) domain containing 13
  Uniprot ID: Q9Y3M8
  ENST ID: ENST00000336934
  CDS Start-End: 118-3459
aaaaatcgctgggtctgttgagctgtcctgggctgggtgccttgctctttgactgagactggagacagacggcaacagccacaggcagactgaggtggcaataggaaatctgccgagatgttcagtcaggtgcccaggaccccagcctcaggctgctactacctaaattccatgacacctgagggccaggagatgtacttgcgatttgatcagactacaagacgctctccttacaggatgagccggattctagcacgccatcagctagtgactaaaattcaacaagaaattgaggcaaaagaagcatgtgactggctccgtgctgccgggttcccgcaatacgctcagttatatgaggattcacaatttcccatcaacattgtggctgtcaagaatgatcatgattttcttgaaaaggaccttgtagaacctctttgcagacgactaaatacgttgaacaagtgtgcctcaatgaaacttgatgtgaacttccaaaggaaaaagggtgacgactccgatgaggaagatctttgtatcagcaacaaatggactttccaaagaaccagtcgcaggtggtctcgtgtggacgacctctacacgctgctccctcgaggagacagaaatgggtcaccgggaggcacggggatgaggaacacgaccagcagtgagagcgtcctcacagacctgagcgagcctgaggtctgctccattcacagcgaaagcagtggaggcagcgacagtcgcagccagccgggccagtgctgtacagacaacccggtcatgctggatgccccactcgtcagcagcagcctcccacagccccccagagatgtcctcaaccaccccttccaccccaagaatgagaagcccacgagggctagggccaaatcatttttgaaacgcatggaaacactccgagggaagggagcccacgggaggcataaggggtctgggcggacaggtggcctggtgatcagtgggcccatgttgcagcaggagccagagtcctttaaggctatgcagtgcatccaaataccaaatggagatctccagaattcgccgccacctgcctgcagaaaagggctcccatgctctggcaagtcgagtggcgagagcagcccgtcggagcacagcagcagcggggtgagcacgccctgcctgaaggaacgcaagtgccacgaggccaacaagcgcgggggcatgtacttggaggacctagatgtgctggcggggacagcactgccggatgcaggggaccaaagccgtatgcatgaatttcactcccaagagaatttggtggtgcatattcccaaggatcacaaaccaggaacattccccaaggcactttctattgaaagcctctctcccacagatagtagcaatggggttaattggaggaccggtagcatctccctgggcagagagcaggtccctggtgccagggagccccggctcatggcgtcctgccacagagccagccgagtcagtatctatgacaatgtccctggctcccatctgtatgccagcacaggagatcttttggacttggagaaagatgaccttttccctcacttggatgacattctgcagcatgtcaatgggctccaagaggtagtcgatgactggtccaaagatgtcttgcctgaactgcaaactcatgatacattggttggggaacctggcttatccacctttccatctcctaatcagatcaccttagattttgaaggtaactctgtctcagaaggtcggacgacacccagtgatgtggaaagagatgtaacatctcttaatgaatctgagcctcctggggtcagagacaggagggattctggtgtaggggcctctctgaccaggccaaacaggcgactccgatggaacagtttccagctgtcgcaccagccccggccggccccagcatcgccccacatcagcagccagacggccagccagctgagcctgctccagcgcttctcactgctccgcctcacggccatcatggagaagcactccatgtccaacaagcacggctggacatggtcagttccaaagttcatgaagaggatgaaagttcccgactacaaagacaaggctgtctttggcgttcctctcatagtccacgtccaaagaacgggacagcccctgcctcaaagtattcagcaagcactgagatatctacgcagcaactgcctcgatcaggtgggtctttttcgcaaatcaggagtgaagtctcgaatccatgcccttcgccaaatgaatgaaaacttccctgagaacgtcaactatgaagaccagtctgcttatgatgtggcggatatggtgaaacagttcttccgggacctccctgagcctcttttcaccaacaagctcagtgagacctttctccatatctatcagtatgtctccaaagagcagcggctgcaggccgtgcaggctgccatcctgctactggccgatgagaacagggaggtcctgcagacgctcttgtgtttcctgaacgacgtcgtcaacttggtggaagagaatcagatgacgcccatgaacctggcagtgtgtctggccccctccctctttcatcttaatttattgaagaaagaaagctctccacgagtcatacagaagaaatatgccactgggaagccagatcaaaaggacctcaacgagaatctggcagcagctcaggggctagcgcacatgatcatggaatgcgacagactttttgaggttccacacgagttggtggcccagtctcgtaactcgtatgtggaggctgagatccacgtgccaaccctggaagaattggggacacagctggaggagagtggggcaactttccacacttacctgaaccatctcatccagggcctccagaaagaagccaaggagaagttcaaaggatgggtcacgtgctccagcacggacaatacagatcttgctttcaaaaaggtgggcgacgggaacccgctgaagctgtggaaggcttctgtggaggtggaagcacccccctcagtggtcctgaaccgcgtgctgagagagcgccacctgtgggacgaggactttgtgcagtggaaggttgtggaaactctagacaggcaaacagagatctaccagtatgtgctgaacagcatggctccccatccttccagagactttgtggttctcaggacctggaaaactgatttgcccaaaggaatgtgtaccctggtgtccctctccgtggagcatgaggaagcccagctcctgggtggtgtgcgagcagtggtgatggactcgcagtacttgatagaaccgtgtggctctggcaagtcaagactgactcacatctgcaggatagacctgaaaggtcactccccagaatggtacagcaaaggctttggacatctgtgtgcagcagaagttgccaggattagaaactctttccagcccctcattgctgagggcccagaaactaaaatctgagttttgcccagtgtgacatcaaactcagggaagaggaagctaaagtgacgagtgtggcagagagtgtgcatgtgagaaagcgagagaaagaggaactgaaggacgcggttaatgcctaaaaatggaaacgttaagaagttggaatgttggagatgcaagaatttccaagaactttcttagccttcctggagatggctacatccctactaatataattttaaaatgagaactttatatatattacttaaaattaaatggactattccttgtgcattgcctaatttgctatttaaaggcttctaagaagcgtatacctaactgtaaataaatgtatgtatagcatatgtacatatgtgtgtatatctccatctttactgtatatatgtaaaataccaattttatatagaattgtgtgttttgaaaatgacggtgtctgactcagtgagtcccttcctcacacagttctttccaagtggctctgggccccatctctccactgtcctgtaagctgtgcagaacctgctgctaacaccaaggtgtgaacatgccctgatgcctaaccaaagatgagttaaccaaaggaaaataacattaaaggagacttatgtgttaacgctttgtttctgctattcaaaaactgagagtggagatctgggataaagcaaggaaataataattactcctccttaaagcaaatgggggggtgagaagtcattaccaaatttaaagctagatgaggagttgccactgggcccagtaagatggaatttcagtgagatatggaccaccggagtcagcgagagtgactgaaacagaagcgatacctctcgctcccatgcccatcactacagaccccaagtcaagatgaatatcatagcctttacttcttcacagccaaagggagcccctgtgttgtctcaagtttttataaatacatttcataatgttattaaatgtcattctatttgaccagtggcctatttggtcacagttaattggtgttttcttattgcactgaattcaactccagacaccatacaaagggagatgatggccattccgttcaaatcctagatcgttacagcttcagggaattcatattttgttatgtgtaggatactcttaaaatgtaattcattaaacttttacaatctgaaagacagggtttttaactaacatgagaccaaaactatgttctttgattagttttagatagtataatcgggtttattaattcttctgtgtttcttcactagccagtccaagctacctatgcatttgacccaaccttatttattattgtacagatgaagcgaattgactccctttagccaactgctaatggatcgaatgtgctttttattgtaattcaacagctatagagagaaagataacttattgtgtgtttgatttcagggagagagattttctttggtcatccataatagagattgataagatttagcaactggtgttggagaaaaaaagaaaagcaaatgagtgttttcaggtttttttgcattatatgcatttatgtaatgtttctgttatcagcaatgtgcaattattttattgagaggaataaaaaagctttctatgagtttggtatggtgcgaggaaaatcttacagtttgaattatgacctagaaatttttcattcccatatctacctaagaaggaagcagtaaatccataatttaccttttgggcaatgctttgtgagcaaaacaaagtcacttctgccataacatcttgaatttaaccatatatgccagattactttatatgcatcaacaagatcaccagtgaagtttaatctagctaaacactggtcctgctcctgagatgggatcctatgtgtttggaaaacgtgataggcacacgaggatgagtggctttgtatcgcccagagaggtgcttgtccagatttcacatgcacatgaattgcctggggatcttgtgaaactgcagactctgctccaagtaatctgggctgggcctgagattctgcatttctaaggagtctcagggatgcctatgctgctggcctaaaaccacactcagaaacgaggacctagaagatccctaaaacagaataagaacaaatgtgattgtatttctgattctccctctcttcgaattatctgacttttttgtttttgtgcacatagtaatcatatcaccgctgcataacaacacagtgcatctttttaaaacaaggaaaagggaaaaaaaggagaaaaaacgatgcatcaagcttgtttgtcaaataccacagtattttattcattgttatcttgccaatggaaataaagtatgatattgcatttaaatattatatttatacctcatgtatatttttacctcaattgttgatatcaatcatcaattgtaaataaataattgccaaggcaaataaatttatatatattaaatatttcctattttctataaaata

SEQ ID NO: 186643 - DNA, 5784 bp, Homo sapiens
  Payload ID: 16753
  Gene Symbol: STARD13
  Gene Name: StAR-related lipid transfer (START) domain containing 13
  Uniprot ID: Q9Y3M8
  ENST ID: ENST00000399365
  CDS Start-End: 374-3361
ctcacagacaacagccaagcacagaggaaatattagctggcagagataacgaagagaaaacactcggtgacagatgcaccatctgtcagtttctgaggagcagttttcaagaaagctgaaaatgaattgaagaagagaggggttttgtttgaaaggtacagcacagcctaaggacaattttaaacaaaaaattgaggcaaaagaagcatgtgactggctccgtgctgccgggttcccgcaatacgctcagttatatgaggattcacaatttcccatcaacattgtggctgtcaagaatgatcatgattttcttgaaaaggaccttgtagaacctctttgcagacgactaaatacgttgaacaagtgtgcctcaatgaaacttgatgtgaacttccaaaggaaaaagggtgacgactccgatgaggaagatctttgtatcagcaacaaatggactttccaaagaaccagtcgcaggtggtctcgtgtggacgacctctacacgctgctccctcgaggagacagaaatgggtcaccgggaggcacggggatgaggaacacgaccagcagtgagagcgtcctcacagacctgagcgagcctgaggtctgctccattcacagcgaaagcagtggaggcagcgacagtcgcagccagccgggccagtgctgtacagacaacccggtcatgctggatgccccactcgtcagcagcagcctcccacagccccccagagatgtcctcaaccaccccttccaccccaagaatgagaagcccacgagggctagggccaaatcatttttgaaacgcatggaaacactccgagggaagggagcccacgggaggcataaggggtctgggcggacaggtggcctggtgatcagtgggcccatgttgcagcaggagccagagtcctttaaggctatgcagtgcatccaaataccaaatggagatctccagaattcgccgccacctgcctgcagaaaagggctcccatgctctggcaagtcgagtggcgagagcagcccgtcggagcacagcagcagcggggtgagcacgccctgcctgaaggaacgcaagtgccacgaggccaacaagcgcgggggcatgtacttggaggacctagatgtgctggcggggacagcactgccggatgcaggggaccaaagccgtatgcatgaatttcactcccaagagaatttggtggtgcatattcccaaggatcacaaaccaggaacattccccaaggcactttctattgaaagcctctctcccacagatagtagcaatggggttaattggaggaccggtagcatctccctgggcagagagcaggtccctggtgccagggagccccggctcatggcgtcctgccacagagccagccgagtcagtatctatgacaatgtccctggctcccatctgtatgccagcacaggagatcttttggacttggagaaagatgaccttttccctcacttggatgacattctgcagcatgtcaatgggctccaagaggtagtcgatgactggtccaaagatgtcttgcctgaactgcaaactcatgatacattggttggggaacctggcttatccacctttccatctcctaatcagatcaccttagattttgaaggtaactctgtctcagaaggtcggacgacacccagtgatgtggaaagagatgtaacatctcttaatgaatctgagcctcctggggtcagagacaggagggattctggtgtaggggcctctctgaccaggccaaacaggcgactccgatggaacagtttccagctgtcgcaccagccccggccggccccagcatcgccccacatcagcagccagacggccagccagctgagcctgctccagcgcttctcactgctccgcctcacggccatcatggagaagcactccatgtccaacaagcacggctggacatggtcagttccaaagttcatgaagaggatgaaagttcccgactacaaagacaaggctgtctttggcgttcctctcatagtccacgtccaaagaacgggacagcccctgcctcaaagtattcagcaagcactgagatatctacgcagcaactgcctcgatcaggtgggtctttttcgcaaatcaggagtgaagtctcgaatccatgcccttcgccaaatgaatgaaaacttccctgagaacgtcaactatgaagaccagtctgcttatgatgtggcggatatggtgaaacagttcttccgggacctccctgagcctcttttcaccaacaagctcagtgagacctttctccatatctatcagtatgtctccaaagagcagcggctgcaggccgtgcaggctgccatcctgctactggccgatgagaacagggaggtcctgcagacgctcttgtgtttcctgaacgacgtcgtcaacttggtggaagagaatcagatgacgcccatgaacctggcagtgtgtctggccccctccctctttcatcttaatttattgaagaaagaaagctctccacgagtcatacagaagaaatatgccactgggaagccagatcaaaaggacctcaacgagaatctggcagcagctcaggggctagcgcacatgatcatggaatgcgacagactttttgaggttccacacgagttggtggcccagtctcgtaactcgtatgtggaggctgagatccacgtgccaaccctggaagaattggggacacagctggaggagagtggggcaactttccacacttacctgaaccatctcatccagggcctccagaaagaagccaaggagaagttcaaaggatgggtcacgtgctccagcacggacaatacagatcttgctttcaaaaaggtgggcgacgggaacccgctgaagctgtggaaggcttctgtggaggtggaagcacccccctcagtggtcctgaaccgcgtgctgagagagcgccacctgtgggacgaggactttgtgcagtggaaggttgtggaaactctagacaggcaaacagagatctaccagtatgtgctgaacagcatggctccccatccttccagagactttgtggttctcaggacctggaaaactgatttgcccaaaggaatgtgtaccctggtgtccctctccgtggagcatgaggaagcccagctcctgggtggtgtgcgagcagtggtgatggactcgcagtacttgatagaaccgtgtggctctggcaagtcaagactgactcacatctgcaggatagacctgaaaggtcactccccagaatggtacagcaaaggctttggacatctgtgtgcagcagaagttgccaggattagaaactctttccagcccctcattgctgagggcccagaaactaaaatctgagttttgcccagtgtgacatcaaactcagggaagaggaagctaaagtgacgagtgtggcagagagtgtgcatgtgagaaagcgagagaaagaggaactgaaggacgcggttaatgcctaaaaatggaaacgttaagaagttggaatgttggagatgcaagaatttccaagaactttcttagccttcctggagatggctacatccctactaatataattttaaaatgagaactttatatatattacttaaaattaaatggactattccttgtgcattgcctaatttgctatttaaaggcttctaagaagcgtatacctaactgtaaataaatgtatgtatagcatatgtacatatgtgtgtatatctccatctttactgtatatatgtaaaataccaattttatatagaattgtgtgttttgaaaatgacggtgtctgactcagtgagtcccttcctcacacagttctttccaagtggctctgggccccatctctccactgtcctgtaagctgtgcagaacctgctgctaacaccaaggtgtgaacatgccctgatgcctaaccaaagatgagttaaccaaaggaaaataacattaaaggagacttatgtgttaacgctttgtttctgctattcaaaaactgagagtggagatctgggataaagcaaggaaataataattactcctccttaaagcaaatgggggggtgagaagtcattaccaaatttaaagctagatgaggagttgccactgggcccagtaagatggaatttcagtgagatatggaccaccggagtcagcgagagtgactgaaacagaagcgatacctctcgctcccatgcccatcactacagaccccaagtcaagatgaatatcatagcctttacttcttcacagccaaagggagcccctgtgttgtctcaagtttttataaatacatttcataatgttattaaatgtcattctatttgaccagtggcctatttggtcacagttaattggtgttttcttattgcactgaattcaactccagacaccatacaaagggagatgatggccattccgttcaaatcctagatcgttacagcttcagggaattcatattttgttatgtgtaggatactcttaaaatgtaattcattaaacttttacaatctgaaagacagggtttttaactaacatgagaccaaaactatgttctttgattagttttagatagtataatcgggtttattaattcttctgtgtttcttcactagccagtccaagctacctatgcatttgacccaaccttatttattattgtacagatgaagcgaattgactccctttagccaactgctaatggatcgaatgtgctttttattgtaattcaacagctatagagagaaagataacttattgtgtgtttgatttcagggagagagattttctttggtcatccataatagagattgataagatttagcaactggtgttggagaaaaaaagaaaagcaaatgagtgttttcaggtttttttgcattatatgcatttatgtaatgtttctgttatcagcaatgtgcaattattttattgagaggaataaaaaagctttctatgagtttggtatggtgcgaggaaaatcttacagtttgaattatgacctagaaatttttcattcccatatctacctaagaaggaagcagtaaatccataatttaccttttgggcaatgctttgtgagcaaaacaaagtcacttctgccataacatcttgaatttaaccatatatgccagattactttatatgcatcaacaagatcaccagtgaagtttaatctagctaaacactggtcctgctcctgagatgggatcctatgtgtttggaaaacgtgataggcacacgaggatgagtggctttgtatcgcccagagaggtgcttgtccagatttcacatgcacatgaattgcctggggatcttgtgaaactgcagactctgctccaagtaatctgggctgggcctgagattctgcatttctaaggagtctcagggatgcctatgctgctggcctaaaaccacactcagaaacgaggacctagaagatccctaaaacagaataagaacaaatgtgattgtatttctgattctccctctcttcgaattatctgacttttttgtttttgtgcacatagtaatcatatcaccgctgcataacaacacagtgcatctttttaaaacaaggaaaagggaaaaaaaggagaaaaaacgatgcatcaagcttgtttgtcaaataccacagtattttattcattgttatcttgccaatggaaataaagtatgatattgcatttaaatattatatttatacctcatgtatatttttacctcaattgttgatatcaatcatcaattgtaaataaataattgccaaggcaaataaattt

SEQ ID NO: 186644 - DNA, 2037 bp, Homo sapiens
  Payload ID: 16753
  Gene Symbol: STARD13
  Gene Name: StAR-related lipid transfer (START) domain containing 13
  ENST ID: ENST00000567873
  CDS Start-End: 218-2037
aataacctagcgcggcgtttctggtggccaggcatcccggtcctcgcgcgtggcgcagcctcccagcgccggaccgacccatgtcgcgcccgcattgggtcccgggaccccggcgggagtgccgcgtccgtcctttccagtcgccgggagtctgagtcgcgggccacgcgggagtggcggtggagagcccgccggtcgttatgaggacggatctaaaatgaccagcaaacggaaaccttgccaaacgcagctcaggagatccatcagtgagcagttgcgggactccacggccagagcctgggatctgctgtggaagaacgtccgggagaggcggctggcagaaattgaggcaaaagaagcatgtgactggctccgtgctgccgggttcccgcaatacgctcagttatatgaggattcacaatttcccatcaacattgtggctgtcaagaatgatcatgattttcttgaaaaggaccttgtagaacctctttgcagacgactaaatacgttgaacaagtgtgcctcaatgaaacttgatgtgaacttccaaaggaaaaagggtgacgactccgatgaggaagatctttgtatcagcaacaaatggactttccaaagaaccagtcgcaggtggtctcgtgtggacgacctctacacgctgctccctcgaggagacagaaatgggtcaccgggaggcacggggatgaggaacacgaccagcagtgagagcgtcctcacagacctgagcgagcctgaggtctgctccattcacagcgaaagcagtggaggcagcgacagtcgcagccagccgggccagtgctgtacagacaacccggtcatgctggatgccccactcgtcagcagcagcctcccacagccccccagagatgtcctcaaccaccccttccaccccaagaatgagaagcccacgagggctagggccaaatcatttttgaaacgcatggaaacactccgagggaagggagcccacgggaggcataaggggtctgggcggacaggtggcctggtgatcagtgggcccatgttgcagcaggagccagagtcctttaaggctatgcagtgcatccaaataccaaatggagatctccagaattcgccgccacctgcctgcagaaaagggctcccatgctctggcaagtcgagtggcgagagcagcccgtcggagcacagcagcagcggggtgagcacgccctgcctgaaggaacgcaagtgccacgaggccaacaagcgcgggggcatgtacttggaggacctagatgtgctggcggggacagcactgccggatgcaggggaccaaagccgtatgcatgaatttcactcccaagagaatttggtggtgcatattcccaaggatcacaaaccaggaacattccccaaggcactttctattgaaagcctctctcccacagatagtagcaatggggttaattggaggaccggtagcatctccctgggcagagagcaggtccctggtgccagggagccccggctcatggcgtcctgccacagagccagccgagtcagtatctatgacaatgtccctggctcccatctgtatgccagcacaggagatcttttggacttggagaaagatgaccttttccctcacttggatgacattctgcagcatgtcaatgggctccaagaggtagtcgatgactggtccaaagatgtcttgcctgaactgcaaactcatgatacattggttggggaacctggcttatccacctttccatctcctaatcagatcaccttagattttgaaggtaactctgtctcagaaggtcggacgacacccagtgatgtggaaagagatgtaacatctcttaatgaatctgagcctcctggggtcagagacaggagggattctggtgtaggggcctctctgaccaggccaaacaggcgactccgatggaacagtttccagctgtcgcaccagccccggccggccccagcatcgccccacatcagcagccagacggccagccagctgagcctgctccagcgcttctcactgct

SEQ ID NO: 186645 - DNA, 945 bp, Homo sapiens
  Payload ID: 16753
  Gene Symbol: STARD13
  Gene Name: StAR-related lipid transfer (START) domain containing 13
  ENST ID: ENST00000439831
  CDS Start-End: 212-403
ctagcgcggcgtttctggtggccaggcatcccggtcctcgcgcgtggcgcagcctcccagcgccggaccgacccatgtcgcgcccgcattgggtcccgggaccccggcgggagtgccgcgtccgtcctttccagtcgccgggagtctgagtcgcgggccacgcgggagtggcggtggagagcccgccggtcgttatgaggacggatctaaaatgaccagcaaacggaaaccttgccaaacgcagctcaggagatccatcagtgagcagttgcgggactccacggccagagcctgggatctgctgtggaagaacgtccgggagaggcggctggcaggactatctcttgagctgggcagtgaccaccacatggggcagaagaaagttctagagaagaaggtctgatgcctagaaagaaggaaaggacaccactggtgaagcgggagatttaaccttctttgaactcctcccttttttccttacttgaactgtaaagcaagtggtttgctaggtgttctgcccttaaacccatgcacccacatcctcatcagcctgaaagcattctggggaagatgcccagaatctatagcaccttgagagaaggtcactagcaagctaaattagaagtggagattatggatgattccaacactcaatgttgtaagcatacaatgttcattccacattttctctccaacacagtggccacatttagtgtgcacctaagaaataaacagacttttttggtttggacccagaaataaattgtggtaacccagcagttttgactgttgatgtttaaaaacctgtacatgcactgtagacctcaattaataacaattagtaactttccctgttatcatgctaaattgtatattctacatgatggatggtgttagagaaatttttgtggtctagtaaacttttgttgcttcataacttcagaa

SEQ ID NO: 186646 - DNA, 2132 bp, Homo sapiens
  Payload ID: 16754
  Gene Symbol: STARD3
  Gene Name: StAR-related lipid transfer (START) domain containing 3
  Uniprot ID: Q14849
  ENST ID: ENST00000336308
  CDS Start-End: 219-1556
ggcggggccgcaggcgaacgcaagtcccgcttcgctctcgggggcggactcagcggcggaagtggcgctgccggaagatcttcttccgctctgaggcgctactgaggccgcggagccggactgcggttggggcgggaagagccggggccgtggctgacatggagcagccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaataccaacacaggcatccgtaagaacttggagcaggagatcatccagtacaactttaaaacttccttcttcgacatctttgtcctggccttcttccgcttctctggactgctcctaggctatgccgtgctgcggctccggcactggtgggtgattgcggtcacgacgctggtgtccagtgcattcctcattgtcaaggtcatcctctctgagctgctcagcaaaggggcatttggctacctgctccccatcgtctcttttgtcctcgcctggttggagacctggttccttgacttcaaagtcctaccccaggaagctgaagaggagcgatggtatcttgccgcccaggttgctgttgcccgtggacccctgctgttctccggtgctctgtccgagggacagttctattcacccccagaatcctttgcagggtctgacaatgaatcagatgaagaagttgctgggaagaaaagtttctctgctcaggagcgggagtacatccgccaggggaaggaggccacggcagtggtggaccagatcttggcccaggaagagaactggaagtttgagaagaataatgaatatggggacaccgtgtacaccattgaagttccctttcacggcaagacgtttatcctgaagaccttcctgccctgtcctgcggagctcgtgtaccaggaggtgatcctgcagcccgagaggatggtgctgtggaacaagacagtgactgcctgccagatcctgcagcgagtggaagacaacaccctcatctcctatgacgtgtctgcaggggctgcgggcggcgtggtctccccaagggacttcgtgaatgtccggcgcattgagcggcgcagggaccgatacttgtcatcagggatcgccacctcacacagtgccaagcccccgacgcacaaatatgtccggggagagaatggccctgggggcttcatcgtgctcaagtcggccagtaacccccgtgtttgcacctttgtctggattcttaatacagatctcaagggccgcctgccccggtacctcatccaccagagcctcgcggccaccatgtttgaatttgcctttcacctgcgacagcgcatcagcgagctgggggcccgggcgtgactgtgccccctcccaccctgcgggccagggtcctgtcgccaccacttccagagccagaaagggtgccagttgggctcgcactgcccacatgggacctggccccaggctgtcaccctccaccgagccacgcagtgcctggagttgactgactgagcaggctgtggggtggagcactggactccggggccccactggctggaggaagtggggtctggcctgttgatgtttacatggcgccctgcctcctggaggaccagattgctctgccccaccttgccagggcagggtctgggctgggcacctgacttggctggggaggaccagggccctgggcagggcagggcagcctgtcacccgtgtgaagatgaaggggctcttcatctgcctgcgctctcgtcggtttttttaggattattgaaagagtctgggacccttgttggggagtgggtggcaggtgggggtgggctgctggccatgaatctctgcctctcccaggctgtccccctcctcccagggcctcctgggggacctttgtattaagccaattaaaaacatgaatttaaaaaaaaaaaaaaa

SEQ ID NO: 186647 - DNA, 1949 bp, Homo sapiens
  Payload ID: 16754
  Gene Symbol: STARD3
  Gene Name: StAR-related lipid transfer (START) domain containing 3
  Uniprot ID: Q14849
  ENST ID: ENST00000394250
  CDS Start-End: 140-1423
cttcttccgctctgaggcgctactgaggccgcggagccggactgcggttggggcgggaagagccggggccgtggctgacatggagcagccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaataccaacacaggcatccgtaagaacttggagcaggagatcatccagtacaactttaaaacttccttcttcgacatctttgtcctggccttcttccgcttctctggactgctcctaggctatgccgtgctgcggctccggcactggtgggtgattgcgctgctcagcaaaggggcatttggctacctgctccccatcgtctcttttgtcctcgcctggttggagacctggttccttgacttcaaagtcctaccccaggaagctgaagaggagcgatggtatcttgccgcccaggttgctgttgcccgtggacccctgctgttctccggtgctctgtccgagggacagttctattcacccccagaatcctttgcagggtctgacaatgaatcagatgaagaagttgctgggaagaaaagtttctctgctcaggagcgggagtacatccgccaggggaaggaggccacggcagtggtggaccagatcttggcccaggaagagaactggaagtttgagaagaataatgaatatggggacaccgtgtacaccattgaagttccctttcacggcaagacgtttatcctgaagaccttcctgccctgtcctgcggagctcgtgtaccaggaggtgatcctgcagcccgagaggatggtgctgtggaacaagacagtgactgcctgccagatcctgcagcgagtggaagacaacaccctcatctcctatgacgtgtctgcaggggctgcgggcggcgtggtctccccaagggacttcgtgaatgtccggcgcattgagcggcgcagggaccgatacttgtcatcagggatcgccacctcacacagtgccaagcccccgacgcacaaatatgtccggggagagaatggccctgggggcttcatcgtgctcaagtcggccagtaacccccgtgtttgcacctttgtctggattcttaatacagatctcaagggccgcctgccccggtacctcatccaccagagcctcgcggccaccatgtttgaatttgcctttcacctgcgacagcgcatcagcgagctgggggcccgggcgtgactgtgccccctcccaccctgcgggccagggtcctgtcgccaccacttccagagccagaaagggtgccagttgggctcgcactgcccacatgggacctggccccaggctgtcaccctccaccgagccacgcagtgcctggagttgactgactgagcaggctgtggggtggagcactggactccggggccccactggctggaggaagtggggtctggcctgttgatgtttacatggcgccctgcctcctggaggaccagattgctctgccccaccttgccagggcagggtctgggctgggcacctgacttggctggggaggaccagggccctgggcagggcagggcagcctgtcacccgtgtgaagatgaaggggctcttcatctgcctgcgctctcgtcggtttttttaggattattgaaagagtctgggacccttgttggggagtgggtggcaggtgggggtgggctgctggccatgaatctctgcctctcccaggctgtccccctcctcccagggcctcctgggg

SEQ ID NO: 186648 - DNA, 673 bp, Homo sapiens
  Payload ID: 16754
  Gene Symbol: STARD3
  Gene Name: StAR-related lipid transfer (START) domain containing 3
  ENST ID: ENST00000443521
  CDS Start-End: 86-673
caggaccagaggctggagctcagggctaggcctgccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaataccaacacaggcatccgtaagaacttggagcaggagatcatccagtacaactttaaaacttccttcttcgacatctttgtcctggccttcttccgcttctctggactgctcctaggctatgccgtgctgcggctccggcactggtgggtgattgcggtcacgacgctggtgtccagtgcattcctcattgtcaaggtcatcctctctgagctgctcagcaaaggggcatttggctacctgctccccatcgtctcttttgtcctcgcctggttggagacctggttccttgacttcaaagtcctaccccaggaagctgaagaggagcgatggtatcttgccgcccaggttgctgttgcccgtggacccctg

SEQ ID NO: 186649 - DNA, 1666 bp, Homo sapiens
  Payload ID: 16754
  Gene Symbol: STARD3
  Gene Name: StAR-related lipid transfer (START) domain containing 3
  Uniprot ID: Q14849
  ENST ID: ENST00000544210
  CDS Start-End: 143-1480
gatcttcttccgctctgaggcgctactgaggccgcggagccggactgcggttggggcgggaagagccggggccgtggctgacatggagcagccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaataccaacacaggcatccgtaagaacttggagcaggagatcatccagtacaactttaaaacttccttcttcgacatctttgtcctggccttcttccgcttctctggactgctcctaggctatgccgtgctgcggctccggcactggtcacgacgctggtgtccagtgcattcctcattgtcaaggtcatcctctctgagctgctcagcaaaggggcatttggctacctgctccccatcgtctcttttgtcctcgcctggttggagacctggttccttgacttcaaagtcctaccccaggaagctgaagaggagcgattctgctcctccagggtatcttgccgcccaggttgctgttgcccgtggacccctgctgttctccggtgctctgtccgagggacagttctattcacccccagaatcctttgcagggtctgacaatgaatcagatgaagaagttgctgggaagaaaagtttctctgctcaggagcgggagtacatccgccaggggaaggaggccacggcagtggtggaccagatcttggcccaggaagagaactggaagtttgagaagaataatgaatatggggacaccgtgtacaccattgaagttccctttcacggcaagacgtttatcctgaagaccttcctgccctgtcctgcggagctcgtgtaccaggaggtgatcctgcagcccgagaggatggtgctgtggaacaagacagtgactgcctgccagatcctgcagcgagtggaagacaacaccctcatctcctatgacgtgtctgcaggggctgcgggcggcgtggtctccccaagggacttcgtgaatgtccggcgcattgagcggcgcagggaccgatacttgtcatcagggatcgccacctcacacagtgccaagcccccgacgcacaaatatgtccggggagagaatggccctgggggcttcatcgtgctcaagtcggccagtaacccccgtgtttgcacctttgtctggattcttaatacagatctcaagggccgcctgccccggtacctcatccaccagagcctcgcggccaccatgtttgaatttgcctttcacctgcgacagcgcatcagcgagctgggggcccgggcgtgactgtgccccctcccaccctgcgggccagggtcctgtcgccaccacttccagagccagaaagggtgccagttgggctcgcactgcccacatgggacctggccccaggctgtcaccctccaccgagccacgcagtgcctggagttgactgactgagcaggctgtggggtggagcactggactccgggg

SEQ ID NO: 186650 - DNA, 560 bp, Homo sapiens
  Payload ID: 16754
  Gene Symbol: STARD3
  Gene Name: StAR-related lipid transfer (START) domain containing 3
  ENST ID: ENST00000579479
  CDS Start-End: 228-560
cttccgctctgaggcgctactgaggccgcggagccggactgcggttggggcgggaagagccggggccgtggctgacatggagcagagacgggtttcactgtgttagccagaatggtctcgatctcctgaccttgtgatccacccacctcccgcctcccagagtgctgggattacagccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaataccaacacaggcatccgtaagaacttggagcaggagatcatccagtacaactttaaaacttccttcttcgacatctttgtcctggccttcttccgcttctctggactgctccta

SEQ ID NO: 186651 - DNA, 558 bp, Homo sapiens
  Payload ID: 16754
  Gene Symbol: STARD3
  Gene Name: StAR-related lipid transfer (START) domain containing 3
  ENST ID: ENST00000580331
  CDS Start-End: 295-558
atcatgttatgctgtgatttggagcaggagggtgggaggctttctgaggagaggacttttgagctgcctgttgaagggtctgtgggagaacattccaggcatggggagagccagatcgaaggtcccaaggcaggacagggcagctgtattgagggatgtaaaaaaggccagagtggcggtggcagcaagacagagagaagggctgggcagaggccacctgcaggcctggactgagagggcctgccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaataccaacacaggcatccgtaagaacttggagcaggagatcatccag

SEQ ID NO: 186652 - DNA, 591 bp, Homo sapiens
  Payload ID: 16754
  Gene Symbol: STARD3
  Gene Name: StAR-related lipid transfer (START) domain containing 3
  ENST ID: ENST00000581894
  CDS Start-End: 236-591
atcttcttccgctctgaggcgctactgaggccgcggagccggactgcggttggggcgggaagagccggggccgtggctgacatggagcagtagagacgggtttcactgtgttagccagaatggtctcgatctcctgaccttgtgatccacccacctcccgcctcccagagtgctgggattacagccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaataccaacacaggcatccgtaagaacttggagcaggagatcatccagtacaactttaaaacttccttcttcgacatctttgtcctggccttcttccgcttctctggactgctcctaggctatgccgtgctgcggctccg

SEQ ID NO: 186653 - DNA, 571 bp, Homo sapiens
  Payload ID: 16754
  Gene Symbol: STARD3
  Gene Name: StAR-related lipid transfer (START) domain containing 3
  ENST ID: ENST00000577248
  CDS Start-End: 102-571
cttccgctctgaggcgctactgaggccgcggagccggactgcggttggggcgggaagagccggggccgtggctgacatggagcaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaataccaacacaggcatccgtaagaacttggagcaggagatcatccagtacaactttaaaacttccttcttcgacatctttgtcctggccttcttccgcttctctggactgctcctaggctatgccgtgctgcggctccggcactggtcacgacgctggtgtccagtgcattcctcattgtcaaggtcatcctctctgagctgctcagcaaaggggcatttggctacctgctccccatcgtctcttttgtcctc

SEQ ID NO: 186654 - DNA, 1989 bp, Homo sapiens
  Payload ID: 16754
  Gene Symbol: STARD3
  Gene Name: StAR-related lipid transfer (START) domain containing 3
  ENST ID: ENST00000580611
  CDS Start-End: 131-1558
ctctgaggcgctactgaggccgcggagccggactgcggttggggcgggaagagccggggccgtggctgacatggagcagccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaatgtcctggccttcttccgcttctctggactgctcctaggctatgccgtgctgcggctccggcactggtgggtgattgcggtcacgacgctggtgtccagtgcattcctcattgtcaaggtcatcctctctgagctgctcagcaaaggggcatttggctacctgctccccatcgtctcttttgtcctcgcctggttggagacctggttccttgacttcaaagtcctaccccaggaagctgaagaggagcgatggtatcttgccgcccaggttgctgttgcccgtggacccctgctgttctccggtgctctgtccgagggacagttctattcacccccagaatcctttgcagggtctgacaatgaatcagatgaagaagttgctgggaagaaaagtttctctgctcaggagcgggagtacatccgccaggggaaggaggccacggcagtggtggaccagatcttggcccaggaagagaactggaagtttgagaagaataatgaatatggggacaccgtgtacaccattgaagttccctttcacggcaagacgtttatcctgaagaccttcctgccctgtcctgcggagctcgtgtaccaggaggtgatcctgcagcccgagaggatggtgctgtggaacaagacagtgactgcctgccagatcctgcagcgagtggaagacaacaccctcatctcctatgacgtgtctgcaggggctgcgggcggcgtggtctccccaagggacttcgtgaatgtccggcgcattgagcggcgcagggaccgatacttgtcatcagggatcgccacctcacacagtgccaagcccccgacgcacaaatatgtccggggagagaatggccctgggggcttcatcgtgctcaagtcggccagtaacccccgtgtttgcacctttgtctggattcttaatacagatctcaaggtggggtgctggggggctgccagggccgcctgccccggtacctcatccaccagagcctcgcggccaccatgtttgaatttgcctttcacctgcgacagcgcatcagcgagctgggggcccgggcgtgactgtgccccctcccaccctgcgggccagggtcctgtcgccaccacttccagagccagaaagggtgccagttgggctcgcactgcccacatgggacctggccccaggctgtcaccctccaccgagccacgcagtgcctggagttgactgactgagcaggctgtggggtggagcactggactccggggccccactggctggaggaagtggggtctggcctgttgatgtttacatggcgccctgcctcctggaggaccagattgctctgccccaccttgccagggcagggtctgggctgggcacctgacttggctggggaggaccagggccctgggcagggcagggcagcctgtcacccgtgtgaagatgaaggggctcttcatctgcctgcgctctcgtcggtttttttaggattattgaaagagtctgggacccttgttggggagtgggtggcaggtgggggtgggctgctggccatgaatctctgcctctcccaggctgtccccctcctcccagggcctcctgggggacctttgtattaagccaattaaaaacatgaatttaaaaaaaaaaaaaaa

SEQ ID NO: 186655 - DNA, 579 bp, Homo sapiens
  Payload ID: 16754
  Gene Symbol: STARD3
  Gene Name: StAR-related lipid transfer (START) domain containing 3
  ENST ID: ENST00000583419
  CDS Start-End: 95-579
attgcaacgcattctctaggccggctatgtgaagagcaggaggccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaataccaacacaggcatccgtaagaacttggagcaggagatcatccagtacaactttaaaacttccttcttcgacatctttgtcctggccttcttccgcttctctggactgctcctaggctatgccgtgctgcggctccggcactggtgggtgattgcggtcacgacgctggtgtccagtgcattcctcattgtcaaggtcatcctctctgagctgctcagcaaaggggcatttggctacctgctccccatcgtctcttttgtcctcgc

SEQ ID NO: 186656 - DNA, 550 bp, Homo sapiens
  Payload ID: 16754
  Gene Symbol: STARD3
  Gene Name: StAR-related lipid transfer (START) domain containing 3
  ENST ID: ENST00000583718
  CDS Start-End: 198-550
cttcctctgtctggcctcgcgccgccccgcgcgggttggggtctccagcaatgactcttggcgaccccgcctatcctggggagcccggggaggacgttcgggatctccttccaaagcctccgtcttaactgaggggagaggagaggccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaataccaacacaggcatccgtaagaacttggagcaggagatcatccagtacaactttaaaacttccttcttcgacatctttgtcctggccttcttccgcttctctggactgctcctaggctatgccgtgctgcggct

SEQ ID NO: 186657 - DNA, 602 bp, Homo sapiens
  Payload ID: 16754
  Gene Symbol: STARD3
  Gene Name: StAR-related lipid transfer (START) domain containing 3
  ENST ID: ENST00000583884
  CDS Start-End: 1-187
atcagatgaagaagttgctgggaagaaaagtttctctgctcaggagcgggagtacatccgccaggggaaggaggccacggcagtggtggaccagatcttggcccaggaagagaactggaagtttgagaagaataatcccaccccctgcctccactctcctccctgccaccttctgtccctgccataggaatatggggacaccgtgtacaccattgaagttccctttcacggcaagacgtttatcctgaagaccttcctgccctgtcctgcggagctcgtgtaccaggaggtgatcctgcagcccgagaggatggtgctgtggaacaagacagtgactgcctgccagatcctgcagcgagtggaagacaacaccctcatctcctatgacgtgtctgcaggggctgcgggcggcgtggtctccccaagggacttcgtgaatgtccggcgcattgagcggcgcagggaccgatacttgtcatcagggatcgccacctcacacagtgccaagcccccgacgcacaaatatgtccggggagagaatggccctgggggcttcatcgtgctcaagtcggccagtaacccccgtgtttgcacctttgtct

SEQ ID NO: 186658 - DNA, 1511 bp, Homo sapiens
  Payload ID: 16754
  Gene Symbol: STARD3
  Gene Name: StAR-related lipid transfer (START) domain containing 3
  ENST ID: ENST00000578577
  CDS Start-End: 142-930
atcttcttccgctctgaggcgctactgaggccgcggagccggactgcggttggggcgggaagagccggggccgtggctgacatggagcagccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaataccaacacaggcatccgtaagaacttggagcaggagatcatccagtacaactttaaaacttccttcttcgacatctttgtcctggccttcttccgcttctctggactgctcctaggctatgccgtgctgcggctccggcactgctgctcagcaaaggggcatttggctacctgctccccatcgtctcttttgtcctcgcctggttggagacctggttccttgacttcaaagtcctaccccaggaagctgaagaggagcgatggtatcttgccgcccaggttgctgttgcccgtggacccctgctgttctccggtgctctgtccgagggacagttctattcacccccagaatcctttgcagggtctgacaatgaatcagatgaagaagttgctgggaagaaaagtttctctgctcaggagcgggagtacatccgccaggggaaggaggccacggcagtggtggaccagatcttggcccaggaagagaactggaagtttgagaagaataatgaatatggggacaccgtgtacaccattgaagttccctttcacggcaagacgtttatcctgaagaccttcctgccctgtcctgcggagctcgtgtaccaggaggtgatcctgcagcccgagaggatggtgctgtggaacaagacagtgactgcctgccagatcctgcagcgagtggaagacaacaccctcatctcctatgacgtgtctgcaggggctgcgggcggcgtggtctccccaagggacttcgtgaatgtccggcgcattgagcggcgcagggaccgatacttgtcatcagggatcgccacctcacacagtgccaagcccccgacgcacaaatatgtccggggagagaatggccctgggggcttcatcgtgctcaagtcggccagtaacccccgtgtttgcacctttgtctggattcttaatacagatctcaagggccgcctgccccggtacctcatccaccagagcctcgcggccaccatgtttgaatttgcctttcacctgcgacagcgcatcagcgagctgggggcccgggcgtgactgtgccccctcccaccctgcgggccagggtcctgtcgccaccacttccagagccagaaagggtgccagttgggctcgcactgcccacatgggacctgg

SEQ ID NO: 186659 - DNA, 4606 bp, Homo sapiens
  Payload ID: 16755
  Gene Symbol: STARD4
  Gene Name: StAR-related lipid transfer (START) domain containing 4
  Uniprot ID: Q96DR4
  ENST ID: ENST00000296632
  CDS Start-End: 136-753
acaagttggctgctgtcgcctgcgcatcggcgggccgggaggctgagcagtactgttgagagcggtgtgaggtgcttggtagcgcgccgtagctgcttccacgtccttgcttcacctcaggtaaagagagaagtaatggaaggcctgtctgatgttgcttcttttgcaactaaacttaaaaacactctcatccagtaccatagcattgaagaagataagtggcgagttgctaagaaaacgaaagatgtaactgtttggagaaaaccctcagaagaatttaatggatatctctacaaagcccaaggtgttatagatgaccttgtctatagtataatagaccatatacgcccagggccttgtcgtttggattgggacagcttgatgacttctttggatattctggagaactttgaagagaattgctgtgtgatgcgttacactactgctggtcagctttggaatataatttccccaagagaatttgttgatttctcctatactgtgggctataaagaagggcttttatcttgtggaataagtcttgactgggatgaaaagagaccagaatttgttcgaggatataaccatccctgtggttggttttgtgttccacttaaagacaacccaaaccagagtcttttgacaggatatattcagacagatctgcgtgggatgattcctcagtctgcggtagatacagccatggcaagcactttaaccaacttctatggtgatttacgaaaagctttatgagaggcaaaatacattcaaacttgtagtactacagatcaactctctcagctacatggcctgtaaaaatcattgattccacttttctgcatagccggtagaaaaatttgaaatgtttttggttcactagtacaatgtttggttttattcctaaagtaaatagctatctaagagagggcattttcacttttttttttttaaattttgagacaggctctcactctgttgcccatgctggagggcagtggtatgatcacagctcactgcagctttgatctgaccgctcaaggggttattctacctcagcctcctgaatagctgggaatacaggtgcacgccactatgcatggctaatttttgtttaattttttgtagagatgtggtcacactgtgttgcccaggctggtcttgaactcctggcctcaagtcattccccaccttagcctcccaaagtgttgggattataagcgtgagccaccatgcctggccccaatttaaaatgtggaattcagttggtgtccaagacttatcttgagactcttaaaagcatcagtctgtaactagaacaaatacagtcttagatttacccaagtgcctagatatcattttataatgattagaattgagtattgtgggtcccctaattctgtgggtgccttaagtgagaatttctaaatgattttcacattctaaatgactttgggttttgaactctccatctagtttacttctaaaatgggaacttgaggcaattcaggtatccaggcaaatctttgtatatatttttttgtgtacatgcacacatctcgaaatccatttccgtgtttaatgttagttgtttatgtgttagtattcctgtgtctactgttttgttgttgttaatatgggtaaagtgagccctgaaatacatgctaaacaagacatgaaatgcagaaaggtacatagtgtttcaagtgcatggtagtttgatctgtgttttactttattgtgttttcttgagtgtaaagaaagaataaatcaaagttcttcatacccattttgacaaagtggaacagtggagctgttttttgcttttgtttttatttattttttgccactggtgatgatagatttcaaaaaacaaaaggtggcagcagcacaatgttcatggtgaattatctcatagtatctagattgatcaagatctgacagaaggaatgcacaaaggattctatattcttaatgatttattaattaccaggatccttttctaaattgaatgtacttttgaattactaggtttcttctttttttttgttctgcaatagtgaaagaaaactcagtagtttagtttcagtttctcatggaaattggtaaatgttagttttgacttcatctattttttatttgtttttattagcgtagagtaggaagtctcatattctactgttctatctaggatggtgaaattccaaaggtgcctaacttgagtaagggatttgtgacaagatagtacacattactataagggctattatttcctgaactggatgtccctaaaagcaaataaactgcccactatctctactctagtgctctctttgtccttatcaacatatacctccaataagtaattacataattcaccgttaaacatggacccactctaggtaaaattaccctcatggaaacattttcactgtgagaatgatgaatttaaaaattatgtttgaatcacctaaaatgtatgtgcagcttctagatggccccttagatctgctgggctctagctgtgtactttaaaaaaacaaaaacagctttattgatatataatttacatattatgtaatttacccacttttaagtatctaattcagtgatgttttaatacatatgtagaactatgcagccatcagcacaatctggatttagaacgtttccatcattccaaaagattccttttgtcttttttgcagactcatacctaacacaaatctaaagtttatcactgttgccaggataattacagcaggttatgtttggtttcatttttaagagtggaggtgttcatgattctaagctcaggaatcttgtgatcatgtattaaatatgttatctcatactataatgataaaaaagcttaatgatgtgggttgggatggatattaacataaataattgagtccgctgcttctatagcaatgctgtaggatagaacaataatgtaagtgatatatgtaattaaaaaattctagaagccacattaaaaaataaaaataaacagctgaagttaattttaatattttatttaactcaatacatccaaaatgttatcattttaacatgtaattgatgtaaagatttattctgatagtttgtactatttcttgtactaattttttgaaatctggtatgcattttacaaatttgggcaagccacattttaagtgctcattagccacatgaggccagtggatactgtattgaatagcacagtcctatagcatatttattaatttgtcttgtagtaagatgaaatagacaataatacggaataatatcttaaatggaaatctttgttagtctctagagccttcattgcttgataaataggacatctaaactttagatataaatcagttgtcaatgagataaaattattgccagcaaatattttccttcaaagataagtaacttttgatatggcagttggtgaaatgaaagaatataatctgccttcttgttaaatggttgactattctgtagcttgtaggtagtacgtattagaaacttgtgtatgtgggaaatatttggcataatactgttttcagtatatagtagctattttttaaggaaattagtttcatacaagaaaaagattattataaaagtgatacttttgcatgaaatattagtttgtgttgataactcttagttaacccttaaagtttaaaacagtactcaaaaaaaaataatgagaatctagtattctgtagttaactaatctataagataaattgctaaagtactagggagcttgtaaatcttaaaaatctttttatttcagtgttcattcaggttggatatatttgaaattgtagatttctatctgtacaacatctcctagttaatagaatttttttccttcccctcccttctctctcctcctccttttctaaccaaagggcattttatcaacaatcatgctgaattcaattaatatctcaagctaaaaaactatgtaattgaggttgtatctggagaagatgggaaaacattgtataatttaagcccttaattgtctgttgagcttttagggctgagtaattgcctttcatacaaataaaagctttaactcttttctcaagagtgtaccaccgtccttagaatcaggtgttttaaatccagtttcttttaattaaatgggactgtagtgatccctaccctgtagagaaatcaacagaactagagaagctaagggcttgatcaggtttcccctagaacctgtgttgcctgcctgctgtatcttccatgtctttcttattcaacttctagaagtagagaaggttgggacttgagtgtagaagaaacatcagaataatttcaaaaaacaggaagttggaactataatttttaaattattgtattgtttttacggattttacatgtatagttaaatattaaaattcatctcttgcagttcaataaaagctatagtatagattttatttttaagaagtttatataattcttttgtgaaccaatatgtaaaactagaatatttattaaactaataatatgtattagtatcaataaaatatgtatttatttttaaattggtatgaaacaaaataaaaatttgtagacactcttaaaa

SEQ ID NO: 186660 - DNA, 577 bp, Homo sapiens
  Payload ID: 16755
  Gene Symbol: STARD4
  Gene Name: StAR-related lipid transfer (START) domain containing 4
  ENST ID: ENST00000455172
  CDS Start-End: 138-344
ttacaagttggctgctgtcgcctgcgcatcggcgggccgggaggctgagcagtactgttgagagcggtgtgaggtgcttggtagcgcgccgtagctgcttccacgtccttgcttcacctcaggtaaagagagaagtaatggaaggcctgtctgatgttgcttcttttgcaactaaacttaaaaacactctcatccagtaccatagcattgaagaagataagtggcgagttgctaagaaaacgaaagatgtaactgtttggagaaaaccctcagaagaatttaatggatatctagtcttaaagggatatgtgatcaaaagagctacaaagcccaaggtgttatagatgaccttgtctatagtataatagaccatatacgcccagggccttgtcgtttggattgggacagcttgatgacttctttggatattctggagaactttgaagagaattgctgtgtgatgcgttacactactgctggtcagctttggaatataatttccccaagagaatttgttgatttctcctatactgtgggctataaagaagggcttttatcttgtggtaataatctcaac

SEQ ID NO: 186661 - DNA, 1135 bp, Homo sapiens
  Payload ID: 16755
  Gene Symbol: STARD4
  Gene Name: StAR-related lipid transfer (START) domain containing 4
  ENST ID: ENST00000511137
  CDS Start-End: 161-328
agttggctgcgaccagcggtgacttacaagttggctgctgtcgcctgcgcatcggcgggccgggaggctgagcagtactgttgagagcggtgtgaggtgcttggtagcgcgccgtagctgcttccacgtccttgcttcacctcaggtaaagagagaagtaatggaaggcctgtctgatgttgcttcttttgcaactaaacttaaaaacactctcatccagtaccatagcattgaagaagataagtggcgagttgctaagaaaacgaaagatgtaactgtttggagaaaaccctcagaagaatttaatggatatctaattgctgtgtgatgcgttacactactgctggtcagctttggaatataatttccccaagagaatttgttgatttctcctatactgtgggctataaagaagggcttttatcttgtggaataagtcttgactgggatgaaaagagaccagaatttgttcgaggatataaccatccctgtggttggttttgtgttccacttaaagacaacccaaaccagagtcttttgacaggatatattcagacagatctgcgtgggatgattcctcagtctgcggtagatacagccatggcaagcactttaaccaacttctatggtgatttacgaaaagctttatgagaggcaaaatacattcaaacttgtagtactacagatcaactctctcagctacatggcctgtaaaaatcattgattccacttttctgcatagccggtagaaaaatttgaaatgtttttggttcactagtacaatgtttggttttattcctaaagtaaatagctatctaagagagggcattttcacttttttttttttaaattttgagacaggctctcactctgttgcccatgctggagggcagtggtatgatcacagctcactgcagctttgatctgaccgctcaaggggttattctacctcagcctcctgaatagctgggaatacaggtgcacgccactatgcatggctaatttttgtttaattttttgtagagatgtggtcacactgtgttgcccaggctggtcttgaactcctggcctcaagtcattccccaccttagcctcccaaagtgttgggattataagcgtgagccaccatgcctgg

SEQ ID NO: 186662 - DNA, 1186 bp, Homo sapiens
  Payload ID: 16755
  Gene Symbol: STARD4
  Gene Name: StAR-related lipid transfer (START) domain containing 4
  ENST ID: ENST00000509887
  CDS Start-End: 161-328
agttggctgcgaccagcggtgacttacaagttggctgctgtcgcctgcgcatcggcgggccgggaggctgagcagtactgttgagagcggtgtgaggtgcttggtagcgcgccgtagctgcttccacgtccttgcttcacctcaggtaaagagagaagtaatggaaggcctgtctgatgttgcttcttttgcaactaaacttaaaaacactctcatccagtaccatagcattgaagaagataagtggcgagttgctaagaaaacgaaagatgtaactgtttggagaaaaccctcagaagaatttaatggatatctaattgctgtgtgatgcgttacactactgctggtcagctttggaatataatttccccaagagaatttgttgatttctcctatactgtgggctataaagaagggcttttatcttgtggtaataatctcaacatgttatgctttttttcagtatggtttaaatatttgtgttttcttggctggatgtctctttccttgtgagatatattttcaactctgactctgtaatcactaacattttttgcaagtgctaaactctagggagtaaaatagcaatatcaaaagagttttgaaacccttctgataagtttttgttcccagttacacagtatcctctaggtcagaggtagcaaatgtggatcacatgactgcctctaagaaagggttctagtaaatggattttcttctaagccactctcagaaaacagtttcttggtcatacacagagaagtactagatttggtgtgtcttagaatattcttccttccttgagctgtgttgtatttttcttttcaagattaaaaatactgccattggaaggctcctgttttctaaaacgtacctataggtaaattaatattattttgtatatagtgtatacttaagttagcagttgtaagtaaacatctacttgtttattcttaactagccagtaccaaactataatatggtagtcgctgtggggaatagttacggtaccatggatttgatttttggcacctcaaggcctggatactacaaccaagatttgtagcttccaaggagtactaagatgatatgatgtcatgtattctgaaaggattaaaagtttccccattacctatctgccaacctcttgtcagaattctccttggtaagtctctttttcactctg

SEQ ID NO: 186663 - DNA, 3500 bp, Homo sapiens
  Payload ID: 16755
  Gene Symbol: STARD4
  Gene Name: StAR-related lipid transfer (START) domain containing 4
  ENST ID: ENST00000512160
  CDS Start-End: 155-322
agttggctgcgaccagcggtgacttacaagttggctgctgtcgcctgcgcatcggcgggccgggaggctgagcagtactgttgagagcggtgtgaggtgcttggtagcgcgccgtagctgcttccacgtccttgcttcacctcagagagaagtaatggaaggcctgtctgatgttgcttcttttgcaactaaacttaaaaacactctcatccagtaccatagcattgaagaagataagtggcgagttgctaagaaaacgaaagatgtaactgtttggagaaaaccctcagaagaatttaatggatatctaattgctgtgtgatgcgttacactactgctggaataagtcttgactgggatgaaaagagaccagaatttgttcgaggatataaccatccctgtggttggttttgtgttccacttaaagacaacccaaaccagagtcttttgacaggatatattcagacagatctgcgtgggatgattcctcagtctgcggtagatacagccatggcaagcactttaaccaacttctatggtgatttacgaaaagctttatgagaggcaaaatacattcaaacttgtagtactacagatcaactctctcagctacatggcctgtaaaaatcattgattccacttttctgcatagccggtagaaaaatttgaaatgtttttggttcactagtacaatgtttggttttattcctaaagtaaatagctatctaagagagggcattttcacttttttttttttaaattttgagacaggctctcactctgttgcccatgctggagggcagtggtatgatcacagctcactgcagctttgatctgaccgctcaaggggttattctacctcagcctcctgaatagctgggaatacaggtgcacgccactatgcatggctaatttttgtttaattttttgtagagatgtggtcacactgtgttgcccaggctggtcttgaactcctggcctcaagtcattccccaccttagcctcccaaagtgttgggattataagcgtgagccaccatgcctggccccaatttaaaatgtggaattcagttggtgtccaagacttatcttgagactcttaaaagcatcagtctgtaactagaacaaatacagtcttagatttacccaagtgcctagatatcattttataatgattagaattgagtattgtgggtcccctaattctgtgggtgccttaagtgagaatttctaaatgattttcacattctaaatgactttgggttttgaactctccatctagtttacttctaaaatgggaacttgaggcaattcaggtatccaggcaaatctttgtatatatttttttgtgtacatgcacacatctcgaaatccatttccgtgtttaatgttagttgtttatgtgttagtattcctgtgtctactgttttgttgttgttaatatgggtaaagtgagccctgaaatacatgctaaacaagacatgaaatgcagaaaggtacatagtgtttcaagtgcatggtagtttgatctgtgttttactttattgtgttttcttgagtgtaaagaaagaataaatcaaagttcttcatacccattttgacaaagtggaacagtggagctgttttttgcttttgtttttatttattttttgccactggtgatgatagatttcaaaaaacaaaaggtggcagcagcacaatgttcatggtgaattatctcatagtatctagattgatcaagatctgacagaaggaatgcacaaaggattctatattcttaatgatttattaattaccaggatccttttctaaattgaatgtacttttgaattactaggtttcttctttttttttgttctgcaatagtgaaagaaaactcagtagtttagtttcagtttctcatggaaattggtaaatgttagttttgacttcatctattttttatttgtttttattagcgtagagtaggaagtctcatattctactgttctatctaggatggtgaaattccaaaggtgcctaacttgagtaagggatttgtgacaagatagtacacattactataagggctattatttcctgaactggatgtccctaaaagcaaataaactgcccactatctctactctagtgctctctttgtccttatcaacatatacctccaataagtaattacataattcaccgttaaacatggacccactctaggtaaaattaccctcatggaaacattttcactgtgagaatgatgaatttaaaaattatgtttgaatcacctaaaatgtatgtgcagcttctagatggccccttagatctgctgggctctagctgtgtactttaaaaaaacaaaaacagctttattgatatataatttacatattatgtaatttacccacttttaagtatctaattcagtgatgttttaatacatatgtagaactatgcagccatcagcacaatctggatttagaacgtttccatcattccaaaagattccttttgtcttttttgcagactcatacctaacacaaatctaaagtttatcactgttgccaggataattacagcaggttatgtttggtttcatttttaagagtggaggtgttcatgattctaagctcaggaatcttgtgatcatgtattaaatatgttatctcatactataatgataaaaaagcttaatgatgtgggttgggatggatattaacataaataattgagtccgctgcttctatagcaatgctgtaggatagaacaataatgtaagtgatatatgtaattaaaaaattctagaagccacattaaaaaataaaaataaacagctgaagttaattttaatattttatttaactcaatacatccaaaatgttatcattttaacatgtaattgatgtaaagatttattctgatagtttgtactatttcttgtactaattttttgaaatctggtatgcattttacaaatttgggcaagccacattttaagtgctcattagccacatgaggccagtggatactgtattgaatagcacagtcctatagcatatttattaatttgtcttgtagtaagatgaaatagacaataatacggaataatatcttaaatggaaatctttgttagtctctagagccttcattgcttgataaataggacatctaaactttagatataaatcagttgtcaatgagataaaattattgccagcaaatattttccttcaaagataagtaacttttgatatggcagttggtgaaatgaaagaatataatctgccttcttgttaaatggttgactattctgtagcttgtaggtagtacgtattagaaacttgtgtatgtgggaaatatttggcataatactgttttcagtatatagtagctattttttaaggaaattagtttcatacaagaaaaagattattataaaagtgatacttttgcatgaaatattagtttgtgttgataactcttagttaacccttaaagtttaaaacagtactc

SEQ ID NO: 186664 - DNA, 803 bp, Homo sapiens
  Payload ID: 16755
  Gene Symbol: STARD4
  Gene Name: StAR-related lipid transfer (START) domain containing 4
  Uniprot ID: Q96DR4
  ENST ID: ENST00000505803
  CDS Start-End: 182-799
cttgccctgaggcgctgggtgccttccagttggctgcgaccagcggtgacttacaagttggctgctgtcgcctgcgcatcggcgggccgggaggctgagcagtactgttgagagcggtgtgaggtgcttggtagcgcgccgtagctgcttccacgtccttgcttcacctcagagagaagtaatggaaggcctgtctgatgttgcttcttttgcaactaaacttaaaaacactctcatccagtaccatagcattgaagaagataagtggcgagttgctaagaaaacgaaagatgtaactgtttggagaaaaccctcagaagaatttaatggatatctctacaaagcccaaggtgttatagatgaccttgtctatagtataatagaccatatacgcccagggccttgtcgtttggattgggacagcttgatgacttctttggatattctggagaactttgaagagaattgctgtgtgatgcgttacactactgctggtcagctttggaatataatttccccaagagaatttgttgatttctcctatactgtgggctataaagaagggcttttatcttgtggaataagtcttgactgggatgaaaagagaccagaatttgttcgaggatataaccatccctgtggttggttttgtgttccacttaaagacaacccaaaccagagtcttttgacaggatatattcagacagatctgcgtgggatgattcctcagtctgcggtagatacagccatggcaagcactttaaccaacttctatggtgatttacgaaaagctttatgagagg

SEQ ID NO: 186665 - DNA, 1467 bp, Homo sapiens
  Payload ID: 16755
  Gene Symbol: STARD4
  Gene Name: StAR-related lipid transfer (START) domain containing 4
  Uniprot ID: Q96DR4
  ENST ID: ENST00000502322
  CDS Start-End: 216-695
agggggcggggctgggggctcggcccgccttgccctgaggcgctgggtgccttccagttggctgcgaccagcggtgacttacaagttggctgctgtcgcctgcgcatcggcgggccgggaggctgagcagtactgttgagagcggtgtgaggtgcttggtagcgcgccgtagctgcttccacgtccttgcttcacctcaggtaaagagagaagtaatggaaggcctgtctgatgttgcttcttttgcaactaaacttaaaaacactctcatccagtaccatagcattgaagaagataagtggcgagttgctaagaaaacgaaagatgtaactgtttggagaaaaccctcagaagaatttaatggatatctctacaaagcccaaggtgttatagatgaccttgtctatagtataatagaccatatacgcccagggccttgtcgtttggattgggacagcttgatgacttctttggatattctggagaactttgaagagaattgctgtgtgatgcgttacactactgctggtcagctttggaatataatttccccaagagaatttgttgatttctcctatactgtgggctataaagaagggcttttatcttgtggtaataatctcaacatgttatgctttttttcagtatggtttaaatatttgtgttttcttggctggatgtctctttccttgtgagatatattttcaactctgactctgtaatcactaacattttttgcaagtgctaaactctagggagtaaaatagcaatatcaaaagagttttgaaacccttctgataagtttttgttcccagttacacagtatcctctaggtcagaggtagcaaatgtggatcacatgactgcctctaagaaagggttctagtaaatggattttcttctaagccactctcagaaaacagtttcttggtcatacacagagaagtactagatttggtgtgtcttagaatattcttccttccttgagctgtgttgtatttttcttttcaagattaaaaatactgccattggaaggctcctgttttctaaaacgtacctataggtaaattaatattattttgtatatagtgtatacttaagttagcagttgtaagtaaacatctacttgtttattcttaactagccagtaccaaactataatatggtagtcgctgtggggaatagttacggtaccatggatttgatttttggcacctcaaggcctggatactacaaccaagatttgtagcttccaaggagtactaagatgatatgatgtcatgtattctgaaaggattaaaagtttccccattacctatctgccaacctcttgtcagaattctccttggtaagtctctttttcactctgccatggtcactttgggatttaattttcatctatatggataataataaatatttaaataagaattctggtaatattttaaaatgagagttttatgtcagt

SEQ ID NO: 186666 - DNA, 4871 bp, Homo sapiens
  Payload ID: 16756
  Gene Symbol: STARD5
  Gene Name: StAR-related lipid transfer (START) domain containing 5
  Uniprot ID: Q9NSY2
  ENST ID: ENST00000302824
  CDS Start-End: 27-668
cgcagctaagcgcagctcccgacgcaatggacccggcgctggcagcccagatgagcgaggctgtggccgagaagatgctccagtaccggcgggacacagcaggctggaagatttgccgggaaggcaatggagtttcagtttcctggaggccatctgtggagtttccagggaacctgtaccgaggagaaggcattgtatatgggacactagaggaggtgtgggactgtgtgaagccagctgttggaggcctacgagtgaagtgggatgagaatgtgaccggttttgaaattatccaaagcatcactgacaccctgtgtgtaagcagaacctccactccctccgctgccatgaagctcatttctcccagagattttgtggacttggtgctagtcaagagatatgaggatgggaccatcagttccaacgccacccatgtggagcatccgttatgtcccccgaagccaggttttgtgagaggatttaaccatccttgtggttgcttctgtgaacctcttccaggggaacccaccaagaccaacctggtcacattcttccataccgacctcagcggttacctcccacagaacgtggtggactccttcttcccccgcagcatgacccggttttatgccaaccttcagaaagcagtgaagcaattccatgagtaatgctatcgttacttcttggcaaagaactcccgtgactcatcgaggagctccagctgttgggacaccaaggagcctgggagcacgcagaggcctgtgttcactctttggaacaagctgatggactgcgcatctctgagaatgccaaccagaggcggcagcccacccttcctgcctcctgccccactcagggttggcgtgtgatgagccattcatgtgttccaaactccatctgcctgttacccaaacacgcctctcctggcagggtagacccaggcctctaaccatctgacagagactcggcctggacaccatgcgatgcactctggcaccaaggctttatgtgcccatcactctcagagaccacgtttccctgactgtcatagagaatcatcatcgccactgaaaaccaggccctgttgccttttaagcatgtaccgctccctcagtcctgtgctgcagccccccaaatatatttttctgatatagaccttgtatatggctttaatgccgcaaaatatttatttttccttaaaaaaggtgtcaacttggaaataatggtttaaaaacaggataagcattaaggaaaaacactttcaatgtgtcttccatttgatgaatttgtttttctctctttatccccgcaaggtggagtttcatgtcctcggtgaaaccagacagtgtgaatctgttccagcccaaatctgcagcattagggatgagttctcagaagtgattctgaactgagcacgcactcatgtctgcatggggaactctggggagaagagccttccttttctttcccttgggcatttgcctttccttgtcgtcttactgaggcggaggcaggaggtctctgtcttccaggccctggccaggccatcctgccatcaggaaagatggaagagtaggcctccgtctagcagccctggctggaaatcccccctctagatcctgctgcaagactgtacaaactcacaggggccatgtccacccaggcacatcatcagaaccagggagcacagccttgccacctagaaggggcctcagcagccgtgcaactttctttccctatctccaatccagagagggatcctctaacattctctagcaacctcatctgcacccccaccaccttccttgtaagaaagaccacgtgtgactaaaatcccttcacgctgcatttacccaggttactattgtgcgcgcaaaatgttttcacagtgttctcagcctttgctcctccaaacagaaaacgtttcccctgcgttactgttacttccctatttttgagtcctggggtgactgtctcttaaatgtgccaagatgtgagcaagctttaaaacatgacagctcagtgttaaggagacagaaagcttcctctttctctgttctattgcaactacaaattctacagtcatgcctaagatcctttagctaacacccttttcaagaaatcatcagactcttggattgacttagaattcattcattcattaagtgcttaccgagtccccgctctgtggcaagcactgttctatatcaacttctcatgagttcagccaattctaggtgcaccagccaaggaaacttcatgcctgccctctctgagctccatactctgaggtggtggtcttatcaagatgggatcgccttgtacatccctgtgtagccaagtggaaggccagccaaccaagaatgcatctcactgggcctatgggacatactgtgcctgcactgctcctccacgtgactgcatcaggttaaactggtcagagccctggatgaggagctggaaaacatgcatccagtccaagctctgccacttgggccaagtgtgctcttgaacagtcacttaatatatctgctttgatttgtcttttaaagaaaatatggaggcaggaataccagtgtcagtgtagcctgcttcttgagtgttggcacaagtgagataatgtatgaatcagtaaaatgctgggcaaagcaaagaagtagggctgcctgggagtggattcctttttatggtgagttaagacgacttcacaattgttagctgtgatgcctgcagtgtttgaggatggcattgccttcatcctgtgtcagctctgaagaagttggcagagcaaagctaagcctcaagtgtaaatcccagcatcatggaacgcaaatggatgagcttttgttttaggatcttcttgctgattcctacccagaggacttccccagcctagagaccagaaacctgggcaatagttatatcttcagtggccctaggagttgttgtgtctccttggggaggagagaaccttctaaaacaggccagagacaggaggtactgggagggccatgggctcacctgcatctatgcccagataacctgggacagataacctctgtcccaatcacttgctttgcctggtctctcaaggagtctcttggtaccccaggcccacggccagctccatgctcatccctgtccccaccttccagtcttgatgaaaacccaccttctctttcatcccttggctgcttgataagacttaaaacaattccctgattttagggaaggccactgcgtgcacagatggtgagtttgtgcaggcaaggaatgtgccctccacatcacgtggcctccttgcccagcctgggtcatgggaagggagtgttgaattgaatcacgtctttcgttggtagattatgttcatcttcaatgtttctattaagtctaaaaagtggatacaaatggtgcctccaagttcttgtctaattgcttgtctactgcttgacaaaatccagaatggaataggccaaacaagttaaccagcaggacagaaactgctctaagcccattattccttgagatgaatagaacagtgagctgaacgcctgctctaatgaagccactaaaggggtttacaggaaggttaggagcccagatgggttttgagtccactgctgggaaacagattcttcacttcctgtggaccctggagaagccatcagattacattaacatggctccactgatgatggcctgagaattactattgtttgtgtttcatctgtgtccttgccaggtcttcccccacatccttacttcacaggatcaggggctgagaggagaccaatactctggcccaggcctggtcaagggatgctggttgttgctgatgcaaagtcacattgcctggtcctgagcttggcaatcaggcatccagagatggccaaaccaaatatccctttggccaggcactcaggcattccctgtaatgttgtgcacttaaagcatcttgggctgatagtctccaccgaatcacagaagaaaactcaatctgccgcatcactcaccagctggataagccatttactgtacacagtgtgtgccctcttatcaatacattggcacagaaccatacaccgtagaagctgctgtgatcactaaaggcaatgcccgtttagccctgagcacagtgcttggcatgtggtaggtaagtagtagcaattttatttgataccctcatatacacgctggttccttctgtcggcacacctgtccacgctttgagcttggtgcttcacctgtactcctctgtttactggctccaccacccttccctaggattacttctccaatccaaccaaaaacaattttgcaaatgtttcatgtgacaaactgtatttttcataaatgaccccagcaatatttcctctccccttaaacccaggcaggtttgtgtcagctctaactgatggagtatggtggaggtgatgccatgcaacttccaaggcaaaggtataaacaagatgcagcttctacatggctcttgcgatcctgggatgctcatcctgggaatccagacaccatgttgtgaggaggcccaggccacaaggagaggccacctataagcattcaggccagcagccccaggtgagttcccagccaacatcaacggccagatgtatgagtgaatgatctcacgtggtcccagcctttgcatgactttgcatgacgccagctgatgccaagtgggacagagatgagctgcccattccaatctctgcccacattgcagattcatgagaaaaataaatgtcactgtttgggggtgaatcatgacacagttacagtacttgaaacattttgcgaagccaggcatgaatgtcatatgaaattctaataaatccattttatttgtggcaccacaa

SEQ ID NO: 186667 - DNA, 1264 bp, Homo sapiens
  Payload ID: 16756
  Gene Symbol: STARD5
  Gene Name: StAR-related lipid transfer (START) domain containing 5
  Uniprot ID: Q9NSY2
  ENST ID: ENST00000325346
  CDS Start-End: 85-276
gagctccagcctccaggcacccgggatccagcgccgccgctcataacacccgcgaccccgcagctaagcgcagctcccgacgcaatggacccggcgctggcagcccagatgagcgaggctgtggccgagaagatgctccagtaccggcgggacacagcaggctggaagatttgccgggaaggcgtaccgaggagaaggcattgtatatgggacactagaggaggtgtgggactgtgtgaagccagctgttggaggcctacgagtgaagtgggatgagaatgtgaccggttttgaaattatccaaagcatcactgacaccctgtgtgtaagcagaacctccactccctccgctgccatgaagctcatttctcccagagattttgtggacttggtgctagtcaagagatatgaggatgggaccatcagttccaacgccacccatgtggagcatccgttatgtcccccgaagccaggttttgtgagaggatttaaccatccttgtggttgcttctgtgaacctcttccaggggaacccaccaagaccaacctggtcacattcttccataccgacctcagcggttacctcccacagaacgtggtggactccttcttcccccgcagcatgacccggttttatgccaaccttcagaaagcagtgaagcaattccatgagtaatgctatcgttacttcttggcaaagaactcccgtgactcatcgaggagctccagctgttgggacaccaaggagcctgggagcacgcagaggcctgtgttcactctttggaacaagctgatggactgcgcatctctgagaatgccaaccagaggcggcagcccacccttcctgcctcctgccccactcagggttggcgtgtgatgagccattcatgtgttccaaactccatctgcctgttacccaaacacgcctctcctggcagggtagacccaggcctctaaccatctgacagagactcggcctggacaccatgcgatgcactctggcaccaaggctttatgtgcccatcactctcagagaccacgtttccctgactgtcatagagaatcatcatcgccactgaaaaccaggccctgttgccttttaagcatgtaccgctccctcagtcctgtgctgcagccccccaaatatatttttctgatatagaccttgtatatggctttaatgccgcaaaatatttatttttccttaaaaaaggtgtcaacttggaaataatggtttaaaaacaggataagcattaaggaaaaa

SEQ ID NO: 186668 - DNA, 579 bp, Homo sapiens
  Payload ID: 16756
  Gene Symbol: STARD5
  Gene Name: StAR-related lipid transfer (START) domain containing 5
  ENST ID: ENST00000560156
  CDS Start-End: 43-375
ataacacccgcgaccccgcagctaagcgcagctcccgacgcaatggacccggcgctggcagcccagatgagcgaggctgtggccgagaagatgctccagtaccggcgggacacagcaggctggaagatttgccgggaaggcgtgagtgaggagctgggcgggaaggggtcgcggagacggcttcgtggagcccgggtccccagaagcccccaagcgcctcctctccccgttgttttctgctccccaatcccctggacccgattgagagggattccaatggggattgttttcttctttaaaaaaaagattgggcctgttatgctcacaatgacttcaggtggtaccgaggagaaggcattgtatatgggacactagaggaggtgtgggactgtgtgaagccagctgttggaggcctacgagtgaagtgggatgagaatgtgaccggttttgaaattatccaaagcatcactgacaccctgtgtgtaagcagaacctccactccctccgctgccatgaagctcatttctcccagagattttgtggacttggtgctagtcaagagatatgaggatgggacca

SEQ ID NO: 186669 - DNA, 663 bp, Homo sapiens
  Payload ID: 16757
  Gene Symbol: STARD6
  Gene Name: StAR-related lipid transfer (START) domain containing 6
  Uniprot ID: P59095
  ENST ID: ENST00000307844
  CDS Start-End: 1-663
atggacttcaaggcaattgcccaacaaactgcccaagaagttttaggttataatcgagatacatcaggctggaaagtggttaaaacttcaaaaaagataactgtttccagtaaggcttctagaaaattccatggaaatctatatcgtgttgaagggataattccagaatcaccagctaaactatctgatttcctctaccaaactggagacagaattacatgggataaatcattgcaagtgtataatatggtacacaggattgattcggacacattcatatgtcataccattacacaaagttttgccgtgggctccatttcccctcgagactttatcgacttagtgtacatcaagcgctacgaaggaaatatgaacattatcagttctaaaagtgtggattttccagaatatcctccatcttcaaattatatccgcggttataaccatccttgtggctttgtatgttcaccaatggaagaaaacccagcatattccaaactagtgatgtttgtccagacagaaatgagaggaaaattgtccccatcaataattgaaaaaaccatgccttccaacttagtaaacttcatcctcaatgcaaaagatggaataaaggcacacagaactccatcaagacgtggatttcatcataatagtcattcatga

SEQ ID NO: 186670 - DNA, 1371 bp, Homo sapiens
  Payload ID: 16757
  Gene Symbol: STARD6
  Gene Name: StAR-related lipid transfer (START) domain containing 6
  Uniprot ID: P59095
  ENST ID: ENST00000581310
  CDS Start-End: 375-1037
ctccgcagtcacagcagagctcgacacccgcgctcgctttcaaaccgccccaacatggcgccggcctgcggtgcgcatgcgcggcagtggggcgccgggcgcgagcggagatgagggagcggccggagaagagaggatgctgttgagcgttaggtcgcgacccctgctggaagaggccatcccaatgttggtttatgtttattttccactgaccctatgagtgaagatatccttgaccatgagtccatctgaatatgttccagctcatccgacgttccaccaccatgttaagagatatggagatttccacaaggatttggagaggagccccagtagttactaaaattctgcattagatctgtcaggaaagatagatggacttcaaggcaattgcccaacaaactgcccaagaagttttaggttataatcgagatacatcaggctggaaagtggttaaaacttcaaaaaagataactgtttccagtaaggcttctagaaaattccatggaaatctatatcgtgttgaagggataattccagaatcaccagctaaactatctgatttcctctaccaaactggagacagaattacatgggataaatcattgcaagtgtataatatggtacacaggattgattcggacacattcatatgtcataccattacacaaagttttgccgtgggctccatttcccctcgagactttatcgacttagtgtacatcaagcgctacgaaggaaatatgaacattatcagttctaaaagtgtggattttccagaatatcctccatcttcaaattatatccgcggttataaccatccttgtggctttgtatgttcaccaatggaagaaaacccagcatattccaaactagtgatgtttgtccagacagaaatgagaggaaaattgtccccatcaataattgaaaaaaccatgccttccaacttagtaaacttcatcctcaatgcaaaagatggaataaaggcacacagaactccatcaagacgtggatttcatcataatagtcattcatgataccaaaagaagaaatgaggccgttctgctataaaatcatgtgtagtagttattgctgtttacttctaagtcaacgcacataaataatactgttaaactattctagacagtattcttgtacacatggctgaagatagttcataaaaataagaactcatagttgtacaagaatatggcattaaataccgtttttaatctcacgtaagaatgatgttaaataagtgttattagtatatttttatcttttgcttttgtccctgtaaaatcctctgtataaggaccaataagaaagcagatacagtcagaggtcagcattaactaaaagttaaaatac

SEQ ID NO: 186671 - DNA, 660 bp, Homo sapiens
  Payload ID: 16757
  Gene Symbol: STARD6
  Gene Name: StAR-related lipid transfer (START) domain containing 6
  ENST ID: ENST00000584040
  CDS Start-End: 238-465
gcggagatgagggagcggccggagaagagaggatgctgttgagcgttaggtcgcgacccctgctggaaggttaagagatatggagatttccacaaggatttggagaggagccccagtagttactaaaattctgcattagatctgtcaggaaagcttcccctaactgaaagctggatgatgacccgaaggaccagtgagactgcagcttccggaactcattcacagcagtaataatagatggacttcaaggcaattgcccaacaaactgcccaagaagttttaggttataatcgagatacatcaggctggaaagtggttaaaacttcagtgcagtggtgtgcacctatagtcccagctactcaggaggctaacacaggaggactgcttgagcacaggagtttgaggctgtcatgcaccatgattgtgcctgtgaatagccagtacactacagactgggcaacatagtgagaccctgtctctgaaaaatatatatatatatttttttcttttacaaaccagaaaaaaaagtgtttttacttttgttagtttttcattttcatttttcctgcatttgacagctaattatttgtggatttttattcccctttgagaaaaagataactgtttccagtaaggcttctagaaaattccatggaaatc

SEQ ID NO: 186672 - DNA, 696 bp, Homo sapiens
  Payload ID: 16757
  Gene Symbol: STARD6
  Gene Name: StAR-related lipid transfer (START) domain containing 6
  ENST ID: ENST00000577499
  CDS Start-End: 146-373
gagcggccggagaagagaggatgctgttgagcgttaggtcgcgacccctgctggaaggttaagagatatggagatttccacaaggatttggagaggagccccagtagttactaaaattctgcattagatctgtcaggaaagatagatggacttcaaggcaattgcccaacaaactgcccaagaagttttaggttataatcgagatacatcaggctggaaagtggttaaaacttcagtgcagtggtgtgcacctatagtcccagctactcaggaggctaacacaggaggactgcttgagcacaggagtttgaggctgtcatgcaccatgattgtgcctgtgaatagccagtacactacagactgggcaacatagtgagaccctgtctctgaaaaatatatatatatatttttttcttttacaaaccagaaaaaaaagtgtttttacttttgttagtttttcattttcatttttcctgcatttgacagctaattatttgtggatttttattcccctttgagaaaaagataactgtttccagtaaggcttctagaaaattccatggaaatctgtgagtacaatcttctatttacaattactgttttaaattcaatgccattgatgtatctggaatttcagtgctgcttcattagctataataaattattttatagtaataaatagaaattattaagtca

SEQ ID NO: 186673 - DNA, 3368 bp, Homo sapiens
  Payload ID: 16758
  Gene Symbol: STARD7
  Gene Name: StAR-related lipid transfer (START) domain containing 7
  Uniprot ID: Q9NQZ5
  ENST ID: ENST00000337288
  CDS Start-End: 385-1497
gcggaaggcgcgggagcttgcgtgctgctgggcctgagctgtctgtctcgtttctgtccgcgcgccctgcatcccggccccgggcgcccgctggaggtcgccgaggagccacagggctgactggtctgctgcccgggcccaggagtgcctggtgtagcagtcgcggagccatcccggcgtctgctgccatgaccgactctcccctcagaggagactcttcctcagcggtggctgcagagacagatgagcggcggctcctggccgcgggaccgtgagacgggttcgtggccggccatttagggggacgctgcgaccaccgcctgcgcccctccggactggttccttgggccccggaagctcgcggcgggccctgcgggaggcggcatgctcccgcggaggctgctggccgcctggctggcggggacgcggggcgggggcctgctggcgcttctggccaatcagtgccgcttcgtcacgggcctgcgcgtgcggcgcgcgcagcagatcgcgcagctctacggccgcctctactccgagagctcacgccgcgttctcctcggccgcctctggcgccggctgcacggccgtcctggccatgcctctgccttgatggcggcgttagccggcgtcttcgtttgggacgaggagaggatccaggaggaggagttgcagagatctattaatgagatgaagcggttggaagaaatgtcaaatatgtttcagagctctggagtccagcaccaccctccagaaccaaaagcccaaacagaagggaatgaagattcagagggcaaagagcaacgttgggaaatggtgatggataagaaacactttaagctgtggcggcgcccaattacaggcacccacctttaccagtaccgagtttttggaacctacacagatgtgacacctcggcagttcttcaatgttcagctggacacagagtatagaaaaaaatgggatgccctggtaatcaagctggaggtgattgagagggatgtggttagtggttccgaggttcttcactgggtaacccattttccttatccaatgtactcacgggattatgtttatgttcggcggtatagtgtggatcaggaaaacaacatgatggtgttggtgtcgcgtgctgtggagcatccgagtgtgccagagtctccagaattcgtcagggtcagatcatatgaatcccaaatggttatccgtccccacaagtcatttgatgagaatggctttgactacttactaacatacagtgacaatccccaaacggtgtttcctcgctactgtgttagttggatggtttccagtggcatgccagatttcctggagaagctgcacatggccactctgaaagccaagaatatggagattaaagtaaaggactacatctcagctaagcctctggaaatgagtagtgaagccaaggccaccagccagtcctctgagcgaaagaacgagggcagctgtggccctgctcggattgagtatgcttgacaggctttgggataagaagggacaaggtgcttctagccctgtctcagtccgttatcactctgctgtagaagggggacatgccacatgtattagaaggcatctgctgtaacttccagtgcaagataattcaataactgatgtcccatttcattcagagcccttattgctcttatcaaaacagaagaaggctacatttgtgggagtgttgtcatattctcaggccaactgttttgaaattcggtatctcactgagctaatctggaacaaacctctcacctcaggccagaaggggatgacctccatttgcttctctgagtagtttcctctgctgacattccaaatcccaccatcgattgtgcagcgctttggatttccttcagttctccaggtccacctggaaagtatagttggccagttgagtctctcaaatgaggggctactgggagtgctcttggtaacaatcatgatgtgaatgggtgtgaacgatacttggctatgttaagtgccttgtccgcaccttgcttttatctctagagacatgaagttattattaattttttttttttttaagtagagatggagtttcactctgtttcccaggctggtcttgaactcctgggccatgcctggccagggacatgaatttgtacaaagaaatttccctccctgcctgcacaatatcacccattgactcaccttatccaaagcaagtttcctgtgaatcggccagttcttctatattcattggatcattgcctccttcctaaccttccccatttaccaagaacactgggagactaatccttttagatagtagctttttgatgctcaaaacatcacatttaaatttagtttaaaaattttttaacttttgtgtcaaataggagttgaggaattgagcaggattctaccctagtccgattgtatagaaaacaccattttgattcaggtattatttttcatatttcaggtttgacttgttcttttcagaaggctaaagtcagaggaatgggggctgggccactcccttggagctctcagatctacagacaagctgtgtgaatgcatagatgtaatcttgtctcaaatactaatacagtggagatttggtttatgttaccattaagttcctctaaaaagtttttcttcctctcttcagagccaaaataaaagtgaactacactgttcagataaggtcacaatctgatgctgtcagtttgaccgagctggttttgcttatggtcatgctgcaatttgttagaataatagggatcaagttttaaatcctcctccttcccttttttctggagtcttgagggccagagtttttgtttttgtttttgtttttgttttcctgcttgctactgttttgtggtgttgaaaagtggtttaaacctgagactaacttaaacacttccttgaccttcttgttgcctgttcatttttgtgccaaggaagtagctgccccagtgtatgtcttgccttctccgcgtcattgttggaagaggagagatgcatcgagcagtcccagctgcttttcatttattacttcttctttccaggacctgacagaagtcagggaagagtccctgggttatgtccaaacttagcacctgcaattgttgggatgtggatggatgtgtgcataagagagagagagaatatgtgtgtgtgtgtgtgcgtctgcgagcgcacacacatgcacaagtgcgaaggagttgcggttgctccatgttctgacttagggcaatttgattctgcacttggggtctgtctgtacagttactcatgtcattgtaatgatttcactcctaactgtgacatttttatcaaatgtgtgaataaatacataaagattggtacaaaaaaaa

SEQ ID NO: 186674 - DNA, 742 bp, Homo sapiens
  Payload ID: 16758
  Gene Symbol: STARD7
  Gene Name: StAR-related lipid transfer (START) domain containing 7
  ENST ID: ENST00000443962
  CDS Start-End: 301-742
ggcagtcgcggaaggcgcgggagcttgcgtgctgctgggcctgagctgtctgtctcgtttctgtccgcgcgccctgcatcccggccccgggcgcccgctggaggtcgccgaggagccacagggctgactggtctgctgcccgggcccaggagtgcctggtgtagcagtcgcggagccatcccggcgtctgctgccatgaccgactctcccctcagaggagactcttcctcagcggtggctgcagagacagatgagcggcggctcctggccgcgggaccgtgagacggatctattaatgagatgaagcggttggaagaaatgtcaaatatgtttcagagctctggagtccagcaccaccctccagaaccaaaagcccaaacagaagggaatgaagattcagagggcaaagagcaacgttgggaaatggtgatggataagaaacactttaagctgtggcggcgcccaattacaggcacccacctttaccagtaccgagtttttggaacctacacagatgtgacacctcggcagttcttcaatgttcagctggacacagagtatagaaaaaaatgggatgccctggtaatcaagctggaggtgattgagagggatgtggttagtggttccgaggttcttcactgggtaacccattttccttatccaatgtactcacgggattatgtttatgttcggcggtatagtgtggatcaggaaaacaacatgatggtgttggtgtcgcggt

SEQ ID NO: 186675 - DNA, 4862 bp, Homo sapiens
  Payload ID: 16759
  Gene Symbol: STARD8
  Gene Name: StAR-related lipid transfer (START) domain containing 8
  Uniprot ID: Q92502
  ENST ID: ENST00000252336
  CDS Start-End: 373-3444
ggccttccaggaggcgggaggcgcccgctgtcgaggcagctgagccccggcaaccgctgctctccgcctctcccctcgcggggccggctcatggagcgcagggaccgggctggctctcgccgagccccgggcctcttttagcctcgtccccagagagggaggagccggtgcccggcacagccccgccggccctagaagctccccacgcgccaccatgcctctgctggacgttttctggtcttgcttcaggaaggtgaagtgcttcccattgctgcaggtgaagaagaacgctgaagccgaggccaaaagagcatgtgagtggcttcaagcaacaggattccctcagtatgtgcagctttttgaaggaggctgatgaccttgaataattgtgcctcgatgaaactggaggttcattttcaaagcaagcagaatgaagactcagaagaggaagagcagtgtaccatcagtagccactgggccttccagcaggaaagtaagtgctggtctcctatggggtcctctgatctgttggccccaccgagccctggcctgccagcgacctcaagctgtgagagcgtcctcaccgagcttagtgccacctctctgccagtcatcaccgtgagcctaccacccgagccagcagacttgcccttgccaggccgtgcccccagctcgagtgaccggcccctcctcagccccacccagggccaggagggtccccaggacaaagccaagaagcgccatcgtaaccgtagcttcctcaagcaccttgaatctctgaggcggaaggaaaagagtggcagccagcaagcagagcccaagcatagtccagccacctcagagaaggtctccaaagcctcatctttccgcagttgtcgtggcttcctctcagctggattttacagggccaagaactgggccgccacctcagccggtggcagtggtgccaatactcggaaggcctgggaggcctggcctgtggcctcgttccggcatcctcagtggacacaccggggtgattgcctggtgcacgttcctggggaccacaaaccaggcacattccctcgctccctgtccattgagagcctgtgtcctgaggatggacaccgcctggcagactggcagccaggtaggcggtggggctgtgaggggcgccggggctcctgtggctcaacgggcagccatgccagcacgtatgacaacttgcctgagctgtacccagctgagcctgtaatggttggggctgaggctgaagatgaagatgatgaggagagtgggggcagctatgctcacctagacgacatcctccagcacgtgtgggggctacagcaacgagtagagctgtggtctcgggccatgtacccagacctggggcctggagatgaggaagaggaggaggccacttcatcagtagaaatagccacagttgaggtcaaatgccaagctgaggctctcagccagatggaggttccggcccatggagagtccccagcctgggcccaggctgaagtccagccagcagtcctggctccggctcaggctccagctgaggctgaaccagtggcacaggaagaggctgaggccccggccccagccccggccccggccccagcccaggacagtgagcaggaggcacattcaggcggggaacccacctttgcctctagcctgtctgtggaagaaggacactccatttctgacactgtggcctcctccagcgaacttgacagtagtgggaactccatgaatgaggctgaggctgcggggcccctggctggactccaggcatcaatgccccgtgaacggcgcgattcaggtgttggggcctcacttaccagaccctgcaggaagctccgttggcatagcttccagaactcccatcgtcccagcctcaactcagagtcgctggagatcaaccggcagtttgcaggccagatcaacctcctgcacaagggctcactgctgcggcttaccgcgttcatggagaagtacactgtgccccacaagcagggctgggtctggtcaatgcccaagttcatgaggaggaacaagaccccagattaccggggacagcacgtatttggggtgccacccctcatccacgtgcagcgcacgggccagccactgccacagagcattcagcaagccatgcgctacttgcgcagccagtgcctggaccaagtaggcatcttccgcaagtctggggtcaagtccaggatccagaacctgcgtcaaatgaatgagacctcgcctgacaatgtctgctacgagggccagtcagcctacgacgtggctgacctgctaaagcagtatttccgggacctgcctgagcccatcttcaccagcaagctcaccaccactttcctccagatctaccagctcctccccaaggatcagtggttggcagcagcacaagccgccaccttgctgctccccgatgagaaccgagaggtgctacagaccctgctctacttcttaagtgacattgcctctgccgaggaaaaccagatgacagcaggcaacctggcagtgtgcctggcgccctccatcttccacctcaatgtctctaagaaggatagcccctctcccaggatcaagagcaaacgcagcctcattggcaggccaggccctagggacctgagtgacaacatggcagccacccagggcctgtcgcacatgatcagtgactgcaagaaacttttccaggtgccccaggacatggtgctgcagctgtgcagctcctacagcgcagctgagctcagccctcccggcccagccctggctgagctgcgtcaggcccaagctgcaggggtaagcctgagcctctacatggaagagaatatccaggacctgctgcgtgatgctgctgagcgcttcaagggctggatgagcgtgccagggccccagcacacggagctggcttgcaggaaggcaccggatgggcaccccctgcggctatggaaggcatccacagaggtggcagcccccccagctgtggtgctgcatcgtgttctccgggagcgggccctctgggatgaggatctgctgcgggcccaggtgctggaagccctgatgccgggtgtggagctgtaccactatgtcaccgacagcatggcaccccatccctgccgcgactttgtggtgcttcggatgtggcgctctgacctgcctcgtgggggttgcctgcttgtctcccagtccctggatccggaacaacctgtgccagagtcgggtgtgcgagccctcatgctcacatcccagtacctcatggagccttgcggcttgggccgctctcggctcacacacatctgccgggctgacctcaggggccgttctcctgactggtacaacaaagtctttggacacctgtgtgccatggaagtggcaaagatccgggactccttccccaccctgcaggcagcgggccctgagacaaagctgtgagccttgggctggtcccagggtggcaccacccaggccccctgggcaccaagggagcgagggggaataagagcagggcagccccctgggtgccgctgtcaggagcagagccaggcccaggtggctccagctgcctgtcctgtcccctttcctaaagctcctctgcacatagaggggagaaaaagagaatttaggcaactccactcccccttcacccccaaccctgtattctactctcccgaaaagagaagagaatcgcatgagtagcaagactgctgccaccagccacctgcttgtgaggccgccacttggcatgaagcctccacagctccccgcctgcaggggcaaagaggtcgacagcaatgtgtgatcccagctctctgccagactgagagggcaagccgtcttgtttgctgcaaggatgcttttgaggttggacaggaggttctggtcctgcctttggggccaacgctggctctgaagtgtctttttcagaggaattggactggagtgaatgggcacaggggtggagcgcagggcagccccagtcaccacgagctgtttcatttgtgtaaatacgatgctgaattttatgaggctgagttaagagtgggcactgacgggcccctaatatgtgacatgacgatttggcatagatagggatgtgagagtggagtaccttcctttctcaagtctcgagatgccagtgaaaccagtattccctgacttgggtttcacactttatcgaccaccccatggggtcctgtgtagcctttggccacgcactgacactgcccaggccaagcaaaagcagagtgtggttaagagacaagggtctatgtcatcatcccttttgcttatggtagtgggctaacataacagcccctttctcaagcagagacctggcccctgggccagccagatggaagggcctatcttagccagctggagcttaagccaaacctgttctgtcccactggccagccatctttgctcacatggaaattcaaatgccattcaaaggccactggtgctttatttttctatctgctgagtaaactgaaatgagatgggtcccaaccaccactgtaattttcaagcctattttatttgtacctgtaaatactgtacagctaatatatatatatatatatatatatgtgtgtgtgtgtgtgtgtgtatatgtgtttatagagatacacacacatatatatgtgtgtatatatatacacatacatatatatacacacacgcatttgcacagacacacacatatatcaattctcatgagtgtattataatctctggtgggggcaagtgtctggaaggcctgaggggcacttcagatgagaatggagaggtagggagccaggtgcagcaggatccctcaaatcaataaagcattaccagagatgcacttt

SEQ ID NO: 186676 - DNA, 4820 bp, Homo sapiens
  Payload ID: 16759
  Gene Symbol: STARD8
  Gene Name: StAR-related lipid transfer (START) domain containing 8
  Uniprot ID: Q92502
  ENST ID: ENST00000374597
  CDS Start-End: 338-3409
ctcgggttgacaacggctaagcagccgcggcagctgctcttctggctggcaccgtcacccctgcccgaccccaggccccgcgtgtgtcccggacggagcagtccctcctgggctcgcctcctgcccgctcgctctgtgtcagcgcccgaacccaaaggggtggacgcggcctccagaagccgaggccaaaagagcatgtgagtggcttcaagcaacaggattccctcagtatgtgcagctttttgaagaaggttcgtttcccctggatattggctctgtgaagaaaaaccacggttttctggacgaggactctttgggggccctgtgtaggaggctgatgaccttgaataattgtgcctcgatgaaactggaggttcattttcaaagcaagcagaatgaagactcagaagaggaagagcagtgtaccatcagtagccactgggccttccagcaggaaagtaagtgctggtctcctatggggtcctctgatctgttggccccaccgagccctggcctgccagcgacctcaagctgtgagagcgtcctcaccgagcttagtgccacctctctgccagtcatcaccgtgagcctaccacccgagccagcagacttgcccttgccaggccgtgcccccagctcgagtgaccggcccctcctcagccccacccagggccaggagggtccccaggacaaagccaagaagcgccatcgtaaccgtagcttcctcaagcaccttgaatctctgaggcggaaggaaaagagtggcagccagcaagcagagcccaagcatagtccagccacctcagagaaggtctccaaagcctcatctttccgcagttgtcgtggcttcctctcagctggattttacagggccaagaactgggccgccacctcagccggtggcagtggtgccaatactcggaaggcctgggaggcctggcctgtggcctcgttccggcatcctcagtggacacaccggggtgattgcctggtgcacgttcctggggaccacaaaccaggcacattccctcgctccctgtccattgagagcctgtgtcctgaggatggacaccgcctggcagactggcagccaggtaggcggtggggctgtgaggggcgccggggctcctgtggctcaacgggcagccatgccagcacgtatgacaacttgcctgagctgtacccagctgagcctgtaatggttggggctgaggctgaagatgaagatgatgaggagagtgggggcagctatgctcacctagacgacatcctccagcacgtgtgggggctacagcaacgagtagagctgtggtctcgggccatgtacccagacctggggcctggagatgaggaagaggaggaggccacttcatcagtagaaatagccacagttgaggtcaaatgccaagctgaggctctcagccagatggaggttccggcccatggagagtccccagcctgggcccaggctgaagtccagccagcagtcctggctccggctcaggctccagctgaggctgaaccagtggcacaggaagaggctgaggccccggccccagccccggccccggccccagcccaggacagtgagcaggaggcacattcaggcggggaacccacctttgcctctagcctgtctgtggaagaaggacactccatttctgacactgtggcctcctccagcgaacttgacagtagtgggaactccatgaatgaggctgaggctgcggggcccctggctggactccaggcatcaatgccccgtgaacggcgcgattcaggtgttggggcctcacttaccagaccctgcaggaagctccgttggcatagcttccagaactcccatcgtcccagcctcaactcagagtcgctggagatcaaccggcagtttgcaggccagatcaacctcctgcacaagggctcactgctgcggcttaccgcgttcatggagaagtacactgtgccccacaagcagggctgggtctggtcaatgcccaagttcatgaggaggaacaagaccccagattaccggggacagcacgtatttggggtgccacccctcatccacgtgcagcgcacgggccagccactgccacagagcattcagcaagccatgcgctacttgcgcagccagtgcctggaccaagtaggcatcttccgcaagtctggggtcaagtccaggatccagaacctgcgtcaaatgaatgagacctcgcctgacaatgtctgctacgagggccagtcagcctacgacgtggctgacctgctaaagcagtatttccgggacctgcctgagcccatcttcaccagcaagctcaccaccactttcctccagatctaccagctcctccccaaggatcagtggttggcagcagcacaagccgccaccttgctgctccccgatgagaaccgagaggtgctacagaccctgctctacttcttaagtgacattgcctctgccgaggaaaaccagatgacagcaggcaacctggcagtgtgcctggcgccctccatcttccacctcaatgtctctaagaaggatagcccctctcccaggatcaagagcaaacgcagcctcattggcaggccaggccctagggacctgagtgacaacatggcagccacccagggcctgtcgcacatgatcagtgactgcaagaaacttttccaggtgccccaggacatggtgctgcagctgtgcagctcctacagcgcagctgagctcagccctcccggcccagccctggctgagctgcgtcaggcccaagctgcaggggtaagcctgagcctctacatggaagagaatatccaggacctgctgcgtgatgctgctgagcgcttcaagggctggatgagcgtgccagggccccagcacacggagctggcttgcaggaaggcaccggatgggcaccccctgcggctatggaaggcatccacagaggtggcagcccccccagctgtggtgctgcatcgtgttctccgggagcgggccctctgggatgaggatctgctgcgggcccaggtgctggaagccctgatgccgggtgtggagctgtaccactatgtcaccgacagcatggcaccccatccctgccgcgactttgtggtgcttcggatgtggcgctctgacctgcctcgtgggggttgcctgcttgtctcccagtccctggatccggaacaacctgtgccagagtcgggtgtgcgagccctcatgctcacatcccagtacctcatggagccttgcggcttgggccgctctcggctcacacacatctgccgggctgacctcaggggccgttctcctgactggtacaacaaagtctttggacacctgtgtgccatggaagtggcaaagatccgggactccttccccaccctgcaggcagcgggccctgagacaaagctgtgagccttgggctggtcccagggtggcaccacccaggccccctgggcaccaagggagcgagggggaataagagcagggcagccccctgggtgccgctgtcaggagcagagccaggcccaggtggctccagctgcctgtcctgtcccctttcctaaagctcctctgcacatagaggggagaaaaagagaatttaggcaactccactcccccttcacccccaaccctgtattctactctcccgaaaagagaagagaatcgcatgagtagcaagactgctgccaccagccacctgcttgtgaggccgccacttggcatgaagcctccacagctccccgcctgcaggggcaaagaggtcgacagcaatgtgtgatcccagctctctgccagactgagagggcaagccgtcttgtttgctgcaaggatgcttttgaggttggacaggaggttctggtcctgcctttggggccaacgctggctctgaagtgtctttttcagaggaattggactggagtgaatgggcacaggggtggagcgcagggcagccccagtcaccacgagctgtttcatttgtgtaaatacgatgctgaattttatgaggctgagttaagagtgggcactgacgggcccctaatatgtgacatgacgatttggcatagatagggatgtgagagtggagtaccttcctttctcaagtctcgagatgccagtgaaaccagtattccctgacttgggtttcacactttatcgaccaccccatggggtcctgtgtagcctttggccacgcactgacactgcccaggccaagcaaaagcagagtgtggttaagagacaagggtctatgtcatcatcccttttgcttatggtagtgggctaacataacagcccctttctcaagcagagacctggcccctgggccagccagatggaagggcctatcttagccagctggagcttaagccaaacctgttctgtcccactggccagccatctttgctcacatggaaattcaaatgccattcaaaggccactggtgctttatttttctatctgctgagtaaactgaaatgagatgggtcccaaccaccactgtaattttcaagcctattttatttgtacctgtaaatactgtacagctaatatatatatatatatatatatatgtgtgtgtgtgtgtgtgtgtatatgtgtttatagagatacacacacatatatatgtgtgtatatatatacacatacatatatatacacacacgcatttgcacagacacacacatatatcaattctcatgagtgtattataatctctggtgggggcaagtgtctggaaggcctgaggggcacttcagatgagaatggagaggtagggagccaggtgcagcaggatccctcaaatcaataaagcattaccagagat

SEQ ID NO: 186677 - DNA, 4841 bp, Homo sapiens
  Payload ID: 16759
  Gene Symbol: STARD8
  Gene Name: StAR-related lipid transfer (START) domain containing 8
  Uniprot ID: Q92502
  ENST ID: ENST00000374599
  CDS Start-End: 116-3427
agggaccgggctggctctcgccgagccccgggcctcttttagcctcgtccccagagagggaggagccggtgcccggcacagccccgccggccctagaagctccccacgcgccaccatgcctctgctggacgttttctggtcttgcttcaggaaggtgaagtgcttcccattgctgcaggtgaagaagaacgctgaagccgaggccaaaagagcatgtgagtggcttcaagcaacaggattccctcagtatgtgcagctttttgaagaaggttcgtttcccctggatattggctctgtgaagaaaaaccacggttttctggacgaggactctttgggggccctgtgtaggaggctgatgaccttgaataattgtgcctcgatgaaactggaggttcattttcaaagcaagcagaatgaagactcagaagaggaagagcagtgtaccatcagtagccactgggccttccagcaggaaagtaagtgctggtctcctatggggtcctctgatctgttggccccaccgagccctggcctgccagcgacctcaagctgtgagagcgtcctcaccgagcttagtgccacctctctgccagtcatcaccgtgagcctaccacccgagccagcagacttgcccttgccaggccgtgcccccagctcgagtgaccggcccctcctcagccccacccagggccaggagggtccccaggacaaagccaagaagcgccatcgtaaccgtagcttcctcaagcaccttgaatctctgaggcggaaggaaaagagtggcagccagcaagcagagcccaagcatagtccagccacctcagagaaggtctccaaagcctcatctttccgcagttgtcgtggcttcctctcagctggattttacagggccaagaactgggccgccacctcagccggtggcagtggtgccaatactcggaaggcctgggaggcctggcctgtggcctcgttccggcatcctcagtggacacaccggggtgattgcctggtgcacgttcctggggaccacaaaccaggcacattccctcgctccctgtccattgagagcctgtgtcctgaggatggacaccgcctggcagactggcagccaggtaggcggtggggctgtgaggggcgccggggctcctgtggctcaacgggcagccatgccagcacgtatgacaacttgcctgagctgtacccagctgagcctgtaatggttggggctgaggctgaagatgaagatgatgaggagagtgggggcagctatgctcacctagacgacatcctccagcacgtgtgggggctacagcaacgagtagagctgtggtctcgggccatgtacccagacctggggcctggagatgaggaagaggaggaggccacttcatcagtagaaatagccacagttgaggtcaaatgccaagctgaggctctcagccagatggaggttccggcccatggagagtccccagcctgggcccaggctgaagtccagccagcagtcctggctccggctcaggctccagctgaggctgaaccagtggcacaggaagaggctgaggccccggccccagccccggccccggccccagcccaggacagtgagcaggaggcacattcaggcggggaacccacctttgcctctagcctgtctgtggaagaaggacactccatttctgacactgtggcctcctccagcgaacttgacagtagtgggaactccatgaatgaggctgaggctgcggggcccctggctggactccaggcatcaatgccccgtgaacggcgcgattcaggtgttggggcctcacttaccagaccctgcaggaagctccgttggcatagcttccagaactcccatcgtcccagcctcaactcagagtcgctggagatcaaccggcagtttgcaggccagatcaacctcctgcacaagggctcactgctgcggcttaccgcgttcatggagaagtacactgtgccccacaagcagggctgggtctggtcaatgcccaagttcatgaggaggaacaagaccccagattaccggggacagcacgtatttggggtgccacccctcatccacgtgcagcgcacgggccagccactgccacagagcattcagcaagccatgcgctacttgcgcagccagtgcctggaccaagtaggcatcttccgcaagtctggggtcaagtccaggatccagaacctgcgtcaaatgaatgagacctcgcctgacaatgtctgctacgagggccagtcagcctacgacgtggctgacctgctaaagcagtatttccgggacctgcctgagcccatcttcaccagcaagctcaccaccactttcctccagatctaccagctcctccccaaggatcagtggttggcagcagcacaagccgccaccttgctgctccccgatgagaaccgagaggtgctacagaccctgctctacttcttaagtgacattgcctctgccgaggaaaaccagatgacagcaggcaacctggcagtgtgcctggcgccctccatcttccacctcaatgtctctaagaaggatagcccctctcccaggatcaagagcaaacgcagcctcattggcaggccaggccctagggacctgagtgacaacatggcagccacccagggcctgtcgcacatgatcagtgactgcaagaaacttttccaggtgccccaggacatggtgctgcagctgtgcagctcctacagcgcagctgagctcagccctcccggcccagccctggctgagctgcgtcaggcccaagctgcaggggtaagcctgagcctctacatggaagagaatatccaggacctgctgcgtgatgctgctgagcgcttcaagggctggatgagcgtgccagggccccagcacacggagctggcttgcaggaaggcaccggatgggcaccccctgcggctatggaaggcatccacagaggtggcagcccccccagctgtggtgctgcatcgtgttctccgggagcgggccctctgggatgaggatctgctgcgggcccaggtgctggaagccctgatgccgggtgtggagctgtaccactatgtcaccgacagcatggcaccccatccctgccgcgactttgtggtgcttcggatgtggcgctctgacctgcctcgtgggggttgcctgcttgtctcccagtccctggatccggaacaacctgtgccagagtcgggtgtgcgagccctcatgctcacatcccagtacctcatggagccttgcggcttgggccgctctcggctcacacacatctgccgggctgacctcaggggccgttctcctgactggtacaacaaagtctttggacacctgtgtgccatggaagtggcaaagatccgggactccttccccaccctgcaggcagcgggccctgagacaaagctgtgagccttgggctggtcccagggtggcaccacccaggccccctgggcaccaagggagcgagggggaataagagcagggcagccccctgggtgccgctgtcaggagcagagccaggcccaggtggctccagctgcctgtcctgtcccctttcctaaagctcctctgcacatagaggggagaaaaagagaatttaggcaactccactcccccttcacccccaaccctgtattctactctcccgaaaagagaagagaatcgcatgagtagcaagactgctgccaccagccacctgcttgtgaggccgccacttggcatgaagcctccacagctccccgcctgcaggggcaaagaggtcgacagcaatgtgtgatcccagctctctgccagactgagagggcaagccgtcttgtttgctgcaaggatgcttttgaggttggacaggaggttctggtcctgcctttggggccaacgctggctctgaagtgtctttttcagaggaattggactggagtgaatgggcacaggggtggagcgcagggcagccccagtcaccacgagctgtttcatttgtgtaaatacgatgctgaattttatgaggctgagttaagagtgggcactgacgggcccctaatatgtgacatgacgatttggcatagatagggatgtgagagtggagtaccttcctttctcaagtctcgagatgccagtgaaaccagtattccctgacttgggtttcacactttatcgaccaccccatggggtcctgtgtagcctttggccacgcactgacactgcccaggccaagcaaaagcagagtgtggttaagagacaagggtctatgtcatcatcccttttgcttatggtagtgggctaacataacagcccctttctcaagcagagacctggcccctgggccagccagatggaagggcctatcttagccagctggagcttaagccaaacctgttctgtcccactggccagccatctttgctcacatggaaattcaaatgccattcaaaggccactggtgctttatttttctatctgctgagtaaactgaaatgagatgggtcccaaccaccactgtaattttcaagcctattttatttgtacctgtaaatactgtacagctaatatatatatatatatatatatatgtgtgtgtgtgtgtgtgtgtatatgtgtttatagagatacacacacatatatatgtgtgtatatatatacacatacatatatatacacacacgcatttgcacagacacacacatatatcaattctcatgagtgtattataatctctggtgggggcaagtgtctggaaggcctgaggggcacttcagatgagaatggagaggtagggagccaggtgcagcaggatccctcaaatcaataaagcattaccagagatgca

SEQ ID NO: 186678 - DNA, 4864 bp, Homo sapiens
  Payload ID: 16759
  Gene Symbol: STARD8
  Gene Name: StAR-related lipid transfer (START) domain containing 8
  ENST ID: ENST00000523864
  CDS Start-End: 215-373
ggccttccaggaggcgggaggcgcccgctgtcgaggcagctgagccccggcaaccgctgctctccgcctctcccctcgcggggccggctcatggagcgcagggaccgggctggctctcgccgagccccgggcctcttttagcctcgtccccagagagggaggagccggtgcccggcacagccccgccggccctagaagctccccacgcgccaccatgcctctgctggacgttttctggtcttgcttcaggaaggtgaagtgcttcccattgctgcaggtgaagaagaacgctgaagccgaggccaaaagagcatgtgagtggcttcaagcaacaggattccctcagtatgtgcagctttttgaaggaggctgatgaccttgaataattgtgcctcgatgaaactggaggttcattttcaaagcaagcagaatgaagactcagaagaggaagagcagtgtaccatcagtagccactgggccttccagcaggaaagtaagtgctggtctcctatggggtcctctgatctgttggccccaccgagccctggcctgccagcgacctcaagctgtgagagcgtcctcaccgagcttagtgccacctctctgccagtcatcaccgtgagcctaccacccgagccagcagacttgcccttgccaggccgtgcccccagctcgagtgaccggcccctcctcagccccacccagggccaggagggtccccaggacaaagccaagaagcgccatcgtaaccgtagcttcctcaagcaccttgaatctctgaggcggaaggaaaagagtggcagccagcaagcagagcccaagcatagtccagccacctcagagaaggtctccaaagcctcatctttccgcagttgtcgtggcttcctctcagctggattttacagggccaagaactgggccgccacctcagccggtggcagtggtgccaatactcggaaggcctgggaggcctggcctgtggcctcgttccggcatcctcagtggacacaccggggtgattgcctggtgcacgttcctggggaccacaaaccaggcacattccctcgctccctgtccattgagagcctgtgtcctgaggatggacaccgcctggcagactggcagccaggtaggcggtggggctgtgaggggcgccggggctcctgtggctcaacgggcagccatgccagcacgtatgacaacttgcctgagctgtacccagctgagcctgtaatggttggggctgaggctgaagatgaagatgatgaggagagtgggggcagctatgctcacctagacgacatcctccagcacgtgtgggggctacagcaacgagtagagctgtggtctcgggccatgtacccagacctggggcctggagatgaggaagaggaggaggccacttcatcagtagaaatagccacagttgaggtcaaatgccaagctgaggctctcagccagatggaggttccggcccatggagagtccccagcctgggcccaggctgaagtccagccagcagtcctggctccggctcaggctccagctgaggctgaaccagtggcacaggaagaggctgaggccccggccccagccccggccccggccccagcccaggacagtgagcaggaggcacattcaggcggggaacccacctttgcctctagcctgtctgtggaagaaggacactccatttctgacactgtggcctcctccagcgaacttgacagtagtgggaactccatgaatgaggctgaggctgcggggcccctggctggactccaggcatcaatgccccgtgaacggcgcgattcaggtgttggggcctcacttaccagaccctgcaggaagctccgttggcatagcttccagaactcccatcgtcccagcctcaactcagagtcgctggagatcaaccggcagtttgcaggccagatcaacctcctgcacaagggctcactgctgcggcttaccgcgttcatggagaagtacactgtgccccacaagcagggctgggtctggtcaatgcccaagttcatgaggaggaacaagaccccagattaccggggacagcacgtatttggggtgccacccctcatccacgtgcagcgcacgggccagccactgccacagagcattcagcaagccatgcgctacttgcgcagccagtgcctggaccaagtaggcatcttccgcaagtctggggtcaagtccaggatccagaacctgcgtcaaatgaatgagacctcgcctgacaatgtctgctacgagggccagtcagcctacgacgtggctgacctgctaaagcagtatttccgggacctgcctgagcccatcttcaccagcaagctcaccaccactttcctccagatctaccagctcctccccaaggatcagtggttggcagcagcacaagccgccaccttgctgctccccgatgagaaccgagaggtgctacagaccctgctctacttcttaagtgacattgcctctgccgaggaaaaccagatgacagcaggcaacctggcagtgtgcctggcgccctccatcttccacctcaatgtctctaagaaggatagcccctctcccaggatcaagagcaaacgcagcctcattggcaggccaggccctagggacctgagtgacaacatggcagccacccagggcctgtcgcacatgatcagtgactgcaagaaacttttccaggtgccccaggacatggtgctgcagctgtgcagctcctacagcgcagctgagctcagccctcccggcccagccctggctgagctgcgtcaggcccaagctgcaggggtaagcctgagcctctacatggaagagaatatccaggacctgctgcgtgatgctgctgagcgcttcaagggctggatgagcgtgccagggccccagcacacggagctggcttgcaggaaggcaccggatgggcaccccctgcggctatggaaggcatccacagaggtggcagcccccccagctgtggtgctgcatcgtgttctccgggagcgggccctctgggatgaggatctgctgcgggcccaggtgctggaagccctgatgccgggtgtggagctgtaccactatgtcaccgacagcatggcaccccatccctgccgcgactttgtggtgcttcggatgtggcgctctgacctgcctcgtgggggttgcctgcttgtctcccagtccctggatccggaacaacctgtgccagagtcgggtgtgcgagccctcatgctcacatcccagtacctcatggagccttgcggcttgggccgctctcggctcacacacatctgccgggctgacctcaggggccgttctcctgactggtacaacaaagtctttggacacctgtgtgccatggaagtggcaaagatccgggactccttccccaccctgcaggcagcgggccctgagacaaagctgtgagccttgggctggtcccagggtggcaccacccaggccccctgggcaccaagggagcgagggggaataagagcagggcagccccctgggtgccgctgtcaggagcagagccaggcccaggtggctccagctgcctgtcctgtcccctttcctaaagctcctctgcacatagaggggagaaaaagagaatttaggcaactccactcccccttcacccccaaccctgtattctactctcccgaaaagagaagagaatcgcatgagtagcaagactgctgccaccagccacctgcttgtgaggccgccacttggcatgaagcctccacagctccccgcctgcaggggcaaagaggtcgacagcaatgtgtgatcccagctctctgccagactgagagggcaagccgtcttgtttgctgcaaggatgcttttgaggttggacaggaggttctggtcctgcctttggggccaacgctggctctgaagtgtctttttcagaggaattggactggagtgaatgggcacaggggtggagcgcagggcagccccagtcaccacgagctgtttcatttgtgtaaatacgatgctgaattttatgaggctgagttaagagtgggcactgacgggcccctaatatgtgacatgacgatttggcatagatagggatgtgagagtggagtaccttcctttctcaagtctcgagatgccagtgaaaccagtattccctgacttgggtttcacactttatcgaccaccccatggggtcctgtgtagcctttggccacgcactgacactgcccaggccaagcaaaagcagagtgtggttaagagacaagggtctatgtcatcatcccttttgcttatggtagtgggctaacataacagcccctttctcaagcagagacctggcccctgggccagccagatggaagggcctatcttagccagctggagcttaagccaaacctgttctgtcccactggccagccatctttgctcacatggaaattcaaatgccattcaaaggccactggtgctttatttttctatctgctgagtaaactgaaatgagatgggtcccaaccaccactgtaattttcaagcctattttatttgtacctgtaaatactgtacagctaatatatatatatatatatatatatgtgtgtgtgtgtgtgtgtgtatatgtgtttatagagatacacacacatatatatgtgtgtatatatatacacatacatatatatacacacacgcatttgcacagacacacacatatatcaattctcatgagtgtattataatctctggtgggggcaagtgtctggaaggcctgaggggcacttcagatgagaatggagaggtagggagccaggtgcagcaggatccctcaaatcaataaagcattaccagagatgcactttaa

SEQ ID NO: 186679 - DNA, 15567 bp, Homo sapiens
  Payload ID: 16760
  Gene Symbol: STARD9
  Gene Name: StAR-related lipid transfer (START) domain containing 9
  Uniprot ID: Q9P2P6
  ENST ID: ENST00000290607
  CDS Start-End: 58-14160
gggggcctgggatgctgccgctgagctgacccgctggacttgggttgtggcagacggatggcgaacgtgcaggtcgccgtgcgggtccggccgctcagcaagagggagaccaaagaagggggaagaattattgtggaagttgatggcaaagtggcaaaaatcaggaatttaaaggtggacaatcgaccagatggctttggggactcccgggagaaggttatggcatttggctttgattactgctactggtcagtcaacccagaggatccccagtatgcatctcaagatgtggttttccaggatttagggatggaagtactgtctggagttgccaaaggctataacatatgcctttttgcttatggacagacaggctctgggaagacatataccatgctggggaccccagcctctgttgggttgacaccacggatatgtgagggtctcttcgtcagggagaaagactgtgcctcactgccttcctcctgtaggataaaagtaagttttctagaaatctataatgaacgggtgcgggatctgttgaagcaatctggtcaaaaaaagtcctataccctgcgggtcagggagcatccagagatggggccctatgtacaaggtttatctcaacatgtagttaccaattataagcaagtaatccaactcttggaggagggaattgcaaacagaatcacagcagccacccatgttcatgaggccagcagcagatcccacgccattttcacgatccactacacgcaggcaatcctggagaacaacctcccttctgaaatggctagcaagatcaaccttgtggacctagcaggcagcgaaagagcagatcccagttactgtaaggaccgcattgctgaaggagccaatatcaacaagtcccttgtgactctaggaattgtcatctccaccttagcccagaactcccaagttttcagcagctgccagagcctcaacagctcagtcagcaatggtggtgacagtgggatccttagctctccttctgggaccagcagtggaggggcaccctcccgaaggcagtcttatatcccataccgagactctgtgttgacctggctgctgaaggacagccttggaggcaactctaaaaccatcatggttgccacggtgtctcctgcacacactagctacagtgagaccatgagcacactgagatatgcatccagtgccaaaaacattatcaacaagccacgagtaaatgaggatgcaaacttaaaactgattagagaactcagagaagagattgaaagactgaaagccctgctgctgagctttgaactgagaaacttcagttcattgagtgatgaaaacctgaaggagctggttctccaaaatgaattgaagatagaccagctgactaaagactggacccagaagtggaatgattggcaggccctcatggagcattacagtgtggacatcaacaggaggagggctggggtggtcatcgactccagcctgccacacttgatggccttggaggatgatgtgctcagcacaggtgttgtgctctatcatctcaaggaagggacaacaaaaataggaaggattgactcagaccaggaacaggacattgtcctgcagggtcagtggattgagagagaccactgcactatcaccagtgcctgtggtgtagttgttctacgacctgcccgtggggcccgctgtacagtcaatggccgggaggtcactgcctcctgccgtctgactcaaggagctgtcataaccctggggaaggcacagaagttccgattcaaccacccagcagaggctgctgtcctgcggcagcgaaggcaggttggagaggctgctgctggtcgtggctcgttggagtggctggatttggatggagatctcgctgcctcccggctgggtctctcccctttgctttggaaggaaaggagagcgcttgaagagcaatgtgacgaggaccatcagacaccgagggatggagagacatcccacagggcccagattcagcagcagcagagctacgtagaggatttgaggcatcaaatcctagcagaagagattcgagctgcgaaggaactggaatttgaccaagcttggattagccagcagattaaagaaaaccagcagtgtctgctcagagaagagacctggctggccagcttgcaacagcagcagcaagaagaccaggtagcagagaaagaacttgaggcatctgtggcacttgatgcttggcttcagacagatcctgagattcagccatccccatttgtccaaagtcagaaaagggtggtgcacctgcagctcctgcggagacacactcttcgggcagcagagcggaatgtccggcggaaaaaggtctcattccagctagagagaatcatcaaaaagcagaggctgctggaggcccagaagagactggagaagctcacgacattgtgctggctccaggatgacagcacccaggagcccccataccaggtcctcagccctgatgccacagtcccacggcctccatgtagaagcaaattgacgagttgcagttctttgagcccccaaagactctgcagcaagcacatgccccagctacacagcattttcctaagttgggatccctctaccacattgccacctaggcctgaccctacacaccaaacatcagagaaaacatcatcagaagagcatttgccacaggctgcttcctaccctgcaaggacagggtgcctccgcaagaacggcctgcattcctcaggtcatgggcagccctgcacagccagagcagccttggccaggaagggagcctcagctccagacgcttgcctcaccatgagtcccaactctgttggcatccaggaaatggagatgggggttaagcagccccatcagatggtgagccagggcttagcatctctgaggaaatcagctaacaaactaaagccaaggcatgagccaaagatcttcacctctactacccagaccagaggggcgaagggactagcagaccctagccacacacaagctgggtggcgaaaagaagggaaccttgggacccacaaggctgctaagggagccagttgcaattccttgtatcctcatggacccaggcagactgctgggcacggaaaggcagtcaagactttttggacagaatacaaaccaccttctccaagcagggcatcaaaaaggcatcagagggttctggcaactagggtcagaaatattaccaaaaagtcctctcacttgcctcttggcagtcctttgaagagacaacaaaatacaagggacccagacaccatggtcccactcacagatttcagcccagtaatggatcattcaagagaaaaagacaatgatttatctgacacagatagcaactactcattggattctctctcatgtgtctatgccaaagccctgatagagccactgaagccagaggagaggaaatgggatttcccagagccagagaactctgaaagtgatgacagccaactatctgaggactcactggctgagaagaggtaccaaagccccaaaaacaggctagggggcaatcgtcccaccaacaaccgtggccaacccaggaccagaactagagcttctgtgaggggcttcactgcagcctcagacagtgacctacttgctcaaactcataggagcttctccttggatagcctgattgatgcagaggaagaactgggggaagatcagcaagaagaacctttccctggttcagctgacgagatacccacagagactttttggcacctggaggactctagtctgcctgtaatggaccaagaggcaatatgcaggcttggtcccatcaactacagaacagcagctaggctggatgccgtcctgccaatgagcagttcgttttaccttgatcctcagttccaaccccattgtgagctccaaccccattgtgagctccaaccccattgtgagctccagccccattgtgagcaggctgaatcacaggtagagccaagctactctgaacaagccgactctctccaaggcatgcagctttcaagagagagcccactgatgtccatggattcctggttttcctgtgactctaagatcaaccccagcagccccccaggaatagtgggttctttatgtccaagtcctgatatgcaggaatttcactcctgtaagggggagaggcctggatactggccaaatactgaggaactaaagccatcagatgcagaaacggttctgccatatagctccaaactgcaccaaggcagtactgagctcctctgcagtgcaagagatgagcacacagcctctgctgctgatacgtctaggctgtctctctggggaattcaaaggcttattcaaccaggagctgatggcacctttcagggcagatgtatccctgacatgacccagcagggcagctctgaagcatcccacaattctagcgtatcaaacgtgctggctgcctctgccaccaccttgactcatgtaggcagcacccatgaaagggattggtctgcccttcagcagaagtacctccttgaactctcttgtcctgttttggaggccataggagcacccaagccagcttacccctaccttgaggaagactctggttccctggcccaagcttctagcaaaggaggagatactctattgccagttggccctagggtatctagcaatctgaatctcaacaactttccagtccatctgtccagaatcaggcgtttgagggcagagaaagaacaggacagtttaaatgccaaattagaaggtgtttcagatttctttagcactagtgagaaagaggcgagttatgacgaaacttattcggcagacttagaatcattgtctgcttctcgatctacaaatgcacaggtctttgcaacagagaacgcgataccagattccatgacagaagcatgtgaagtcaagcagaacaacttggaagaatgccttcagagttgcaggaaacctggactgatgacttcctctgatgaggattttttccagaagaacgcttgtcacagtaatgtcactacagccaccaaagcagaccattggtcccaaggctgggctcctctcaggaaaaatagtgcagtccagccagggcaattaagtcccgacagccactacccactagaggaagagaagacagattgccaggagagctctaaggaagcagttagaagacacataaatgtttcctttgcccttccttcaggtccagagctataccttcactctgctccctggaatccattgtcatcttccctgcagcccccactcttggaaacattctatgtgaccaaaagcagggatgccctgacagaaactgccttagagattccagcttgcagagaagtaagggtaccctccccaccccccagggaagcctggggctttggtcacaaccaccaagctctccaaggtgcttatttgaagaataatttgccagtgctgttacaaaaccagaattctaagattgcctcatctcagcaggtcacagctgagataccagttgatctgaataccagggaagtcatcagagaatcaggtaaatgccctggaaatattacagaagaaagccatgattcagtttattcttctgttactcagaacagacattttctcccctctaccagcacaaaagtatgtgaatttgaaaaccaagttgtaattttaaataaaaaacacagttttccagcacttgagggaggagaggtcactgctcagtcctgttgcggtgcttcctcagacagcactgagtctgggaagtctctcctctttcgtgaatctgaggcacgagaggaagaagagctggatcagaatacggttctgaggcagaccatcaatgtaagccttgagaaagacatgccaggggaaagtgctgtttctttgaaatccagatcagtagatcgtagagtaagcagcccagtgatggtggcccagggtggtggcccaacccctaagtgggaagggaaaaatgaaactgggcttcttgaaaaaggtcttcgtcccaaagatagctcagaagagtttaagcttccaggtacaaagcctgcatatgaaaggttccagttagttgcatgccctcaggaaagaaaccccagtgaatgcaagtcacaagaaatgttaaatcccaacagagaaccttctggaaagaaacagaataaaagagttaataatactgatgaaatggctaggctaattaggagtgtaatgcagctggaaaatggcatcttagaaattgaatctaagcagaataagcaggttcatgcttcccacacaccaggaaccgataaggagttggtgttccaggaccagaaggagcaggagaagactgaccatgcctttaggccagacagctctggaaaccctttgccctctaaggatcagccatcttctccaagacagacagatgatactgtctttagggatagtgaagctggagcgatggaggttaacagcattgggaaccatccccaggtccagaaaatcaccccaaaccccttcaggtcaagggaaggtgtacgagagagtgaacctgtgagagagcacacccacccagctggatcggacagacctgccagggatatttgtgattctttagggaaacacacaacttgcagagagttcaccaacacttctcttcacccacagagaatgaaagcattggctagagctctgccattgcaacccaggctagagaggtcttctaagaataatggccagtttgtaaaagcatcagcaagtctcaaagggcagccttggggcttaggaagtcttgaggaattggagactgtgaaaggttttcaggaaagccaagtagctgaacacgtaagtagttccaaccaagaagagccaaaagctcaaggtaaagttgaagaaatgcctatgcaaaggggaggcagccttcaggaagaaaataaagtgactcagaaatttcctagtctcagccagctttgtagggacacgtttttcaggcaggaaactgtcagcccattactaagccggacagaattctgtacagctcctcttcaccaagacctgagtaataccttgcccttgaattctccaaggtggccaagaaggtgtcttcatgtacctgttgctctaggcatctcttcacttgactgtgtgctggatctcacaatgttgaaaattcataacagtcccttggtaactggagtagagcatcaggaccagagtacggagaccagaagccacagccccgaaggaaatgttagagggcgttcctctgaggcacacactgcctggtgtgggtctgtgcgatccatggccatgggatctcatagtcaatctggtgtaccagagagcattcctctggggacagaggacaggatctcagcaagcaccagcccccaagaccatggaaaggacctcagaatcaccttgctgggtttcagtaccagtgaagattttgcttctgaagccgaggtggctgtacaaaaagaaataagagtcagttcactgaacaaggtctctagccagcctgaaaagagggtcagcttctccttggaagaggatagtgaccaagccagcaagccaaggcagaaggcagagaaggagactgaggacgtcggactgaccagcggtgtttccttagcacctgtttccctgccgagggtgcccagtccagagcctaggctgttggagccctctgaccatgcatccatgtgcctggccatcttggaggagatcagacaggcaaaggcccagagaaagcagcttcatgactttgtggccaggggcacagtcctttcttactgtgaaactttactagaacccgaatgttcttcaagggttgctggcaggcctcagtgtaaacaaatagaccagtcatcatcagaccagaccaggaatgagggtgaagcaccgggatttcatgtggcatctctatctgctgaagcagggcagatagatctgttacctgatgagaggaaagtccaggccacatctctgtctgcagacagctttgaatctctgcccaatacggaaactgacagagagccatgggatcctgtgcaggctttctcccatgctgctcctgctcaagacaggaaacgtcgtactggagaactgaggcagttcgcgggagcaagtgaaccatttatatgtcactctagttcttctgaaatcatagagaaaaagaaagatgcaaccagaacaccttcctcagctgatcctttggccccagacagtcctcgttcttcagcacctgtggaggaggtcaggagggtagtatcaaagaaggtagtggctgccttaccttctcaggccccttatgatgatcctagagtgactctgcatgagctaagtcagtcagttccgcaggagactgcagagggcataccccctggcagtcaggacagcagcccagagcatcaggaacccagaactctagacaccacatatggagaagtttcagataatttgttagtgactgcacagggagaaaaaacagcccattttgaaagtcagtctgtgacctgtgatgttcagaattctacaagtgcctcagggcctaagcaagaccatgtccaatgccctgaggcttctactggctttgaagaaggtagggcaagtcccaaacaagataccattctgcctggagctctgacaagggttgcactggaagctcccacacagcagtgtgtgcagtgtaaggagagtgttgggtctgggttgacagaagtctgcagggctggcagcaaacattccaggccaattccactgccagatcaaagaccaagcgcaaatcctgggggaattggggaggaagccccatgtagacacccaagggaagctttagatggccctgtcttctcaaggaaccctgaaggcagcaggactctcagcccgtctagagggaaagagagcagaactcttccttgccgacagccatgcagttctcaacctgttgctactcatgcttattcctcccattcctctactttactgtgttttagagatggtgacctagggaaggagcctttcaaggctgccccacatactatccacccaccctgtgtagtaccttccagggcctatgaaatggatgagacaggagagatctctaggggacctgatgtgcacttgacacatggccttgagcccaaagatgttaacagggaatttaggctaacagagagcagcacttgtgagccttctactgtggctgctgtcctatctcgagctcaaggctgcagatccccttctgctcctgacgtgaggacaggttccttcagccactcagctactgatggaagcgtggggttaataggggttcctgagaaaaaggttgctgagaagcaagcaagcacagaacttgaggctgcctctttccctgcaggcatgtactctgagcccctgaggcagtttagggacagctctgtaggtgaccagaatgcacaggtgtgtcaaaccaatccagaaccacctgcaacaactcagggaccacacaccctggatttaagtgaagggtctgctgagagcaagttggtggtagagccacagcatgaatgtttagaaaataccactagatgttttttggaaaagccacaattttccactgagttgagggatcacaatcgcttggattcccaagccaagtttgtagcaaggttaaaacatacctgcagcccccaggaagacagtccctggcaggaagaagagcagcacagagaccaggcttcaggtggtggagaaggcttcgcccagggtgtgaatccccttcctgatgaagatggcttagatggctgtcagattttagatgctgggagagaggaggtggctgtggccaagcctcctgtgtccaagattttatcacagggcttcaaagacccagccactgtgtccttgaggcaaaatgaaacaccgcagcctgctgctcagaggagtggccacctctacactggcagagagcagccagcacccaaccacaggggctcacttcctgtgactacaatcttctctggccccaaacactccaggtcctcccccacaccacagttctcagttgtcggctcttctcgttctcttcaggagctgaacttgagtgtggagcctccttcccctacagacgaagatacacaggggcctaacagattgtggaacccacatctcaggggctattcctcaggaaagtcagtggcaagaacatctctgcaggctgaggacagcaatcagaaagcctcatctcgcttggatgatgggactaccgatcacaggcacctgaagcctgccacccctccttatccaatgccttccactctctcacacatgccaacccctgatttcacgaccagctggatgtctggtactttggaacaagcccaacagggaaagcgagagaaactgggtgtccaggttaggccagaaaattggtgctctcagatggacaaaggaatgctgcactttggctccagtgacatcagtccctatgcgctgccgtggcgtccggaggagcctgcacgtatcagctggaagcagtatatgtctggcagtgcagtcgatgtttcctgcagccagaagccccaggggctgacactatcaaatgtggcccggtgctccagcatggacaatggcctagaagaccagaactcccctttccactcccacctcagcacttacgccaatatttgtgatctgtcaaccacacacagcagcactgagaatgcccagggttcaaatgaggcctgggaagtattccgagggagttcttcaattgccttaggagacccccacatcccgacgagccctgaaggagtagcccccacttcgggtcatgacagaaggcctcagttcaggggcccttctggtgaagcagactgtctgaggagtaagccccccttggccaaaggaagtgctgcaggtccagtggatgagattatgctgctgtatccatcagaggcaggctgccctgtgggacagaccaggacgaacacattcgaacagggcacacagaccctcggcagcaggcgccactggagcagcactgacatctcctttgctcagcctgaagccagtgcagtatcagcctttgatctggcctcatggaccagcatgcacaatctgtctctccacctctcacagctcctgcacagtacctcagagctgcttgggagtctctcccagccagatgtggccagaagggagcagaacaccaagagggacatcccagataaagccccacaggccctgatgatggatggctctactcagaccactgtggatgagggcagccagactgacctcaccttacccaccctgtgcctccagacttcagaggctgaacctcagggagccaatgtgatccttgaagggctaggctcagatacctcgactgtgtctcaagaagagggagatgtgccaggggtacctcagaagagagaggcagaggaaacagcacagaaaatggctcagctcctctatcttcaggaagaaagcactccctacaagccccagagcccttcaataccctcatcccacttgaggtttcagaaagcccccgttgggcagcatcttccttctgtgagcccctcagtttctgatgctttcctgcctcccagctcccagccagaggagtcatattgcttagttgtcagcagtcccagtcccagctcccctcattccccagggctctttcccagtacttccgagtatcctggggactccagggtccagaagaagctgggccccacaagtgctttgttcgtggacagggcctcctccccaatcctcactcttagtgccagcacccaagagccgggtctttccccaggctctttgaccctctcagccccttcaactcaccctgttgaaggccaccagaagcttgactccagcccagaccctgttgatgccccaaggactccaatggataattattcccaaaccactgacgagttaggtggctcccagagaggtagaagttccttacaaaggagtaatgggagatccttccttgagttgcactccccacacagcccacagcagagtccaaaactccaatttagtttcttagggcagcaccctcagcagcttcagcccaggacaactatcggggtccaaagcagactgctgccaccaccactgaggcacaggagccaaaggctgggcaacagctttgtgcctgagaaggtggcttccccggagcattgcccactgagcggtagggagccaagtcagtggcagagcaggacagaaaatggaggtgagagttcagcatctccaggggaaccacaacgcactctggaccgaccttcttcatggggaggcctccagcacctcagcccctgccctgtctctgagttgactgatactgcagggctccgaggttctgccttgggcctccctcaggcctgccaacctgaggagttactgtgcttcagttgccagatgtgcatggcccctgagcaccagcaccacagtctgagggacctcccggtgcataacaaatttagtaactggtgtggggttcagaagggctcacctggggggttggacatgactgaggaggagctgggggccagcggtgatctcagctctgaaaagcaggaacagagtcccccacaacctcctaatgaccacagccaggattctgagtggtccaagagggagcagatccccctgcaagttggggcccagaacctctcactcagcgtggaactcacagaagcgaaactgcaccatggctttggggaggccgatgccctgctccaggtgctgcagagtgggacaggggaggcgcttgctgctgatgaacctgtgacatccacctggaaggagctctatgcacggcaaaaaaaggccattgagaccctcaggagagagcgggctgagcgacttgggaacttctgccggacgcgaagccttagccctcagaaacaactgagcctcctgcccaacaaagatctcttcatctgggatcttgacttgcccagcagacgccgagaatacctgcagcaactgaggaaggatgttgtggagaccaccaggagcccagagtcagtgtcaaggtcagctcacacaccctctgacatagagttgatgctgcaagactaccagcaggcccatgaggaggccaaggtggagattgcccgggcccgagaccaactgcgggagcggactgaacaagagaagctgagaatccaccagaagatcatttcccagctattgaaggaagaggataaactacataccttggccaattccagctccctgtgcaccagctctaatggaagcctctcgtctggcatgacctctggctataatagcagcccagccttgtcaggccagctccagttcccagagaatatggggcatacaaacttgcctgattccagggatgtatggataggggatgagcgaggaggccattctgcagtgaggaagaactctgcctacagccacagagcctccctgggcagttgctgctgttcaccatccagtctgtccagcttggggacctgcttttcctcctcctaccaggatttggccaagcatgtcgtggacacttctatggctgatgtaatggctgcttgttcggataatttgcacaacctcttcagctgccaggcaactgctggctggaactatcagggtgaggagcaggcggtgcagctttactacaaggtgttttctcccactcggcatggcttcctgggggcaggtgtggtgtcccagccgctgtctcgtgtgtgggcggctgtcagtgaccccactgtgtggcccctgtattacaagcccatccagacagcaaggctgcatcagcgagtgaccaacagcatcagcctggtgtacttggtgtgcaacaccaccctgtgcgcactgaagcagccacgggatttctgttgtgtctgcgtggaagccaaagagggtcacctgtctgtcatggcagcccagtctgtgtatgatacatccatgccaagacccagcagaaaaatggttcgcggggagatcctgcccagtgcctggatcttgcagcccatcactgtggaagggaaggaagtcaccagagtcatctacttggcccaggtggaacttggtgctccaggcttcccacctcagctcctgagctctttcatcaaacggcagccactggttatagccagactggcttccttccttggtaggtagcatctcaccgtcaagatggtgctgctgagatgcaggcccaggctgctcaagagagacactgtggcagctccttgttactttccataccacagtgcaggaaaagctgatgctacctgctgtggccgattggggcagacagcactggcccagggatgctagcaaagcccagtcagtacttggtcacagctggcaccagtgcagagcaaacggcctgagctcctggcccagactatccagagtgaatgcagctccgctcaccttttggatttctcacctttctttcctgtttctgggactctgcggcagacaggacacttaaggaccaggactgggcacagccagcagagccggggactgcagtgctttggcaaggtgcttccgcaggctggtagggaagcaggcagccactggccaagactctgttctgaatctacctcctctagcattcagctctactgtgtgatgggacgttaaaaataccaaaacagaaagagggtttaaaaaacagctgcacaaaccagaacaccgattcagaatcttttctccctcttgagtttttgcaaaatactttattattgatttttgctttttttctccctttccctcccaggagaagacatttgggtcttggcctgaggcaggggtgttgagcgatgatgctctgatatggagctgtcactctagagctcggtcagatggaagacactatagaaccaggttggacagatttggggtcagggttggaggctgagttcttttgaggactggttggagtggcagccagatggtggctgctgacaaggcaagaggaatttcagagattaaacattgtcctttgaggaagggagaggaggtgaatgaactcccagaggaggtgagtggcttgttgggaggaagctcagttccagaacttacctcagtgcacttgggaggggtggagtcctgagcattccatgatttctgccctggccccacctatcctaggatggggtgggatggagagtgggttcagttttcttgtactttagcctggctgaacatgaactttgtgtttacctggaagtggtaggggtgggagagattctcatctttagttctggtgcccaaaatctttggtagatggagggaactggggattcagaagatgtggtaaaggtctatttctgtagtgtggcagagatgtgtttttctaaagtgtttgcagggcatttttccctcttacctcagattaagttatttatatattgttgattgaaggttttttaaaattgcttttaaacttctatttctcgggtaaattttttggtgacatgatatatttaacaccctatttatatactcctacctcttttcatataaatctcttactaagactactgaccaaaaaagaacattttaaaattaaaa

SEQ ID NO: 186680 - DNA, 666 bp, Homo sapiens
  Payload ID: 16760
  Gene Symbol: STARD9
  Gene Name: StAR-related lipid transfer (START) domain containing 9
  ENST ID: ENST00000569419
  CDS Start-End: 1-666
gatgaaaacctgaaggagctggttctccaaaatgaattgaagatagaccagctgactaaagactggacccagaagtggaatgattggcaggccctcatggagcattacagtgtggacatcaacaggaggagggctggggtggtcatcgactccagcctgccacacttgatggccttggaggatgatgtgctcagcacaggtgttgtgctctatcatctcaagaatctggtgtctgttaaacttcatctgcggaccaagaaggaagggacaacaaaaataggaaggattgactcagaccaggaacaggacattggagctgtcataaccctggggaaggcacagaagttccgattcaaccacccagcagaggctgctgtcctgcggcagcgaaggcaggttggagaggctgctgctggtcgtggctcgttggagtggctggatttggatggagatctcgctgcctcccggctgggtctctcccctttgctttggaaggaaaggagagcgcttgaagagcaatgtgacgaggaccatcagacaccgagggatggagagacatcccacagggcccagattcagcagcagcagagctacgtagaggatttgaggcatcaaatcctagcagaagagattcgagctgcgaaggaactggaatttgaccaagct

SEQ ID NO: 186681 - DNA, 7237 bp, Homo sapiens
  Payload ID: 16760
  Gene Symbol: STARD9
  Gene Name: StAR-related lipid transfer (START) domain containing 9
  ENST ID: ENST00000562619
  CDS Start-End: 1-4761
caagacaggaaacgtcgtactggagaactgaggcagttcgcgggagcaagtgaaccatttatatgtcactctagttcttctgaaatcatagagaaaaagaaagatgcaaccagaacaccttcctcagctgatcctttggccccagacagtcctcgttcttcagcacctgtggaggaggtcaggagggtagtatcaaagaaggtagtggctgccttaccttctcaggccccttatgatgatcctagagtgactctgcatgagctaagtcagtcagttccgcaggagactgcagagggcataccccctggcagtcaggacagcagcccagagcatcaggaacccagaactctagacaccacatatggagaagtttcagataatttgttagtgactgcacagggagaaaaaacagcccattttgaaagtcagtctgtgacctgtgatgttcagaattctacaagtgcctcagggcctaagcaagaccatgtccaatgccctgaggcttctactggctttgaagaaggtagggcaagtcccaaacaagataccattctgcctggagctctgacaagggttgcactggaagctcccacacagcagtgtgtgcagtgtaaggagagtgttgggtctgggttgacagaagtctgcagggctggcagcaaacattccaggccaattccactgccagatcaaagaccaagcgcaaatcctgggggaattggggaggaagccccatgtagacacccaagggaagctttagatggccctgtcttctcaaggaaccctgaaggcagcaggactctcagcccgtctagagggaaagagagcagaactcttccttgccgacagccatgcagttctcaacctgttgctactcatgcttattcctcccattcctctactttactgtgttttagagatggtgacctagggaaggagcctttcaaggctgccccacatactatccacccaccctgtgtagtaccttccagggcctatgaaatggatgagacaggagagatctctaggggacctgatgtgcacttgacacatggccttgagcccaaagatgttaacagggaatttaggctaacagagagcagcacttgtgagccttctactgtggctgctgtcctatctcgagctcaaggctgcagatccccttctgctcctgacgtgaggacaggttccttcagccactcagctactgatggaagcgtggggttaataggggttcctgagaaaaaggttgctgagaagcaagcaagcacagaacttgaggctgcctctttccctgcaggcatgtactctgagcccctgaggcagtttagggacagctctgtaggtgaccagaatgcacaggtgtgtcaaaccaatccagaaccacctgcaacaactcagggaccacacaccctggatttaagtgaagggtctgctgagagcaagttggtggtagagccacagcatgaatgtttagaaaataccactagatgttttttggaaaagccacaattttccactgagttgagggatcacaatcgcttggattcccaagccaagtttgtagcaaggttaaaacatacctgcagcccccaggaagacagtccctggcaggaagaagagcagcacagagaccaggcttcaggtggtggagaaggcttcgcccagggtgtgaatccccttcctgatgaagatggcttagatggctgtcagattttagatgctgggagagaggaggtggctgtggccaagcctcctgtgtccaagattttatcacagggcttcaaagacccagccactgtgtccttgaggcaaaatgaaacaccgcagcctgctgctcagaggagtggccacctctacactggcagagagcagccagcacccaaccacaggggctcacttcctgtgactacaatcttctctggccccaaacactccaggtcctcccccacaccacagttctcagttgtcggctcttctcgttctcttcaggagctgaacttgagtgtggagcctccttcccctacagacgaagatacacaggggcctaacagattgtggaacccacatctcaggggctattcctcaggaaagtcagtggcaagaacatctctgcaggctgaggacagcaatcagaaagcctcatctcgcttggatgatgggactaccgatcacaggcacctgaagcctgccacccctccttatccaatgccttccactctctcacacatgccaacccctgatttcacgaccagctggatgtctggtactttggaacaagcccaacagggaaagcgagagaaactgggtgtccaggttaggccagaaaattggtgctctcagatggacaaaggaatgctgcactttggctccagtgacatcagtccctatgcgctgccgtggcgtccggaggagcctgcacgtatcagctggaagcagtatatgtctggcagtgcagtcgatgtttcctgcagccagaagccccaggggctgacactatcaaatgtggcccggtgctccagcatggacaatggcctagaagaccagaactcccctttccactcccacctcagcacttacgccaatatttgtgatctgtcaaccacacacagcagcactgagaatgcccagggttcaaatgaggcctgggaagtattccgagggagttcttcaattgccttaggagacccccacatcccgacgagccctgaaggagtagcccccacttcgggtcatgacagaaggcctcagttcaggggcccttctggtgaagcagactgtctgaggagtaagccccccttggccaaaggaagtgctgcaggtccagtggatgagattatgctgctgtatccatcagaggcaggctgccctgtgggacagaccaggacgaacacattcgaacagggcacacagaccctcggcagcaggcgccactggagcagcactgacatctcctttgctcagcctgaagccagtgcagtatcagcctttgatctggcctcatggaccagcatgcacaatctgtctctccacctctcacagctcctgcacagtacctcagagctgcttgggagtctctcccagccagatgtggccagaagggagcagaacaccaagagggacatcccagataaagccccacaggccctgatgatggatggctctactcagaccactgtggatgagggcagccagactgacctcaccttacccaccctgtgcctccagacttcagaggctgaacctcagggagccaatgtgatccttgaagggctaggctcagatacctcgactgtgtctcaagaagagggagatgtgccaggggtacctcagaagagagaggcagaggaaacagcacagaaaatggctcagctcctctatcttcaggaagaaagcactccctacaagccccagagcccttcaataccctcatcccacttgaggtttcagaaagcccccgttgggcagcatcttccttctgtgagcccctcagtttctgatgctttcctgcctcccagctcccagccagaggagtcatattgcttagttgtcagcagtcccagtcccagctcccctcattccccagggctctttcccagtacttccgagtatcctggggactccagggtccagaagaagctgggccccacaagtgctttgttcgtggacagggcctcctccccaatcctcactcttagtgccagcacccaagagccgggtctttccccaggctctttgaccctctcagccccttcaactcaccctgttgaaggccaccagaagcttgactccagcccagaccctgttgatgccccaaggactccaatggataattattcccaaaccactgacgagttaggtggctcccagagaggtagaagttccttacaaaggagtaatgggagatccttccttgagttgcactccccacacagcccacagcagagtccaaaactccaatttagtttcttagggcagcaccctcagcagcttcagcccaggacaactatcggggtccaaagcagactgctgccaccaccactgaggcacaggagccaaaggctgggcaacagctttgtgcctgagaaggtggcttccccggagcattgcccactgagcggtagggagccaagtcagtggcagagcaggacagaaaatggaggtgagagttcagcatctccaggggaaccacaacgcactctggaccgaccttcttcatggggaggcctccagcacctcagcccctgccctgtctctgagttgactgatactgcagggctccgaggttctgccttgggcctccctcaggcctgccaacctgaggagttactgtgcttcagttgccagatgtgcatggcccctgagcaccagcaccacagtctgagggacctcccggtgcataacaaatttagtaactggtgtggggttcagaagggctcacctggggggttggacatgactgaggaggagctgggggccagcggtgatctcagctctgaaaagcaggaacagagtcccccacaacctcctaatgaccacagccaggattctgagtggtccaagagggagcagatccccctgcaagttggggcccagaacctctcactcagcgtggaactcacagaagcgaaactgcaccatggctttggggaggccgatgccctgctccaggtgctgcagagtgggacaggggaggcgcttgctgctgatgaacctgtgacatccacctggaaggagctctatgcacggggtcagagatagatcttaaagtgaaggacattcagggccagcttcagcgaatcgtgttttgcctcaggcaaaaaaaggccattgagaccctcaggagagagcgggctgagcgacttgggaacttctgccggacgcgaagccttagccctcagaaacaactgagcctcctgcccaacaaagatctcttcatctgggatcttgacttgcccagcagacgccgagaatacctgcagcaactgaggaaggatgttgtggagaccaccaggagcccagagtcagtgtcaaggtcagctcacacaccctctgacatagagttgatgctgcaagactaccagcaggcccatgaggaggccaaggtggagattgcccgggcccgagaccaactgcgggagcggactgaacaagagaagctgagaatccaccagaagatcatttcccagctattgaaggaagaggataaactacataccttggccaattccagctccctgtgcaccagctctaatggaagcctctcgtctggcatgacctctggctataatagcagcccagccttgtcaggccagctccagttcccagagaatatggggcatacaaacttgcctgattccagggatgtatggataggggatgagcgaggaggccattctgcagtgaggaagaactctgcctacagccacagagcctccctgggcagttgctgctgttcaccatccagtctgtccagcttggggacctgcttttcctcctcctaccaggatttggccaagcatgtcgtggacacttctatggctgatgtaatggctgcttgttcggataatttgcacaacctcttcagctgccaggcaactgctggctggaatgtacttggtgtgcaacaccaccctgtgcgcactgaagcagccacgggatttctgttgtgtctgcgtggaagccaaagagggtcacctgtctgtcatggcagcccagtctgtgtatgatacatccatgccaagacccagcagaaaaatggttcgcggggagatcctgcccagtgcctggatcttgcagcccatcactgtggaagggaaggaagtcaccagagtcatctacttggcccaggtggaacttggtgctccaggcttcccacctcagctcctgagctctttcatcaaacggcagccactggttatagccagactggcttccttccttggtaggtagcatctcaccgtcaagatggtgctgctgagatgcaggcccaggctgctcaagagagacactgtggcagctccttgttactttccataccacagtgcaggaaaagctgatgctacctgctgtggccgattggggcagacagcactggcccagggatgctagcaaagcccagtcagtacttggtcacagctggcaccagtgcagagcaaacggcctgagctcctggcccagactatccagagtgaatgcagctccgctcaccttttggatttctcacctttctttcctgtttctgggactctgcggcagacaggacacttaaggaccaggactgggcacagccagcagagccggggactgcagtgctttggcaaggtgcttccgcaggctggtagggaagcaggcagccactggccaagactctgttctgaatctacctcctctagcattcagctctactgtgtgatgggacgttaaaaataccaaaacagaaagagggtttaaaaaacagctgcacaaaccagaacaccgattcagaatcttttctccctcttgagtttttgcaaaatactttattattgatttttgctttttttctccctttccctcccaggagaagacatttgggtcttggcctgaggcaggggtgttgagcgatgatgctctgatatggagctgtcactctagagctcggtcagatggaagacactatagaaccaggttggacagatttggggtcagggttggaggctgagttcttttgaggactggttggagtggcagccagatggtggctgctgacaaggcaagaggaatttcagagattaaacattgtcctttgaggaagggagaggaggtgaatgaactcccagaggaggtgagtggcttgttgggaggaagctcagttccagaacttacctcagtgcacttgggaggggtggagtcctgagcattccatgatttctgccctggccccacctatcctaggatggggtgggatggagagtgggttcagttttcttgtactttagcctggctgaacatgaactttgtgtttacctggaagtggtaggggtgggagagattctcatctttagttctggtgcccaaaatctttggtagatggagggaactggggattcagaagatgtggtaaaggtctatttctgtagtgtggcagagatgtgtttttctaaagtgtttgcagggcatttttccctcttacctcagattaagttatttatatattgttgattgaaggttttttaaaattgcttttaaacttcta

SEQ ID NO: 186682 - DNA, 598 bp, Homo sapiens
  Payload ID: 16761
  Gene Symbol: STATH
  Gene Name: statherin
  Uniprot ID: P02808
  ENST ID: ENST00000246895
  CDS Start-End: 112-300
agagtgtttaaatacattggccctctagggtagcacatcatctcttgaagcttcacttcaacttcactacttctgtagtctcatcttgagtaaaagagaacccagccaactatgaagttccttgtctttgccttcatcttggctctcatggtttccatgattggagctgattcatctgaagagaaatttttgcgtagaattggaagattcggttatgggtatggcccttatcagccagttccagaacaaccactatacccacaaccataccaaccacaataccaacaatataccttttaatatcatcagtaactgcaggacatgattattgaggcttgattggcaaatacgacttctacatccatattctcatctttcataccatatcacactactaccactttttgaagaatcatcaaagagcaatgcaaatgaaaaacactataatttactgtatactctttgtttcaggatacttgccttttcaattgtcacttgatgatataattgcaatttaaactgttaagctgtgttcagtactgtttctgaataatagaaatcacttctctaaaagcaataaatttcaagcacattttta

SEQ ID NO: 186683 - DNA, 534 bp, Homo sapiens
  Payload ID: 16761
  Gene Symbol: STATH
  Gene Name: statherin
  Uniprot ID: P02808
  ENST ID: ENST00000381060
  CDS Start-End: 76-234
atcatctcttgaagcttcacttcaacttcactacttctgtagtctcatcttgagtaaaagagaacccagccaactatgaagttccttgtctttgccttcatcttggctctcatggtttccatgattggagctgattcatctgaagagtatgggtatggcccttatcagccagttccagaacaaccactatacccacaaccataccaaccacaataccaacaatataccttttaatatcatcagtaactgcaggacatgattattgaggcttgattggcaaatacgacttctacatccatattctcatctttcataccatatcacactactaccactttttgaagaatcatcaaagagcaatgcaaatgaaaaacactataatttactgtatactctttgtttcaggatacttgccttttcaattgtcacttgatgatataattgcaatttaaactgttaagctgtgttcagtactgtttctgaataatagaaatcacttctctaaaagcaataaatttcaagcacatttttaca

SEQ ID NO: 186684 - DNA, 598 bp, Homo sapiens
  Payload ID: 16761
  Gene Symbol: STATH
  Gene Name: statherin
  Uniprot ID: P02808
  ENST ID: ENST00000615994
  CDS Start-End: 111-299
gagtgtttaaatacattggccctctagggtagcacatcatctcttgaagcttcacttcaacttcactacttctgtagtctcatcttgagtaaaagagaacccagccaactatgaagttccttgtctttgccttcatcttggctctcatggtttccatgattggagctgattcatctgaagagaaatttttgcgtagaattggaagattcggttatgggtatggcccttatcagccagttccagaacaaccactatacccacaaccataccaaccacaataccaacaatataccttttaatatcatcagtaactgcaggacatgattattgaggcttgattggcaaatacgacttctacatccatattctcatctttcataccatatcacactactaccactttttgaagaatcatcaaagagcaatgcaaatgaaaaacactataatttactgtatactctttgtttcaggatacttgccttttcaattgtcacttgatgatataattgcaatttaaactgttaagctgtgttcagtactgtttctgaataatagaaatcacttctctaaaagcaataaatttcaagcacatttttac

SEQ ID NO: 186685 - DNA, 534 bp, Homo sapiens; identical to SEQ ID NO: 186683
  Payload ID: 16761
  Gene Symbol: STATH
  Gene Name: statherin
  ENST ID: ENST00000634727
  CDS Start-End: 76-234

SEQ ID NO: 186686 - DNA, 598 bp, Homo sapiens; identical to SEQ ID NO: 186682
  Payload ID: 16761
  Gene Symbol: STATH
  Gene Name: statherin
  ENST ID: ENST00000635686
  CDS Start-End: 112-300

SEQ ID NO: 186687 - DNA, 598 bp, Homo sapiens; identical to SEQ ID NO: 186684
  Payload ID: 16761
  Gene Symbol: STATH
  Gene Name: statherin
  ENST ID: ENST00000635437
  CDS Start-End: 111-299

SEQ ID NO: 186688 - DNA, 1137 bp, Homo sapiens
  Payload ID: 16762
  Gene Symbol: STMN1
  Gene Name: stathmin 1
  Uniprot ID: P16949
  ENST ID: ENST00000357865
  CDS Start-End: 267-716
cgccggtgtcggtgtagggtgccgggggcagggggccctgcaggggcgtggagtggcattgtgctgtcacaggggctcgggcgtcttaggcacccatgtgggtggcgcactagaaggggcactgctctgtccgagtgctgcccttggggcgaggcgggcatgtggctctacaaggtggagtccaggcggccaaagtttggaaaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaa

SEQ ID NO: 186689 - DNA, 867 bp, Homo sapiens
  Payload ID: 16762
  Gene Symbol: STMN1
  Gene Name: stathmin 1
  Uniprot ID: P16949
  ENST ID: ENST00000374291
  CDS Start-End: 143-592
gcacaatgagttgtaggcagtattaagatggctccgggggcactgttgagttgaatctggaatatcttcttacagtttcggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggt

SEQ ID NO: 186690 - DNA, 1712 bp, Homo sapiens
  Payload ID: 16762
  Gene Symbol: STMN1
  Gene Name: stathmin 1
  Uniprot ID: P16949
  ENST ID: ENST00000399728
  CDS Start-End: 365-814
atcaccgggcgtccgctccggggtgccgtcgaggagacaatagggggcgtgggccctcgtttacctccctccctccctcccttccctgcgggccccgccgggttccccattgtctgaagggacggggcggtgccccagggaccagcggctttaggaccaaactgcgggcagccagggccgcgaccctccctgcgaccgtcccctggcgaccgcagctggtgattgaggggcggcgctcccgggccccacgagggttcttctgtcttcgcggccggacgcgcggacagcgtgggtggcggcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttggtggcagtgacttcttttgagttaggttaataaatcaagccatagagcccctcctggttgatacttgttccagatggggcctttggggctggtagaaatacccaacgcacaaatgaccgcacgttctctgccccgtttcttgccccagtgtggtttgcattgtctccttccacaatgactgctttgtttggatgcctcagcccaggtcagctgttactttctttcagatgtttatttgcaaacaaccattttttgttctgtgtcccttttaaaaggcagattaaaagcacaagcgtgtttctagagaacagttgagagagaatctcaagattctacttggtggtttgcttgctctacgttacaggtggggcatgtcctcatcctttcctgccataaaagctatgacacgagaatcagaatattaataaaactttatgtactgctgtagc

SEQ ID NO: 186691 - DNA, 1504 bp, Homo sapiens
  Payload ID: 16762
  Gene Symbol: STMN1
  Gene Name: stathmin 1
  Uniprot ID: P16949
  ENST ID: ENST00000455785
  CDS Start-End: 141-590
gtgcctctgtttggcgcttttgtgcgcgcccgggtctgttggtgctcagagtgtggtcaggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttggtggcagtgacttcttttgagttaggttaataaatcaagccatagagcccctcctggttgatacttgttccagatggggcctttggggctggtagaaatacccaacgcacaaatgaccgcacgttctctgccccgtttcttgccccagtgtggtttgcattgtctccttccacaatgactgctttgtttggatgcctcagcccaggtcagctgttactttctttcagatgtttatttgcaaacaaccattttttgttctgtgtcccttttaaaaggcagattaaaagcacaagcgtgtttctagagaacagttgagagagaatctcaagattctacttggtggtttgcttgctctacgttacaggtggggcatgtcctcatcctttcctgccataaaagctatgacacgagaatcagaatattaataaaactttatgtactgctgtagcaactcctgtgaaatga

SEQ ID NO: 186692 - DNA, 665 bp, Homo sapiens
  Payload ID: 16762
  Gene Symbol: STMN1
  Gene Name: stathmin 1
  ENST ID: ENST00000446334
  CDS Start-End: 409-665
ggccacgcccatcctgggtccggtgctgcgtctaattctctgcttttcttaaatcttgtcgctgcctctgattttaattcctagcttttgggaacctgtcatcctacgtttttggtactagctggcgtctacaaaagtcataatgttaaaaagatcaacaagagatacagcatttttcatgacataacggcagcaaatataagtcaaaatctagaggttcataaacattttgcttgctgttgggcaaggaagcttaaacctgagggacaataggagttcaacattattggttactattagcttgggcgttttcttatccaccacgtcagacacagacaaagcaggggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggc

SEQ ID NO: 186693 - DNA, 948 bp, Homo sapiens
  Payload ID: 16762
  Gene Symbol: STMN1
  Gene Name: stathmin 1
  Uniprot ID: P16949
  ENST ID: ENST00000426559
  CDS Start-End: 141-665
gtgcctctgtttggcgcttttgtgcgcgcccgggtctgttggtgctcagagtgtggtcaggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaagatgtacttctggactcacgggcctggggcccacccagcacagatctctgctgagcaatcttgtctccactctgttcctgccctttgcccagccctgggcctccaatctgcattgattacctggtctgatctctctcaccatcactaggtacttaataaatatttgctgttgatgatagcaatgaccttgagactgatgaacagtctggccaagaggatccttgatgtggaagatagaaaaagcctttggggtcaggcagacttggattctaataccagccagttctgcttgctgtgtctgagcctcagtttactcatctgtgaagaggaggtagcaagaatgaaaatgcctgccttgtggtttgttgtaaggacagacactgccaacgtagagggcccagcagctcacagaccagttgctctgagagcag

SEQ ID NO: 186694 - DNA, 2223 bp, Homo sapiens
  Payload ID: 16763
  Gene Symbol: STMN2
  Gene Name: stathmin 2
  Uniprot ID: Q93045
  ENST ID: ENST00000220876
  CDS Start-End: 383-922
agctcctaggaagcttcagggcttaaagctccactctacttggactgtactatcaggcccccaaaatggggggagccgacagggaaggactgatttccatttcaaactgcattctggtactttgtactccagcaccattggccgatcaatatttaatgcttggagattctgactctgcgggagtcatgtcaggggaccttgggagccaatctgcttgagcttctgagtgataattattcatgggctcctgcctcttgctctttctctagcacggtcccactctgcagactcagtgccttattcagtcttctctctcgctctctccgctgctgtagccggaccctttgccttcgccactgctcagcgtctgcacatccctacaatggctaaaacagcaatggcctacaaggaaaaaatgaaggagctgtccatgctgtcactgatctgctcttgcttttacccggaacctcgcaacatcaacatctatacttacgatgatatggaagtgaagcaaatcaacaaacgtgcctctggccaggcttttgagctgatcttgaagccaccatctcctatctcagaagccccacgaactttagcttctccaaagaagaaagacctgtccctggaggagatccagaagaaactggaggctgcagaggaaagaagaaagtctcaggaggcccaggtgctgaaacaattggcagagaagagggaacacgagcgagaagtccttcagaaggctttggaggagaacaacaacttcagcaagatggcggaggaaaagctgatcctgaaaatggaacaaattaaggaaaaccgtgaggctaatctagctgctattattgaacgtctgcaggaaaaggagaggcatgctgcggaggtgcgcaggaacaaggaactccaggttgaactgtctggctgaagcaagggagggtctggcacgccccaccaatagtaaatccccctgcctatattataatggatcatgcgatatcaggatggggaatgtatgacatggtttaaaaagaactcattataaaaaaaaaaaaacaaaaaaaatcaaaaattaaaaaaaatcaatgcggtctctttgcagaatgttttgcttgatgtttaaaaaataccttggatcttattttgtaaatacttacatttttgttaaaaaatacaagtattgcattatgcaagttatttcataatcttacatgtcctgtaacaggcttttgatgttgtgtctttccactcaaatgaatttgctaggtctgttctttttgaagctccccatgtctaactccattccaaaagaaaaatgaggtcagtagacagtctatggtgctagaaacccaccattgcctaatgacctagaaggctttgttgtctctgagcttgactaagaccatacctagatcacaggtattatgactccacatgaaccttcacatttgttcgctcataatctacttactgcctaaaaactacaaaaccaggctaagaaataccaccagtcatagcatttacttctgcttctcctggattatgtgctacaaatgtgctttggctttagaaagggatggatgagaagacagacctgagaccaatctgggtagaagcaaaaagttgaaccttttaaagtgctgaacacaaatccaaattcgaatggttcaagcagccgtgaaatcgctcttcataaagtgggcttaattctctagtttaagttcttttgatggaatgaattaattaatgtgtcaggtggcttatttgtggatgccatgattgatgatgttcattttaagctcttacctatagtacaagtacatgatgctactgaatatttttccacttggaaactgtgagctggttgttgcattaaaacacacatacaaacaaaatcaaaaacactgcggactttcactcaagctggtctttcttccccagtgtaaggcaatcctgcctactaacaacaccaacaacaaaacactccatctgtgaagctgacgcagttaagggggctaggcagggcatttgtgccaactaagaatcaccagatacccaccataagtacctatcgcagttttgaagtcgtttctccccaactcccaactcctgaaggttgctgcctgcatatttactcttcattagtgctattttcctgtatgtcattgtgagcaagctgtgattaataaagaattggagttctgtgaactaataaaggtttggtctgtt

SEQ ID NO: 186695 - DNA, 799 bp, Homo sapiens
  Payload ID: 16763
  Gene Symbol: STMN2
  Gene Name: stathmin 2
  Uniprot ID: Q93045
  ENST ID: ENST00000518111
  CDS Start-End: 45-608
gaccctttgccttcgccactgctcagcgtctgcacatccctacaatggctaaaacagcaatggcctacaaggaaaaaatgaaggagctgtccatgctgtcactgatctgctcttgcttttacccggaacctcgcaacatcaacatctatacttacgatgatatggaagtgaagcaaatcaacaaacgtgcctctggccaggcttttgagctgatcttgaagccaccatctcctatctcagaagccccacgaactttagcttctccaaagaagaaagacctgtccctggaggagatccagaagaaactggaggctgcagaggaaagaagaaagtctcaggaggcccaggtgctgaaacaattggcagagaagagggaacacgagcgagaagtccttcagaaggctttggaggagaacaacaacttcagcaagatggcggaggaaaagctgatcctgaaaatggaacaaattaaggaaaaccgtgaggctaatctagctgctattattgaacgtctgcaggaaaagctggtcaagtttatttcttctgaactaaaagaatctatagagtctcaatttctggagcttcagagggaaggagagaagcaatgagaggcatgctgcggaggtgcgcaggaacaaggaactccaggttgaactgtctggctgaagcaagggagggtctggcacgccccaccaatagtaaatccccctgcctatattataatggatcatgcgatatcaggatggggaatgtatgacatggtttaaaaagaactcattataaaaaaaaaaaaacaaaa

SEQ ID NO: 186696 - DNA, 585 bp, Homo sapiens
  Payload ID: 16763
  Gene Symbol: STMN2
  Gene Name: stathmin 2
  ENST ID: ENST00000518491
  CDS Start-End: 72-578
attttacggtattgtctcgtcgaagaaaccgctagtcctggggtgcggtgcagggagcctacaaggaaaaaatgaaggagctgtccatgctgtcactgatctgctcttgcttttacccggaacctcgcaacatcaacatctatacttacgatgatatggaagtgaagcaaatcaacaaacgtgcctctggccaggcttttgagctgatcttgaagccaccatctcctatctcagaagccccacgaactttagcttctccaaagaagaaagacctgtccctggaggagatccagaagaaactggaggctgcagaggaaagaagaaagtctcaggaggcccaggtgctgaaacaattggcagagaagagggaacacgagcgagaagtccttcagaaggctttggaggagaacaacaacttcagcaagatggcggaggaaaagctgatcctgaaaatggaacaaattaaggaaaaccgtgaggctaatctagctgctattattgaacgtctgcaggaaaaggagaggcatgctgcggaggtgcgcaggaacaaggaactccaggttgaactgtctggctgaagcaagg

SEQ ID NO: 186697 - DNA, 930 bp, Homo sapiens
  Payload ID: 16764
  Gene Symbol: STMND1
  Gene Name: stathmin domain containing 1
  ENST ID: ENST00000354384
  CDS Start-End: 330-930
cgcggtggcgcacgtctgtaatcccaacactttgggaggccgaggtgggcagatcacgaggtcaagaattcgagaccagcctggccaacatggtgaaaccccgtctctactaaaaatacaaaaattagccgggcgtggtggtgcgctcctgtaacctcagctactcagaaggctgaggcaggagaatcacttgaacccgagaggcagaggttgcagtgagccgagatcgcaccactgcactcaagcctgggtgacagagcaagactctgtctcaaaaaaataaaaaatagacattaaaagaatcctgggaagacattaccgagtggaagatgcacgtgttctttgtgttcttatctcttctggagacactgaggagacttcctgtggctgatgtcagtgtgcctcatactggggaaaattgcagcccccggatggaagctgctctgaccaagaatactgtggacattgcagaaggcctggaacaagtccagatgggaagcttacctggaaccatttcagaaaattctccatctcctagtgaaagaaacagacgagtaaattcagacctagtgaccaatggattaatcaataaaccccaatccctagagagtcgagagcgacagaagtcatcagatatcctggaggaactaattgttcaaggaattatacaaagccacagcaaagtatttagaaatggagaatcatatgatgtcacgttgactacgactgagaagccattgagaaagccaccttccagactgaaaaaactcaagatcaaaaagcaagtgaaggatttcacaatgaaggacatcgaggagaagatggaggctgccgaggagcgcaggaagactaaagaagaagaaataagaaaaaggctacggagtgaccgacttttgccttcagccaatcactcagattcagctgaattag

SEQ ID NO: 186698 - DNA, 1322 bp, Homo sapiens
  Payload ID: 16764
  Gene Symbol: STMND1
  Gene Name: stathmin domain containing 1
  Uniprot ID: H3BQB6
  ENST ID: ENST00000536551
  CDS Start-End: 1-831
atgggctgtggaccttcccaacctgctgaagaccggagacgtgtacgcgcgcccaagaagggctggaaagaggaattcaaggctgatgtcagtgtgcctcatactggggaaaattgcagcccccggatggaagctgctctgaccaagaatactgtggacattgcagaaggcctggaacaagtccagatgggaagcttacctggaaccatttcagaaaattctccatctcctagtgaaagaaacagacgagtaaattcagacctagtgaccaatggattaatcaataaaccccaatccctagagagtcgagagcgacagaagtcatcagatatcctggaggaactaattgttcaaggaattatacaaagccacagcaaagtatttagaaatggagaatcatatgatgtcacgttgactacgactgagaagccattgagaaagccaccttccagactgaaaaaactcaagatcaaaaagcaagtgaaggatttcacaatgaaggacatcgaggagaagatggaggctgccgaggagcgcaggaagactaaagaagaagaaataagaaaaaggctacggagtgaccgacttttgccttcagccaatcactcagattcagctgaattagatggggccgaggttgcatttgccaaaggacttcaaagggtgaggtctgctggatttgaaccatctgacctgcagggaggaaaaccattgaagaggaagaagagtaaatgtgatgcaaccttgattgatagaaacgaaagtgatgaaagttttggggtcgtggagtcagacatgtcctacaaccaagcagatgacatagtctactaagccattttttgtgaatttcataagaaagcattcattctccccatttgtgacatttgtagtatgtctcatattctttgactgactgacctcattccactgggatttctgccttgggcttaaggatgattgtgtgggctgcacaggctgaaggttagttgagtaaattaagtagctatgctagcttttaaaaaaagagcgagggggagacttgaccagcatagatatttggcactctcctttgtgtggcttcaaacattatggagatgtctttaattcatttataagtgccttcagtttacattaataagttcgtgccaaatgaaatccttcctgtttactcctgccttgtggcggggtccatcctctgctgctcctttaaaacaaattgcatggatttgtattaagtattttaatggcttatatgttttttatgctgtatgtctatggttttataatttttttctctgtgttgtgaaggaataaagcaatgt

SEQ ID NO: 186699 - DNA, 2255 bp, Homo sapiens
  Payload ID: 16765
  Gene Symbol: STMN3
  Gene Name: stathmin-like 3
  Uniprot ID: Q9NZ72
  ENST ID: ENST00000370053
  CDS Start-End: 83-625
ggcactgcagcaccagccgtctgcagctccggccgccacttgcgcctctccagcctccgcaggcccaaccgccgccagcaccatggccagcaccatttccgcctacaaggagaagatgaaggagctgtcggtgctgtcgctcatctgctcctgcttctacacacagccgcaccccaataccgtctaccagtacggggacatggaggtgaagcagctggacaagcgggcctcaggccagagcttcgaggtcatcctcaagtccccttctgacctgtccccagagagccctatgctctcctccccacccaagaagaaggacacctccctggaggagctgcaaaagcggctggaggcagccgaggagcggaggaagacgcaggaggcgcaggtgctgaagcagctggcggagcggcgcgagcacgagcgcgaggtgctgcacaaggcgctggaggagaataacaacttcagccgccaggcggaggagaagctcaactacaagatggagctcagcaaggagatccgcgaggcacacctggccgcactgcgcgagcggctgcgcgagaaggagctgcacgcggccgaggtgcgcaggaacaaggagcagcgagaagagatgtcgggctaagggcccgggacgggcggcgcccatcctgcgacagaacacgttcgggttttggttttgtttcgttcacctctgtctagatgcaacttttgttcctcctcccccacccccgcccccagcttcatgcttctcttccgcactcagccgccctgccctgtcctcgtggtgagtcgctgaccacggcttcccctgcaggagccgccgggcgtgagacgcggtccctcggtgcagacaccaggccgggcgcggctgggtcccccgggggccctgtgagagaggtggcggtgaccgtggtaaacccagggcggtggcgtgggatcacgggtccttacgctgggctgtctggtcagcacgtgcaggtcagggcaggtcctctgagccggcgcccctggccagcaggcgaggctacagtacctgctgtctttccagggggaaggggctccccatgagggaggggcgacgggggaggggggtgatggtgcctgggagcctgcgtgtgcagccggtgcttgttgaactggcaggcgggtgggtgggggctgcagctttccttaatgtggttgcacaggggtcctctgagaccacctggcgtgaggtggacaccctgggccttcctggaagcctgcagttgggggcctgccctgagtctgctggggagtgggcattctctgccagggacccatgagcaggctgcatggtctagaggttgtgggcagcatggacagtcccccactcagaagtgcaagagttccaaagagcctctggcccaggcccctccccaccagggctttgcagatgtccttgaaagacccaccctagagccctttggagtgctggcccctcctgtgccctctgccctggtggaagcggcagccacaagtcctcctcagggagccccaagggggattttgtgggaccgctgcccacagatccaggtgttggaagggcagcgggtaaggttcccaagccagccccaacacccttcccacttggcacccagagggggctgtgggtggaggcctgactccaggcctctcctgcccacaccctctgggctgagttccttctttcccttggacgcccagtgctggccttggaggacggtcagctggaggatggcggtgggggaggctgtctttgtaccactgcagcatcccccacttctccacggaagccccatcccaaagctgctgcctggccccttgctgtaaagtgtgaagggggcggctgagttctcttaggacccagagccagggccctcaacttccatcctgcgggaggccttggccgggcactgccagtgtcttccagagtcacacccagggaccacgggaggatcctgacccctgcagggctcaggggtcagcagggacccactgccccatctccctctccccaccaagacagccccagaaggagcagccagctgggatgggaacccaaggctgtccacatctggcttttgtgggactcagaaagggaagcagaactgagggctgggatattcctcatggtggcagcgctcatagcgaaagcctactgtaatatgcacccatctcatccacgtagtaaagtgaacttaaaaattcaatcaaatgaacaattaaataaacacctgtgtgtttaagacatg

SEQ ID NO: 186700 - DNA, 2351 bp, Homo sapiens
  Payload ID: 16765
  Gene Symbol: STMN3
  Gene Name: stathmin-like 3
  Uniprot ID: Q9NZ72
  ENST ID: ENST00000540534
  CDS Start-End: 209-718
acaccgctgcggcctcggggaccaccctttgcgacgcccgcgccacctgctctggccagaaaagccactgccctttgcgccgcggggtctggatgggggaggggcgactgcgatccccaaaccctccggagaccagagggctccgcccctcccgcccctccacctcccgcggggcggacccaccgccttcgaagcctacaaggagaagatgaaggagctgtcggtgctgtcgctcatctgctcctgcttctacacacagccgcaccccaataccgtctaccagtacggggacatggaggtgaagcagctggacaagcgggcctcaggccagagcttcgaggtcatcctcaagtccccttctgacctgtccccagagagccctatgctctcctccccacccaagaagaaggacacctccctggaggagctgcaaaagcggctggaggcagccgaggagcggaggaagacgcaggaggcgcaggtgctgaagcagctggcggagcggcgcgagcacgagcgcgaggtgctgcacaaggcgctggaggagaataacaacttcagccgccaggcggaggagaagctcaactacaagatggagctcagcaaggagatccgcgaggcacacctggccgcactgcgcgagcggctgcgcgagaaggagctgcacgcggccgaggtgcgcaggaacaaggagcagcgagaagagatgtcgggctaagggcccgggacgggcggcgcccatcctgcgacagaacacgttcgggttttggttttgtttcgttcacctctgtctagatgcaacttttgttcctcctcccccacccccgcccccagcttcatgcttctcttccgcactcagccgccctgccctgtcctcgtggtgagtcgctgaccacggcttcccctgcaggagccgccgggcgtgagacgcggtccctcggtgcagacaccaggccgggcgcggctgggtcccccgggggccctgtgagagaggtggcggtgaccgtggtaaacccagggcggtggcgtgggatcacgggtccttacgctgggctgtctggtcagcacgtgcaggtcagggcaggtcctctgagccggcgcccctggccagcaggcgaggctacagtacctgctgtctttccagggggaaggggctccccatgagggaggggcgacgggggaggggggtgatggtgcctgggagcctgcgtgtgcagccggtgcttgttgaactggcaggcgggtgggtgggggctgcagctttccttaatgtggttgcacaggggtcctctgagaccacctggcgtgaggtggacaccctgggccttcctggaagcctgcagttgggggcctgccctgagtctgctggggagtgggcattctctgccagggacccatgagcaggctgcatggtctagaggttgtgggcagcatggacagtcccccactcagaagtgcaagagttccaaagagcctctggcccaggcccctccccaccagggctttgcagatgtccttgaaagacccaccctagagccctttggagtgctggcccctcctgtgccctctgccctggtggaagcggcagccacaagtcctcctcagggagccccaagggggattttgtgggaccgctgcccacagatccaggtgttggaagggcagcgggtaaggttcccaagccagccccaacacccttcccacttggcacccagagggggctgtgggtggaggcctgactccaggcctctcctgcccacaccctctgggctgagttccttctttcccttggacgcccagtgctggccttggaggacggtcagctggaggatggcggtgggggaggctgtctttgtaccactgcagcatcccccacttctccacggaagccccatcccaaagctgctgcctggccccttgctgtaaagtgtgaagggggcggctgagttctcttaggacccagagccagggccctcaacttccatcctgcgggaggccttggccgggcactgccagtgtcttccagagtcacacccagggaccacgggaggatcctgacccctgcagggctcaggggtcagcagggacccactgccccatctccctctccccaccaagacagccccagaaggagcagccagctgggatgggaacccaaggctgtccacatctggcttttgtgggactcagaaagggaagcagaactgagggctgggatattcctcatggtggcagcgctcatagcgaaagcctactgtaatatgcacccatctcatccacgtagtaaagtgaacttaaaaattcaatcaaatgaacaattaaataaacacctgtgtgtttaagacatggtt

SEQ ID NO: 186701 - DNA, 519 bp, Homo sapiens
  Payload ID: 16765
  Gene Symbol: STMN3
  Gene Name: stathmin-like 3
  ENST ID: ENST00000632676
  CDS Start-End: 262-519
gcttcgtttttcactcgacgtttgggaggacaggacgaagggccgcacctccttcccatcgccgcccccgttcacgagccgcactccctcccaccttttcttacgcccccgggacaggtcgccgcggtccctctcccgagctgactggttcaactcgggcgccttggcccggggcgcagaactccgcccacccacgcgtgcccgacctgaccccgcccctcaggccccacgggcttggaggctccagcctacaaggagaagatgaaggagctgtcggtgctgtcgctcatctgctcctgcttctacacacagccgcaccccaataccgtctaccagtacggggacatggaggtgaagcagctggacaagcgggcctcaggccagagcttcgaggtcatcctcaagtccccttctgacctgtccccagagagccctatgctctcctccccacccaagaagaaggacacctccctggaggagctgcaaaagcggctggaggcagccgaggagcggaggaag

SEQ ID NO: 186702 - DNA, 970 bp, Homo sapiens
  Payload ID: 16765
  Gene Symbol: STMN3
  Gene Name: stathmin-like 3
  ENST ID: ENST00000631920
  CDS Start-End: 1-718
acaccgctgcggcctcggggaccaccctttgcgacgcccgcgccacctgctctggccagaaaagccactgccctttgcgccgcggggtctggatgggggaggggcgactgcgatccccaaaccctccggagaccagagggctccgcccctcccgcccctccacctcccgcggggcggacccaccgccttcgaagcctacaaggagaagatgaaggagctgtcggtgctgtcgctcatctgctcctgcttctacacacagccgcaccccaataccgtctaccagtacggggacatggaggtgaagcagctggacaagcgggcctcaggccagagcttcgaggtcatcctcaagtccccttctgacctgtccccagagagccctatgctctcctccccacccaagaagaaggacacctccctggaggagctgcaaaagcggctggaggcagccgaggagcggaggaagacgcaggaggcgcaggtgctgaagcagctggcggagcggcgcgagcacgagcgcgaggtgctgcacaaggcgctggaggagaataacaacttcagccgccaggcggaggagaagctcaactacaagatggagctcagcaaggagatccgcgaggcacacctggccgcactgcgcgagcggctgcgcgagaaggagctgcacgcggccgaggtgcgcaggaacaaggagcagcgagaagagatgtcgggctaagggcccgggacgggcggcgcccatcctgcgacagaacacgttcgggttttggttttgtttcgttcacctctgtctagatgcaacttttgttcctcctcccccacccccgcccccagcttcatgcttctcttccgcactcagccgccctgccctgtcctcgtggtgagtcgctgaccacggcttcccctgcaggagccgccgggcgtgagacgcggtccctcggtgcagacaccaggccgggcgcggctgggt

SEQ ID NO: 186703 - DNA, 605 bp, Homo sapiens
  Payload ID: 16765
  Gene Symbol: STMN3
  Gene Name: stathmin-like 3
  ENST ID: ENST00000634126
  CDS Start-End: 348-605
cgcgcacggccggcaggcagcacttcttcgtggcttcttcatggctgtgtttaatgtccactgacggcacatgcgaatgccatgcgtgcccacgctcctgggtgtgagatagtgctcggagaagccccagcactcactggcacccagccccatgtgcctgttgtggtgaaggaactgcaggctgcctatctgagactcggcagggagttgaagatgaggagaccagccacacacactcgttgaatgaatgggcaccaagcacaagtttcagtgccccccatacatgctgatatggttcggctctgtgtctccacccaagtctcacctcgaattcctacaaggagaagatgaaggagctgtcggtgctgtcgctcatctgctcctgcttctacacacagccgcaccccaataccgtctaccagtacggggacatggaggtgaagcagctggacaagcgggcctcaggccagagcttcgaggtcatcctcaagtccccttctgacctgtccccagagagccctatgctctcctccccacccaagaagaaggacacctccctggaggagctgcaaaagcggctggaggcagccgaggagcggaggaag

SEQ ID NO: 186704 - DNA, 1250 bp, Homo sapiens
  Payload ID: 16766
  Gene Symbol: STMN4
  Gene Name: stathmin-like 4
  Uniprot ID: Q9H169
  ENST ID: ENST00000265770
  CDS Start-End: 138-707
agggtaccactaattgagggagtgaggaagagagcagctcgcttctaactggactgcacgttggtgacagcgtcccaagctggtgacagacccactctgtaactttcagctagattcagccaccagatcccagaaacatgacccttgctgcctacaaagagaagatgaaggagctcccgctggtgtccttgttctgctcctgcttcctggccgatcccctgaataagtcgtcctacaaatatgaagcagacacggtggacctgaattggtgcgtcatttccgacatggaagtcatcgagctgaacaaatgcacctcgggccaatcctttgaagtcatcctgaagccaccctcctttgatggggttcccgagttcaacgcctccctgccaaggcggcgagacccatccctggaagagatccagaagaaactagaagcggctgaggagcgaaggaagtaccaggaagcggagctcctgaaacacctagcagagaaacgggaacatgagagagaggtgatccaaaaggccattgaggaaaacaacaacttcatcaagatggctaaggaaaaactggcccagaagatggaatccaacaaggagaacagggaggcccacctcgccgccatgttggaacggctgcaagagaaggacaagcacgccgaggaggtgcggaaaaacaaggagctgaaggaagaggcctccaggtaaagcctagaggccaaagaactttccaggtcagccggacagctccagcagctccacgttccaggcagcctcgcccgccggctgcgctcccagcactggggtttggggggaggggggtggccaaggggcgtttcctctgcttttggtgtttgtacatgttaagaattgaccagtgaagccatcctatttgtttccggggaacaatgacggggtgggagaggggagaggagagagtttgggaaagggagatggagaagaactcaaggacattgcaaccctgcccggcgcagatctgattttcacatctctacctggacattgagcctccaggcaccatgttgaggagagatgaaaaccagggcggtagaacttcagggtgaaggacagagtcctgggtggggcagcggctgcagggcgcaccagagaacccagccagaggggttgtgagtaccagtggtgttgcttccaccctgcagcaggtgggatgaggtctgtgtgtgtgtgtgaaccatcattttttgatcatcatgaccaatgaaacattga

SEQ ID NO: 186705 - DNA, 2288 bp, Homo sapiens
  Payload ID: 16766
  Gene Symbol: STMN4
  Gene Name: stathmin-like 4
  Uniprot ID: Q9H169
  ENST ID: ENST00000350889
  CDS Start-End: 115-765
gaggaagagagcagctcgcttctaactggactgcacgttggtgacagcgtcccaagctggtgacagacccactctgtaactttcagctagattcagccaccagatcccagaaacatgacccttgctgcctacaaagagaagatgaaggagctcccgctggtgtccttgttctgctcctgcttcctggccgatcccctgaataagtcgtcctacaaatatgaaggctggtgtgggagacagtgtaggaggaaggatgaaagccagcggaaagacagtgctgactggagagaaagaagagctcaggcagacacggtggacctgaattggtgcgtcatttccgacatggaagtcatcgagctgaacaaatgcacctcgggccaatcctttgaagtcatcctgaagccaccctcctttgatggggttcccgagttcaacgcctccctgccaaggcggcgagacccatccctggaagagatccagaagaaactagaagcggctgaggagcgaaggaagtaccaggaagcggagctcctgaaacacctagcagagaaacgggaacatgagagagaggtgatccaaaaggccattgaggaaaacaacaacttcatcaagatggctaaggaaaaactggcccagaagatggaatccaacaaggagaacagggaggcccacctcgccgccatgttggaacggctgcaagagaaggacaagcacgccgaggaggtgcggaaaaacaaggagctgaaggaagaggcctccaggtaaagcctagaggccaaagaactttccaggtcagccggacagctccagcagctccacgttccaggcagcctcgcccgccggctgcgctcccagcactggggtttggggggaggggggtggccaaggggcgtttcctctgcttttggtgtttgtacatgttaagaattgaccagtgaagccatcctatttgtttccggggaacaatgacggggtgggagaggggagaggagagagtttgggaaagggagatggagaagaactcaaggacattgcaaccctgcccggcgcagatctgattttcacatctctacctggacattgagcctccaggcaccatgttgaggagagatgaaaaccagggcggtagaacttcagggtgaaggacagagtcctgggtggggcagcggctgcagggcgcaccagagaacccagccagaggggttgtgagtaccagtggtgttgcttccaccctgcagcaggtgggatgaggtctgtgtgtgtgtgtgaaccatcattttttgatcatcatgaccaatgaaacattgactccaagtgtccagttctttatttcccaaatgtgtcctttgggtaattgttaaaaagttctcgaaacctggctttcatccatctgatggcagatgcccctttgcttccttaattctgccattcaagcatctggagcctgggtgaggtgggttgaatcaggccagcctttggcataattgaaaggttttctcttctgttttttaaaatcccctctgtgggctaatctttattggatagcatgcactaaattgatgagaaaagaaactcaatcttcctttcaatgaactgacatcctaatatggtccccaagatgcactgtaagaaggaatttgtcttagtcacaaccgttcagactgctgtaacaaaataccttagactaagtaattgataacagaaattgattgctcacagttttggaggctgggaagtccaatatcaaggtgccagcagattcagtgtctggtgagggcttgccatctgcttcaaagatgatgcctttttgctgcatcctcacatggcagaagggaagggcaaaagggcttccttgagccttttctttaaggcactaatcccattcatgaaggtggagtcctcatgatctcacctcttaaggccctatctcttaattctgtagtgtcgggattaggattcaacctgtatattgggggagacagcaacattcacaccatagcagaagtcctccatgctttgggggtttgagattctaggtagattagaaaatacgagcaaggaaataaagtgtttgctagtagaaggcaaaggaggcatccagacccagcagtcttggtctccaggacactgaaccatggctggaaaagaagctctcctcctcccttcccctgcaaacatgagtgcaggggctgcctgtgttaaccgggtcccaggacctcttcccactctgctctgcacactgtgtagttttttacagctttgcaaataaaccctttggtatagccttt

SEQ ID NO: 186706 - DNA, 1224 bp, Homo sapiens
  Payload ID: 16766
  Gene Symbol: STMN4
  Gene Name: stathmin-like 4
  Uniprot ID: Q9H169
  ENST ID: ENST00000523048
  CDS Start-End: 149-760
gagagaagcccagggtaccactaattgagggagtgaggaagagagcagctcgcttctaactggactgcacgttggtgacagcgtcccaagctggtgacagacccactctgtaactttcagctagattcagccaccagatcccagaaacatgacccttgctgcctacaaagagaagatgaaggagctcccgctggtgtccttgttctgctcctgcttcctggccgatcccctgaataagtcgtcctacaaatatgaaggctggtgtgggagacagtgtaggaggaaggatgaaagccagcggaaagacagtgctgactggagagaaagaagagctcaggcagacacggtggacctgaattggtgcgtcatttccgacatggaagtcatcgagctgaacaaatgcacctcgggccaatcctttgaagtcatcctgaagccaccctcctttgatggggttcccgagttcaacgcctccctgccaaggcggcgagacccatccctggaagagatccagaagaaactagaagcggctgaggagcgaaggaagtaccaggaagcggagctcctgaaacacctagcagagaaacgggaacatgagagagaggtgatccaaaaggccattgaggaaaacaacaacttcatcaagatggctaaggaaaaactggcccagaagatggaatccaacaaggagaacagggaggcccacctcgccgccatgttggaacggctgcaagagaaggaaccgcctgctgcgcggtgactcccgggacctgatcggtggcctcgtcccatggacaagcacgccgaggaggtgcggaaaaacaaggagctgaaggaagaggcctccaggtaaagcctagaggccaaagaactttccaggtcagccggacagctccagcagctccacgttccaggcagcctcgcccgccggctgcgctcccagcactggggtttggggggaggggggtggccaaggggcgtttcctctgcttttggtgtttgtacatgttaagaattgaccagtgaagccatcctatttgtttccggggaacaatgacggggtgggagaggggagaggagagagtttgggaaagggagatggagaagaactcaaggacattgcaaccctgcccggcgcagatctgattttcacatctctacctggacattgagcctccaggcaccatgttgaggagagatgaaaaccagggcggtagaacttca

SEQ ID NO: 186707 - DNA, 1623 bp, Homo sapiens
  Payload ID: 16766
  Gene Symbol: STMN4
  Gene Name: stathmin-like 4
  Uniprot ID: Q9H169
  ENST ID: ENST00000519997
  CDS Start-End: 66-569
actaattgagggagtgaggaagagagcagctcgcttctaactggactgcaccctacaaagagaagatgaaggagctcccgctggtgtccttgttctgctcctgcttcctggccgatcccctgaataagtcgtcctacaaatatgaagcagacacggtggacctgaattggtgcgtcatttccgacatggaagtcatcgagctgaacaaatgcacctcgggccaatcctttgaagtcatcctgaagccaccctcctttgatggggttcccgagttcaacgcctccctgccaaggcggcgagacccatccctggaagagatccagaagaaactagaagcggctgaggagcgaaggaagtaccaggaagcggagctcctgaaacacctagcagagaaacgggaacatgagagagaggtgatccaaaaggccattgaggaaaacaacaacttcatcaagatggctaaggaaaaactggcccagaagatggaatccaacaaggagaacagggaggcccacctcgccgccatgttggaacggctgcaagagaaggaaccgcctgctgcgcggtgactcccgggacctgatcggtggcctcgtcccatggacaagcacgccgaggaggtgcggaaaaacaaggagctgaaggaagaggcctccaggtaaagcctagaggccaaagaactttccaggtcagccggacagctccagcagctccacgttccaggcagcctcgcccgccggctgcgctcccagcactggggtttggggggaggggggtggccaaggggcgtttcctctgcttttggtgtttgtacatgttaagaattgaccagtgaagccatcctatttgtttccggggaacaatgacggggtgggagaggggagaggagagagtttgggaaagggagatggagaagaactcaaggacattgcaaccctgcccggcgcagatctgattttcacatctctacctggacattgagcctccaggcaccatgttgaggagagatgaaaaccagggcggtagaacttcagggtgaaggacagagtcctgggtggggcagcggctgcagggcgcaccagagaacccagccagaggggttgtgagtaccagtggtgttgcttccaccctgcagcaggtgggatgaggtctgtgtgtgtgtgtgaaccatcattttttgatcatcatgaccaatgaaacattgactccaagtgtccagttctttatttcccaaatgtgtcctttgggtaattgttaaaaagttctcgaaacctggctttcatccatctgatggcagatgcccctttgcttccttaattctgccattcaagcatctggagcctgggtgaggtgggttgaatcaggccagcctttggcataattgaaaggttttctcttctgttttttaaaatcccctctgtgggctaatctttattggatagcatgcactaaattgatgagaaaagaaactcaatcttcctttcaatgaactgacatcctaatatggtccccaagatgcactgtaagaaggaatttgtcttagtcacaaccgttcagactgctgtaacaaaataccttagactaagtaattgataacagaaattgattgctcacagttttgga

SEQ ID NO: 186708 - DNA, 1004 bp, Homo sapiens
  Payload ID: 16766
  Gene Symbol: STMN4
  Gene Name: stathmin-like 4
  ENST ID: ENST00000522908
  CDS Start-End: 133-909
accactaattgagggagtgaggaagagagcagctcgcttctaactggactgcacgttggtgacagcgtcccaagctggtgacagacccactctgtaactttcagctagattcagccaccagatcccagaaacatgacccttgctgcctacaaagagaagatgaaggagctcccgctggtgtccttgttctgctcctgcttcctggccgatcccctgaataagtcgtcctacaaatatgaaggctggtgtgggagacagtgtaggaggaaggatgaaagccagcggaaagacagtgctgactggagagaaagaagagctcaggcagacacggtggacctgaattggtgcgtcatttccgacatggaagtcatcgagctgaacaaatgcacctcgggccaatcctttgaagtcatcctgaagccaccctcctttgatggggttcccgagttcaacgcctccctgccaaggcggcgagacccatccctggaagagatccagaagaaactagaagcggctgaggagcgaaggaagtaccaggaagcggagctcctgaaacacctagcagagaaacgggaacatgagagagaggtgatccaaaaggccattgaggaaaacaacaacttcatcaagatggctaaggaaaaactggcccagaagatggaatccaacaaggagaacagggaggcccacctcgccgccatgttggaacggctgcaagagaaggtgaggggtccctggctagagaggagtttcctgggacatgctgttttccttctgcagcaagtatgcggggacctgctgatcatctcagggaggaagcagcctcaggcaaaaatcaggatctttttcttaggcaggatctttagagagttccgaaggatgatcagggaagtcagaggcaagaaataggaaccagactcagggtttccttgggggatattctgcacagttacacaattaaaatccttcattgccttagggagcatatatgtctgattttctag

SEQ ID NO: 186709 - DNA, 1273 bp, Homo sapiens
  Payload ID: 16766
  Gene Symbol: STMN4
  Gene Name: stathmin-like 4
  ENST ID: ENST00000519614
  CDS Start-End: 133-828
accactaattgagggagtgaggaagagagcagctcgcttctaactggactgcacgttggtgacagcgtcccaagctggtgacagacccactctgtaactttcagctagattcagccaccagatcccagaaacatgacccttgctgcctacaaagagaagatgaaggagctcccgctggtgtccttgttctgctcctgcttcctggccgatcccctgaataagtcgtcctacaaatatgaagcagacacggtggacctgaattggtgcgtcatttccgacatggaagtcatcgagctgaacaaatgcacctcgggccaatcctttgaagtcatcctgaagccaccctcctttgatggggttcccgagttcaacgcctccctgccaaggcggcgagacccatccctggaagagatccagaagaaactagaagcggctgaggagcgaaggaagtaccaggaagcggagctcctgaaacacctagcagagaaacgggaacatgagagagaggtgatccaaaaggccattgaggaaaacaacaacttcatcaagatggctaaggaaaaactggcccagaagatggaatccaacaaggagaacagggaggcccacctcgccgccatgttggaacggctgcaagagaaggtgaggggtccctggctagagaggagtttcctgggacatgctgttttccttctgcagcaagtatgcggggacctgctgatcatctcagggaggaagcagcctcaggcaaaaatcaggatctttttcttaggcaggatctttagagagttccgaaggatgatcagggaagtcagaggcaagaaataggaaccagactcagggtttccttgggggatattctgcacagttacacaattaaaatccttcattgccttagggagcatatatgtctgattttctagaagaagcctgtctaatacaaaggagtagagatagacaagcaggtatgcattcctagcttcatccctgaatggattgatttgatggaaggaaagatgctttcttgagctcttggctctaagtcacgggtatgatgagctgagattcccactgagcaggaaacatgattctctctaaacctcttgacacagacccagtgagtcacaggtctttccaatatgttgccttttgtcaataaatggaacggtgtcacctaaatatgagaaacatgaggccggggttggttctgtgtgtcagcagaataccggcccgttctgctgagaacacgctggcctcatttcctgagtctcaa

SEQ ID NO: 186710 - DNA, 3136 bp, Homo sapiens
  Payload ID: 16767
  Gene Symbol: STAU1
  Gene Name: staufen double-stranded RNA binding protein 1
  Uniprot ID: O95793
  ENST ID: ENST00000347458
  CDS Start-End: 291-1781
acttcctgccgggctgcgggcgcctgagcggctcttcagcgtttgcgccggcggctgccgcgtctctctcggctcccgcttcctttgaccgcctcccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaa

SEQ ID NO: 186711 - DNA, 3334 bp, Homo sapiens
  Payload ID: 16767
  Gene Symbol: STAU1
  Gene Name: staufen double-stranded RNA binding protein 1
  Uniprot ID: O95793
  ENST ID: ENST00000340954
  CDS Start-End: 489-1979
acttcctgccgggctgcgggcgcctgagcggctcttcagcgtttgcgccggcggctgccgcgtctctctcggctcccgcttcctttgaccgcctcccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccaggtggagttttgctcttgtcgcccaggctggagtgcagtggcgtgatctcggctcactgcaacctccacctcccaggttcaagcgattttcccacttcagcctcccgataagctgagattacagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaa

SEQ ID NO: 186712 - DNA, 3211 bp, Homo sapiens
  Payload ID: 16767
  Gene Symbol: STAU1
  Gene Name: staufen double-stranded RNA binding protein 1
  Uniprot ID: O95793
  ENST ID: ENST00000360426
  CDS Start-End: 366-1856
acttcctgccgggctgcgggcgcctgagcggctcttcagcgtttgcgccggcggctgccgcgtctctctcggctcccgcttcctttgaccgcctcccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaa

SEQ ID NO: 186713 - DNA, 3130 bp, Homo sapiens
  Payload ID: 16767
  Gene Symbol: STAU1
  Gene Name: staufen double-stranded RNA binding protein 1
  ENST ID: ENST00000371792
  CDS Start-End: 291-1775
acttcctgccgggctgcgggcgcctgagcggctcttcagcgtttgcgccggcggctgccgcgtctctctcggctcccgcttcctttgaccgcctcccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaa

SEQ ID NO: 186714 - DNA, 3154 bp, Homo sapiens
  Payload ID: 16767
  Gene Symbol: STAU1
  Gene Name: staufen double-stranded RNA binding protein 1
  Uniprot ID: O95793
  ENST ID: ENST00000371802
  CDS Start-End: 291-1799
acttcctgccgggctgcgggcgcctgagcggctcttcagcgtttgcgccggcggctgccgcgtctctctcggctcccgcttcctttgaccgcctcccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgagtctttccctctgaaacaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaa

SEQ ID NO: 186715 - DNA, 3411 bp, Homo sapiens
  Payload ID: 16767
  Gene Symbol: STAU1
  Gene Name: staufen double-stranded RNA binding protein 1
  Uniprot ID: O95793
  ENST ID: ENST00000371828
  CDS Start-End: 366-1874
acttcctgccgggctgcgggcgcctgagcggctcttcagcgtttgcgccggcggctgccgcgtctctctcggctcccgcttcctttgaccgcctcccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgagtctttccctctgaaacaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaatttttttgttaatttattctcaaatgccactactgctaggttggtcccctcccaacttgcccctatcctttttttatttttaagaaaaaaactttgtaatgcttgtgattccatctgggcaaaagtctgaagatctgaaataactttatatcaaaccattgatcaataaacagctactaatg

SEQ ID NO: 186716 - DNA, 3684 bp, Homo sapiens
  Payload ID: 16767
  Gene Symbol: STAU1
  Gene Name: staufen double-stranded RNA binding protein 1
  Uniprot ID: O95793
  ENST ID: ENST00000371856
  CDS Start-End: 412-2145
acttcctgccgggctgcgggcgcctgagcggctcttcagcgtttgcgccggcggctgccgcgtctctctcggctcccgcttcctttgaccgcctcccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagagtttattaaccacttaacctctcagaactgaacaaagacaacattgttcctggaacgccctctttttaaaaaaggtagaactttagacttcatagcactgaattaacctgcactgaaagctgtttacctgcatttgttcacttttgttgaaagtgaccatgtctcaagttcaagtgcaagttcagaacccatctgctgctctctcagggagccaaatactgaacaagaaccagtctcttctctcacagcctttgatgagtattccttctactactagctctctgccctctgaaaatgcaggtagacccattcaaaactctgctttaccctctgcatctattacatccaccagtgcagctgcagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaatttttttgttaatttattctcaaatgccactactgctaggttggtcccctcccaacttgcccctatcctttttttatttttaagaaaaaaactttgtaatgcttgtgattccatctgggcaaaagtctgaagatctgaaataactttatatcaaaccattgatcaataaacagctactaatgaa

SEQ ID NO: 186717 - DNA, 643 bp, Homo sapiens
  Payload ID: 16767
  Gene Symbol: STAU1
  Gene Name: staufen double-stranded RNA binding protein 1
  ENST ID: ENST00000456866
  CDS Start-End: 257-643
ttaaccacttaacctctcagaactgaacaaagacaacattgttcctggaacgccctctttttaaaaaagctttttccccttcagcatttatccatgagacaatcaccaagatgacccagggattgtactgcgttgcaggcttctgccatttgaccttcctgcctgccagggttttgagttcatgctgttgtttgtacttaaatgagtagcctgatggactgcagaacatataataaaggagacccctgatgtcctgatgtgtgaagtgtcaagggggtggaagccgtgcactgagggaatcctaaaagtaagacctacaagaaaaatcagctatgaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggag

SEQ ID NO: 186718 - DNA, 1085 bp, Homo sapiens
  Payload ID: 16767
  Gene Symbol: STAU1
  Gene Name: staufen double-stranded RNA binding protein 1
  ENST ID: ENST00000437404
  CDS Start-End: 489-1085
acttcctgccgggctgcgggcgcctgagcggctcttcagcgtttgcgccggcggctgccgcgtctctctcggctcccgcttcctttgaccgcctcccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccaggtggagttttgctcttgtcgcccaggctggagtgcagtggcgtgatctcggctcactgcaacctccacctcccaggttcaagcgattttcccacttcagcctcccgataagctgagattacagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgagtctttccctctgaaacaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaag

SEQ ID NO: 186719 - DNA, 3054 bp, Homo sapiens
  Payload ID: 16767
  Gene Symbol: STAU1
  Gene Name: staufen double-stranded RNA binding protein 1
  ENST ID: ENST00000614381
  CDS Start-End: 36-1517
gcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcagcgcagccaccaaacccgcactcaagtcagaggagaagacacccataaagaaaccaggggatggaagaaaagtaacctttttctggctctggggatgaaagggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaatttttttgttaatttattctcaaatgccactactgctaggttggtcccctcccaacttgcccctatcctttttttatttttaagaaaaaaactttgtaatgcttgtgattccatctgggcaaaagtctgaagatctgaaataactttatatcaaaccattgatcaataaacagctactaatg

SEQ ID NO: 186720 - DNA, 4061 bp, Homo sapiens
  Payload ID: 16768
  Gene Symbol: STAU2
  Gene Name: staufen double-stranded RNA binding protein 2
  ENST ID: ENST00000355780
  CDS Start-End: 220-1659
agttctctgtagtgtttgccaatgttggagccgtctgcaaagtgtccccggcaagaagaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatgtggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggtatgaattaaaagcaaaaacaaaaaacaaaacaattcattagcctcagattcttcatctgtatacatcacaaggctcattcttgcctgctagtatggcctacatgccacttacgttttaagttatttaggaacacaaaggacagacaaaaaagccatatgcacatgcctcattttctcttatttttgatctatctagtaattcttttgctgcctgtctcttctccattttccttcttcttttttaagcatttttcatattcttcactgtcttctatttggtcttgattaggtgcatctatctcttcgctctgtcttccacaaacaaaaattctgccttcagacatttggtgttagtatttcacactcagttctccctttttttacataaggattgagtttctttttatgatgattttacctttatagcaattttgaattttgcattctattgctagtattgattcaggtacaccattaagatacaacattctagaagtctattaccttaggagttaattaaacatgatatttgaagaataatgaaatgctttatagttgtttgaggcataacaatgtgtatttgttttactggatcatgttttgaactgactagggagggtagcacctgcctcagatagtaccaacaattctgtttcactgggtagtctaaaactagcttatagtttaacttaacttgttgtgtatgtgaatttagggatggaaactttttttcccctatttattctttgtttccttctgggaaaaaaccccacaaaaatcagcactcctttatggatacattggagcttttgaaagaattgtaaactctaggaaggggaaatatctgtgtcttgatttcttagttgccttgaaaatcatgtactgaactgtaaccgctaacttgactggatgaactagtttgcttgtgtgtagagagtgtattgcttcctcagatttcactgttttcatctccttttccatcttagtctttattccttaagaccaaaaactgtaatatcctttagaaatgctctagaagatctgtattgtgtagaatgatcatgtatttataaatattttacaagtttagattataaaatgaaaaagaaggtcatgtgttttggggggtattttgcatgttcggatttttttttcacttcaccgaacccttctgattctttcaaactattgccaggtagttgttagtgtttctaattggactcttaatatgaacttcaagaagctgttaccagttatcggctctgtcatctgaaattttaaccacttaatttaaagttacaattttagaatttgtttttgttgttttaccttaagaaacacaataaatcactgtttaaaaaagatctcaatttatataaagtactggaaaaaagctaagtaatttttagttctatctataatctccgtaggatgaattagaaataaattgtgatgaaaagaaattaactgcttatttatgaatctaatcatttagaaatgtctgagagtaacactgcattcttatagaaacaaagcacaaattgcattcaagctctgaattgattttttgcttggagctgttgttacagtagctgtaattttgctaccagaatgtcttaattttttaaatttgtttttatttctaagctcttggcaatgacaataattataattttaacatatcttcactgtagtcaacatgtagagtctgcttccctcattattgcattgctaaggcctttttaaaaagcttatgcttacataatatactcttttttatggacacgttatatgtttccaaatctgtgtattgtgatttttacatactaatgaatataaacaggtgattttaaaatattactgtgcttctttggttgaatgagctggtattgatgtaaaatactctgtcattgatggaccactacctgcagctaagcagtgagcagaatctccgggaaatgacttagtctggccacatgcatagcccatcttcataatgtcgcagcagaaggttctttgtggttaaaagttttaaagcctatttctttataggtaaccctctcaggtatatttacctggtagaaaaacatgtagattgtttctattacttaaatgttttaattggactgtagtttagaaattacaggaccagcttgttacagattatacactattctgttacttttatttctgaaacttaaaaacaataaattctttttctgtgtttctaggttagaacttttttattttattgcacactgaacagatactgttgcttattgaatattgtgtaaacccttctttggctttccttgcccattgcaatttgatttaagcctactagagccattgtatgtgacagctatattgtattacaaagtaaaaatatatgagtgtattgaaaac

SEQ ID NO: 186721 - DNA, 2173 bp, Homo sapiens
  Payload ID: 16768
  Gene Symbol: STAU2
  Gene Name: staufen double-stranded RNA binding protein 2
  ENST ID: ENST00000522509
  CDS Start-End: 371-1810
actcttgcctcataaatctaggattcagggcattgttttcaatggttctcatttttggctccaaggattctttttcatgtgactaatattttcggtagaagaggaggtctggccacgccgcgggtcttggcgagcaggtgatcacggatccctggtgtttgctgggcgagacggtgaagcaacctcctccccgccccctcccccgtctagaaaggtgcaagatccgctaaaccgtgcgttgcacagcggcggccggagcagacgcgggatggtcgcgcgtcccctgcacagcacagaggggcagccggagagcctgggaaagtttttggagccgtgagggatacagcagtttggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatgtggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggtatgaattaaaagcaaaaacaaaaaacaaaacaattcattagcctcagattcttcatctgtatacatcacaaggctcattcttgcctgctagtatggcctacatgccacttacgttttaagttatttaggaacacaaaggacagacaaaaaagccatatgcacatgcctcattttctcttatttttgatctatctagtaattcttttgctgcctgtctcttctccattttccttcttcttttttaagcatttttcatattcttcactgtcttctatttggtcttgattaggtgcatctatctcttcgctctgtcttccacaaacaaaaattctgccttcagacatttggtgttagtatttcacactca

SEQ ID NO: 186722 - DNA, 687 bp, Homo sapiens
  Payload ID: 16768
  Gene Symbol: STAU2
  Gene Name: staufen double-stranded RNA binding protein 2
  ENST ID: ENST00000518502
  CDS Start-End: 283-687
ggcgggcggaggcggggggcggggagcccgaggggtggaagccggcggcggccgagcggggtcagttctctgtagtgtttgccaatgttggagccgtctgcaaagtgtccccggcaagaagaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatgga

SEQ ID NO: 186723 - DNA, 2646 bp, Homo sapiens
  Payload ID: 16768
  Gene Symbol: STAU2
  Gene Name: staufen double-stranded RNA binding protein 2
  ENST ID: ENST00000522695
  CDS Start-End: 27-1643
agcagtttggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatgtggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggcagccttaagtgccttgaaacaattttctgaacaaggactggatccaatcgatggagcaatgaatatcgaaaaaggttctcttgaaaaacaagccaagcatctgagagagaaagcggacaataaccaggcacccccgggctccatcgctcaggactgcaagaaatcaaactcggccgtctagcagctcccagaacccgcggctgccaccgcatccttataaacctgtcagcacgcatgagggtgtctgtgttcagggaaatgaatgactaataccattatttgagtcttatgtgaagacaacactattctaacacgagagataatatacatggtactgtttattcaactggggaaaaataaaactttgagcatttcccttggaactcgagatcagatcataactcatttgcctagaggcagcagaaatctgatcctgctactggagcttaaaataacaagtaaagaaaagtgttagaaacaaagctaaaattttaacatgattaataatagagaagttgggtttggttctgttgttatgattgttttgtcgtggtgcttgtgttcagttatattctctctctctctcatttcaaatactgcttgacaattcgaaaatgaaccaatgatgtgctgtggaatgtgatggttgtcttcatatagagtcacatggtttctctttttatgcagatatttataatcttcatcctatatcagtaggaataactataaggtgcactacaaaaagatgtatgcaaacaaacatgttttaaatcaggtcagatatctgatgaaaaatacgaactaatgttaagagcaagtagtttcaacatactccaggaactgagaaacaaaacaaagcaattgtgggttttgagctccatatactcttagcaagtaagggggcgtcttgcccctatatatcatcttcccggattccactccctgttgtgggaatcgcgcccacccccatccgtgtgttgtagccactcacggtttgcatcaagagtgttttttgtaactgcctctggacttgggacagtgagtaggatcaaaaataaataatgtacatgacggggaagggaaaaacctgttggagttgcttccagccagccacgctccgggccagcatgttggaatccagcgtggagcagatgcagtaaaaatgtggttggtttctgtgtgaa

SEQ ID NO: 186724 - DNA, 2712 bp, Homo sapiens
  Payload ID: 16768
  Gene Symbol: STAU2
  Gene Name: staufen double-stranded RNA binding protein 2
  ENST ID: ENST00000521451
  CDS Start-End: 378-1253
cggggagcccgaggggtggaagccggcggcggccgagcggggtcagttctctgtagtgtttgccaatgttggagccgtctgcaaagtgtccccggcaagaaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagtgttatcctattttttgtgatttagaatggtgaatcaggaaaggatgtggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggtatgaattaaaagcaaaaacaaaaaacaaaacaattcattagcctcagattcttcatctgtatacatcacaaggctcattcttgcctgctagtatggcctacatgccacttacgttttaagttatttaggaacacaaaggacagacaaaaaagccatatgcacatgcctcattttctcttatttttgatctatctagtaattcttttgctgcctgtctcttctccattttccttcttcttttttaagcatttttcatattcttcactgtcttctatttggtcttgattaggtgcatctatctcttcgctctgtcttccacaaacaaaaattctgccttcagacatttggtgttagtatttcacactcagttctccctttttttacataaggattgagtttctttttatgatgattttacctttatagcaattttgaattttgcattctattgctagtattgattcaggtacaccattaagatacaacattctagaagtctattaccttaggagttaattaaacatgatatttgaagaataatgaaatgctttatagttgtttgaggcataacaatgtgtatttgttttactggatcatgttttgaactgactagggagggtagcacctgcctcagatagtaccaacaattctgtttcactgggtagtctaaaactagcttatagtttaacttaacttgttgtgtatgtgaatttagggatggaaactttttttcccctatttattctttgtttccttctgggaaaaaaccccacaaaaatcagcactcctttatggatacattggagcttttgaaagaattgtaaactctaggaaggggaaatatctgtgtcttgatttcttagttgccttgaaaatcatgtactgaactgtaaccgctaacttgactggatgaactagtttgcttgtgtgtagagagtgtattgcttcctcagatttcactgttttcatctccttttccatcttagtctttattccttaagaccaaaaactgtaatatcctttagaaatgctctagaagatctgtattgtgtagaatgatcatgtatttataaatattttacaagtttagattataaaatgaaaaagaaggtcatgtgttttggggggtattttgcatgttcggatttttttttcacttcaccgaacccttctgattctttcaaactattgccaggtagttgttagtgtttctaattggactcttaatatgaacttcaagaagctgttaccagttatcggctctgtcatctgaaattttaaccacttaatttaaagttacaattttagaatttgtttttgttgttttaccttaagaaacacaataaatcactgtttaaaaaagatctcaatttatataaagtactggaaaaaagctaagtaatttttagttctatctataatctccgtaggatgaattagaaataaattgtgatgaaaagaaa

SEQ ID NO: 186725 - DNA, 1746 bp, Homo sapiens
  Payload ID: 16768
  Gene Symbol: STAU2
  Gene Name: staufen double-stranded RNA binding protein 2
  ENST ID: ENST00000518981
  CDS Start-End: 32-1204
gttgcacagcggcggccggagcagacgcgggatggtcgcgcgtcccctgcacagcacagaggggcagccggagagcctgggaaagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatgtggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataataggaaatcataactaatggagtttttctgagaagaatcataaccaagaagaacgatctttattttacgagcaacattttaaccccacttaaataaactaaaaattgaagatgactcattatcctcacaagctccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggtatgaattaaaagcaaaaacaaaaaacaaaacaattcattagcctcagattcttcatctgtatacatcacaaggctcattcttgcctgctagtatggcctacatgccacttacgt

SEQ ID NO: 186726 - DNA, 972 bp, Homo sapiens
  Payload ID: 16768
  Gene Symbol: STAU2
  Gene Name: staufen double-stranded RNA binding protein 2
  ENST ID: ENST00000521419
  CDS Start-End: 308-685
ggggcggggagcccgaggggtggaagccggcggcggccgagcggggtcagttctctgtagtgtttgccaatgttggagccgtctgcaaagtgtccccggcaagaagtttttggagccgtgagggatacagcagtttggtcaatattgtcttaacatgcttcaaataaatcagattgaagaactcccttcaggatttcttgtagaacaagtctggtgttgatgaaatccttcggcttttgtttgtctgggaaagactttatctctccttcataattaaaggatattttcaccagatatactattctagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagagatggcaacacttgaatggattacagggactctggagccaaagatccaaggagatgtcttttccttgtcagaacccagattaatcattagcttcttaaggcagggaatgaaaggtgaagtccaagaaacagatgaagagttacctaagtcagtgttataagatgttccatggtaaaagggatttgaagacaaattttggaaatgctgcatactgtatctctcttgaagactcctaaaggtgtcatgaagaaaactgtttacctaagtggttcctaacactgactgaacatcaggctttcctgggcagctttaaaaattctgatgcccagactttatgtggactaattaaatcagaatttctggttgcaga

SEQ ID NO: 186727 - DNA, 550 bp, Homo sapiens
  Payload ID: 16768
  Gene Symbol: STAU2
  Gene Name: staufen double-stranded RNA binding protein 2
  ENST ID: ENST00000521736
  CDS Start-End: 360-550
agttctctgtagtgtttgccaatgttggagccgtctgcaaagtgtccccggcaagaagagacgattttgccgtgttcgccaggctagtctcgaactcctgacctcaggtgatccgtccgcctcagactccaaaagtgctgggattacaggcgtgagccaccacacccagctgaggaggtggattttatgaaaccaaagaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactcc

SEQ ID NO: 186728 - DNA, 1603 bp, Homo sapiens
  Payload ID: 16768
  Gene Symbol: STAU2
  Gene Name: staufen double-stranded RNA binding protein 2
  ENST ID: ENST00000523558
  CDS Start-End: 165-1361
agttctctgtagtgtttgccaatgttggagccgtctgcaaagtgtccccggcaagaaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatgtggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggcagccttaagtgccttgaaacaattttctgaacaaggactggatccaatcgatggagcaatgaatatcgaaaaaggttctcttgaaaaacaagccaagcatctgagagagaaagcggacaataaccaggcacccccgggctccatcgctcaggactgcaagaaatcaaactcggccgtctagcagctcccagaacccgcggctgccaccgcatccttataaacctgtcagcacgcatgagggtgtctgtgttcagggaaatgaatgactaataccattatttgagtcttatgtgaagacaacactattctaacacgagagataatatacatggtactgtttattcaactggggaaaaataaaactttgagcatttcccttggaactcgagatcagatcataactcatttgcctagaggcagcag

SEQ ID NO: 186729 - DNA, 3065 bp, Homo sapiens
  Payload ID: 16768
  Gene Symbol: STAU2
  Gene Name: staufen double-stranded RNA binding protein 2
  ENST ID: ENST00000524300
  CDS Start-End: 352-2064
agggcgcggcgggagcgccggggaggcgggcggaggcgggcggaggcggggggcggggagcccgaggggtggaagccggcggcggccgagcggggtcagttctctgtagtgtttgccaatgttggagccgtctgcaaagtgtccccggcaagaagaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcagcttctctccaagataaaatggcaaacccaaaagagaaaactgcaatgtgtctggtaaatgagttagcccgtttcaatagagtccaaccccagtataaacttctgaatgaaagagggcctgctcattcaaagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatgtggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggcagccttaagtgccttgaaacaattttctgaacaaggactggatccaatcgatggagcaatgaatatcgaaaaaggttctcttgaaaaacaagccaagcatctgagagagaaagcggacaataaccaggcacccccgggctccatcgctcaggactgcaagaaatcaaactcggccgtctagcagctcccagaacccgcggctgccaccgcatccttataaacctgtcagcacgcatgagggtgtctgtgttcagggaaatgaatgactaataccattatttgagtcttatgtgaagacaacactattctaacacgagagataatatacatggtactgtttattcaactggggaaaaataaaactttgagcatttcccttggaactcgagatcagatcataactcatttgcctagaggcagcagaaatctgatcctgctactggagcttaaaataacaagtaaagaaaagtgttagaaacaaagctaaaattttaacatgattaataatagagaagttgggtttggttctgttgttatgattgttttgtcgtggtgcttgtgttcagttatattctctctctctctcatttcaaatactgcttgacaattcgaaaatgaaccaatgatgtgctgtggaatgtgatggttgtcttcatatagagtcacatggtttctctttttatgcagatatttataatcttcatcctatatcagtaggaataactataaggtgcactacaaaaagatgtatgcaaacaaacatgttttaaatcaggtcagatatctgatgaaaaatacgaactaatgttaagagcaagtagtttcaacatactccaggaactgagaaacaaaacaaagcaattgtgggttttgagctccatatactcttagcaagtaagggggcgtcttgcccctatatatcatcttcccggattccactccctgttgtgggaatcgcgcccacccccatccgtgtgttgtagccactcacggtttgcatcaagagtgttttttgtaactgcctctggacttgggacagtgagtaggatcaaaaataaataatgtacatgacggggaagggaaaaacctgttggagttgcttccagccagccacgctccgggccagcatgttggaatccagcgtggagcagatgcagtaaaaatgtggttggtttctgtgtg

SEQ ID NO: 186730 - DNA, 727 bp, Homo sapiens
  Payload ID: 16768
  Gene Symbol: STAU2
  Gene Name: staufen double-stranded RNA binding protein 2
  ENST ID: ENST00000521447
  CDS Start-End: 116-727
agcggggtcagttctctgtagtgtttgccaatgttggagccgtctgcaaagtgtccccggcaagaagtttttggagccgtgagggatacagcagtttggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatgtggatgatgacaaagatgcaaataagtctgagatcagcttagtgtttgaaattgctctgaagcgaaatatgcctgtcagttttgaggttattaaagaaagtggaccaccacatatg

SEQ ID NO: 186731 - DNA, 1146 bp, Homo sapiens
  Payload ID: 16768
  Gene Symbol: STAU2
  Gene Name: staufen double-stranded RNA binding protein 2
  ENST ID: ENST00000518767
  CDS Start-End: 187-1146
acagcggcggccggagcagacgcgggatggtcgcgcgtcccctgcacagcacagaggggcagccggagagcctgggaaaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatgtggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttct

SEQ ID NO: 186732 - DNA, 1950 bp, Homo sapiens
  Payload ID: 16768
  Gene Symbol: STAU2
  Gene Name: staufen double-stranded RNA binding protein 2
  ENST ID: ENST00000521210
  CDS Start-End: 276-1790
agttctctgtagtgtttgccaatgttggagccgtctgcaaagtgtccccggcaagaagaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatgtggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggttcactactgtgatagacaaagtggcaaagagtgtgtgacctgtctgacattagcccctgtgcagatgactttccatgctattggaagctccattgaagccagccatgatcaggcagccttaagtgccttgaaacaattttctgaacaaggactggatccaatcgatggagcaatgaatatcgaaaaaggttctcttgaaaaacaagccaagcatctgagagagaaagcggacaataaccaggcacccccgggctccatcgctcaggactgcaagaaatcaaactcggccgtctagcagctcccagaacccgcggctgccaccgcatccttataaacctgtcagcacgcatgagggtgtctgtgttcagggaaatgaatgactaataccattatttgagtcttatgtgaagacaacactattctaacacgagagataatatacatggtactgttta

SEQ ID NO: 186733 - DNA, 3953 bp, Homo sapiens
  Payload ID: 16768
  Gene Symbol: STAU2
  Gene Name: staufen double-stranded RNA binding protein 2
  ENST ID: ENST00000521727
  CDS Start-End: 258-1733
ataaatctaggattcagggcattgttttcaatggttctcatttttggctccaaggattctttttcatgtgactaatattttcggtagaagaggaggtctggccacgccgcgggtcttggcgagcaggtgatcacggatccctggtgtttgctgggcgagacggtgaagcaacctcctccccgccccctcccccgtctagaaaggtgcaagatccgctaaaccgtgcgttgcacagcggcggccggagcagacgcgggatggtcgcgcgtcccctgcacagcacagaggggcagccggagagcctgggaaagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatgtggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggtatgaattaaaagcaaaaacaaaaaacaaaacaattcattagcctcagattcttcatctgtatacatcacaaggctcattcttgcctgctagtatggcctacatgccacttacgttttaagttatttaggaacacaaaggacagacaaaaaagccatatgcacatgcctcattttctcttatttttgatctatctagtaattcttttgctgcctgtctcttctccattttccttcttcttttttaagcatttttcatattcttcactgtcttctatttggtcttgattaggtgcatctatctcttcgctctgtcttccacaaacaaaaattctgccttcagacatttggtgttagtatttcacactcagttctccctttttttacataaggattgagtttctttttatgatgattttacctttatagcaattttgaattttgcattctattgctagtattgattcaggtacaccattaagatacaacattctagaagtctattaccttaggagttaattaaacatgatatttgaagaataatgaaatgctttatagttgtttgaggcataacaatgtgtatttgttttactggatcatgttttgaactgactagggagggtagcacctgcctcagatagtaccaacaattctgtttcactgggtagtctaaaactagcttatagtttaacttaacttgttgtgtatgtgaatttagggatggaaactttttttcccctatttattctttgtttccttctgggaaaaaaccccacaaaaatcagcactcctttatggatacattggagcttttgaaagaattgtaaactctaggaaggggaaatatctgtgtcttgatttcttagttgccttgaaaatcatgtactgaactgtaaccgctaacttgactggatgaactagtttgcttgtgtgtagagagtgtattgcttcctcagatttcactgttttcatctccttttccatcttagtctttattccttaagaccaaaaactgtaatatcctttagaaatgctctagaagatctgtattgtgtagaatgatcatgtatttataaatattttacaagtttagattataaaatgaaaaagaaggtcatgtgttttggggggtattttgcatgttcggatttttttttcacttcaccgaacccttctgattctttcaaactattgccaggtagttgttagtgtttctaattggactcttaatatgaacttcaagaagctgttaccagttatcggctctgtcatctgaaattttaaccacttaatttaaagttacaattttagaatttgtttttgttgttttaccttaagaaacacaataaatcactgtttaaaaaagatctcaatttatataaagtactggaaaaaagctaagtaatttttagttctatctataatctccgtaggatgaattagaaataaattgtgatgaaaagaaattaactgcttatttatgaatctaatcatttagaaatgtctgagagtaacactgcattcttatagaaacaaagcacaaattgcattcaagctctgaattgattttttgcttggagctgttgttacagtagctgtaattttgctaccagaatgtcttaattttttaaatttgtttttatttctaagctcttggcaatgacaataattataattttaacatatcttcactgtagtcaacatgtagagtctgcttccctcattattgcattgctaaggcctttttaaaaagcttatgcttacataatatactcttttttatggacacgttatatgtttccaaatctgtgtattgtgatttttacatactaatgaatataaacaggtgattttaaaatattactgtgcttctttggttgaatgagctggtattgatgtaaaatactctgtcattgatggaccactacctgcagctaagcagtgagcagaatctccgggaaatgacttagtctggccacatgcatagcccatcttcataatgtcgcagcagaaggttctttgtggttaaaagttttaaagcctatttctttataggtaaccctctcaggtatatttacctggtagaaaaacatgtagattgtttctattacttaaatgttttaattggactgtagtttagaaattacaggaccagcttgttacagattatacactattctgttacttttatttctgaaacttaaaaacaataaattctttttctgtg

SEQ ID NO: 186734 - DNA, 805 bp, Homo sapiens
  Payload ID: 16768
  Gene Symbol: STAU2
  Gene Name: staufen double-stranded RNA binding protein 2
  ENST ID: ENST00000523533
  CDS Start-End: 1-489
acaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggttcactactgtgatagacaaagtggcaaagagtgtgtgacctgtctgacattagcccctgtgcagatgactttccatgctattggaagctccattgaagccagccatgatcaggtataatatgccactgccattttgctgtgttatggcccagctcggaaatggaaggccatcaaaatggaagctatgtgcgcacatgcagctttgctttccttaatacattatctgctagcaccatctgctagacttgaaaaatcaaaattgtttgtgttgggaaattgatatcatagtagatttaaattattttagacttcttgtttgcagttcattattattttaaatatggaattattttatatgaaaaatagttgtcccacaggttatttttatctttaatagttatatatgagaggaagggtcaacaaaacaatataga

SEQ ID NO: 186735 - DNA, 2173 bp, Homo sapiens
  Payload ID: 16768
  Gene Symbol: STAU2
  Gene Name: staufen double-stranded RNA binding protein 2
  Uniprot ID: Q9NUL3
  ENST ID: ENST00000524104
  CDS Start-End: 220-537
agttctctgtagtgtttgccaatgttggagccgtctgcaaagtgtccccggcaagaagaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagagatgaagagttacctaagtcagtgttataagatgttccatggtaaaagggatttgaagacaaattttggaaatgctgcatactgtatctctcttgaagactcctaaaggtgtcatgaagaaaactgtttacctaagtggttcctaacactgactgaacatcaggctttcctgggcagctttaaaaattctgatgcccagactttatgtggactaattaaatcagaatttctggttgcagagcttgaaccgcactgttttttaaaacttccccaagtaattctatgtccagtcatttaaatactggtccccacaacccaaaacacattaccctctattaacatcaaagattatgagatggtttgaatagtcatagaacttttgaaagaagtaaagaagaagggaagaattacagttaaccacactccttaaggataattgttctggacagctagcttccccacattgctgagggttcacttttttttggaacctaaaactttacttagttcagtaattttggatagaaatatttctaaaagttatggcatatattttttatatccttaaatagaaaatgccacaattcttagcatgaagaatccttgctgttgactcattatcaaccttataaacaataagtattacaagcctcatgagatatgtacatggtttgtccttataccagataatcctagacatctgtttctagagtacccaagtgtgcttttagttactttccaaatcattgttgtcagtcagattgtcatcttatttcttgtttttgtcagtgcacctttgcatattgcttgctcctttctttgatgcttttcaattgctattatcttgaaaaccgatattattgtttgaatttggggcaaagtaagagtagcagggctttaattacgccctaagatgtccccttaactgtggaaaacatcgagttttatctagttggtgaatttttttacttcagaatttatttttttctgtcataaattttgctaaggatctgcattttgagtagaatgaagtggccagatagttgaataatggtttggtgaatatctatatgtatatatgtatgtgtatgtgtgttacacatacatatttaatgacatgaagtactttggttgcttggaattggacagaaataacagtttttttttttttttgggacagagtcttgctctgtcacctaggctggagtgcaatggcgcgatctctgctcactgcaacttccacctcccaggttcaagtgattctcctgccgcagcctcccgagtagctgggattgcaggcgcctgccagcatgcccgccagcacgcctggctaatttttttttttgtatttttagtagagatggggtttcactatgttggccaggctggtcttggaactcctgatctcgtgatctgtgtgccttggcctcccaaagtgctgggattacaggcgtgagccaccgcgcctggccagaaataacagttttaataaatttcatgaaatcactttcttgtatgttaaaggaaacagaaagggttcatttgtgcatggtttagtctttcttttgaatgtggaagtttttcttcttatttgtgtgtctaaaaaaattaaaaagtgaaacattttccaaaatgagaaga

SEQ ID NO: 186736 - DNA, 3928 bp, Homo sapiens
  Payload ID: 16768
  Gene Symbol: STAU2
  Gene Name: staufen double-stranded RNA binding protein 2
  ENST ID: ENST00000519961
  CDS Start-End: 79-1614
ggagccgtgagggatacagcagtttggtcaatattgtcttaacatgcttcaaataaatcagcttctctccaagataaaatggcaaacccaaaagagaaaactgcaatgtgtctggtaaatgagttagcccgtttcaatagagtccaaccccagtataaacttctgaatgaaagagggcctgctcattcaaagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatgtggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggtatgaattaaaagcaaaaacaaaaaacaaaacaattcattagcctcagattcttcatctgtatacatcacaaggctcattcttgcctgctagtatggcctacatgccacttacgttttaagttatttaggaacacaaaggacagacaaaaaagccatatgcacatgcctcattttctcttatttttgatctatctagtaattcttttgctgcctgtctcttctccattttccttcttcttttttaagcatttttcatattcttcactgtcttctatttggtcttgattaggtgcatctatctcttcgctctgtcttccacaaacaaaaattctgccttcagacatttggtgttagtatttcacactcagttctccctttttttacataaggattgagtttctttttatgatgattttacctttatagcaattttgaattttgcattctattgctagtattgattcaggtacaccattaagatacaacattctagaagtctattaccttaggagttaattaaacatgatatttgaagaataatgaaatgctttatagttgtttgaggcataacaatgtgtatttgttttactggatcatgttttgaactgactagggagggtagcacctgcctcagatagtaccaacaattctgtttcactgggtagtctaaaactagcttatagtttaacttaacttgttgtgtatgtgaatttagggatggaaactttttttcccctatttattctttgtttccttctgggaaaaaaccccacaaaaatcagcactcctttatggatacattggagcttttgaaagaattgtaaactctaggaaggggaaatatctgtgtcttgatttcttagttgccttgaaaatcatgtactgaactgtaaccgctaacttgactggatgaactagtttgcttgtgtgtagagagtgtattgcttcctcagatttcactgttttcatctccttttccatcttagtctttattccttaagaccaaaaactgtaatatcctttagaaatgctctagaagatctgtattgtgtagaatgatcatgtatttataaatattttacaagtttagattataaaatgaaaaagaaggtcatgtgttttggggggtattttgcatgttcggatttttttttcacttcaccgaacccttctgattctttcaaactattgccaggtagttgttagtgtttctaattggactcttaatatgaacttcaagaagctgttaccagttatcggctctgtcatctgaaattttaaccacttaatttaaagttacaattttagaatttgtttttgttgttttaccttaagaaacacaataaatcactgtttaaaaaagatctcaatttatataaagtactggaaaaaagctaagtaatttttagttctatctataatctccgtaggatgaattagaaataaattgtgatgaaaagaaattaactgcttatttatgaatctaatcatttagaaatgtctgagagtaacactgcattcttatagaaacaaagcacaaattgcattcaagctctgaattgattttttgcttggagctgttgttacagtagctgtaattttgctaccagaatgtcttaattttttaaatttgtttttatttctaagctcttggcaatgacaataattataattttaacatatcttcactgtagtcaacatgtagagtctgcttccctcattattgcattgctaaggcctttttaaaaagcttatgcttacataatatactcttttttatggacacgttatatgtttccaaatctgtgtattgtgatttttacatactaatgaatataaacaggtgattttaaaatattactgtgcttctttggttgaatgagctggtattgatgtaaaatactctgtcattgatggaccactacctgcagctaagcagtgagcagaatctccgggaaatgacttagtctggccacatgcatagcccatcttcataatgtcgcagcagaaggttctttgtggttaaaagttttaaagcctatttctttataggtaaccctctcaggtatatttacctggtagaaaaacatgtagattgtttctattacttaaatgttttaattggactgtagtttagaaattacaggaccagcttgttacagattatacactattctgttacttttatttctgaaacttaaaaacaataaattctttttctgtgtttctaggttagaacttttttattttattgcacactgaacagatactgttgcttattgaatattgtgtaaacccttctttggctttccttgccc

SEQ ID NO: 186737 - DNA, 1695 bp, Homo sapiens
  Payload ID: 16768
  Gene Symbol: STAU2
  Gene Name: staufen double-stranded RNA binding protein 2
  ENST ID: ENST00000517542
  CDS Start-End: 98-1519
agcccgaggggtggaagccggcggcggccgagcggggtcagttctctgtagtgtttgccaatgttggagccgtctgcaaagtgtccccggcaagaagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatgtggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggtatgaattaaaagcaaaaacaaaaaacaaaacaattcattagcctcagattcttcatctgtatacatcacaaggctcattcttgcctgctagtatggcctacatgccacttacgttttaagttatttaggaacacaaaggacagacaaaaaagccatatgcacatgcctcattttctctta

SEQ ID NO: 186738 - DNA, 7673 bp, Homo sapiens
  Payload ID: 16769
  Gene Symbol: SLK
  Gene Name: STE20-like kinase
  Uniprot ID: Q9H2G2
  ENST ID: ENST00000335753
  CDS Start-End: 546-4160
gcggcggcggcgccccagacccgaggggacgcgcgggccttgcgccgcgggagcggacggcggcggaggagaccctaggctcgcggcccgaggcgggagggctcggcttctcgactgcccgcctccgaggccgccggccgcttctctctcccagagtggccgccgcccctggagactcgccgtgacacgggcctaagccgccgccgcgggagtcctgaccgctcggacccgtcggatcaggccgggtgggagcgagcttgcgggcaggtgccgctcccggagggtgggccggaggcgaggcgcccaccgcgcggctcgcgggccgggctcggcggaggggccgctcgcgcagcacccccaccgcgggccggagcccgggtcgccgccccgccttctcccgggaccgcccggccggagctgcgggggccgagggacgccgcgcccgccgccgccagccgggctcgcgcgggagagcagggaagagaaactttgccttttattgtttttagtccttaagtgcaaggaactctgtgttgggaggaaaaatgtccttcttcaatttccgtaagatcttcaagttggggagcgagaagaagaagaagcagtacgaacacgtgaagagggacctgaaccccgaagacttttgggagattataggagaactgggcgacggagcctttgggaaagtgtacaaggcccagaataaagagaccagtgttttagctgctgcaaaagtgattgacactaaatctgaagaagaacttgaagattacatggtagagattgacatattagcatcttgtgatcacccaaatatagtcaagcttctagatgccttctattatgagaacaatctttggatcctcattgaattttgtgcaggtggagcagtagatgctgtgatgcttgaacttgagagaccattaactgagtcccaaatacaagtagtttgcaagcagactttagatgcattgaactacttacatgataataagatcatccacagagatctgaaggctggcaacattctctttaccttagatggagatatcaaattggcggattttggagtatcagctaaaaacacgaggacaattcaaagaagagattcctttattggtacaccatattggatggctcctgaagtagtcatgtgtgaaacatctaaggacagaccctatgactacaaagctgatgtttggtccctgggtatcactttaatagaaatggctgagatagaaccacctcatcatgaattaaatccaatgcgagtgctgctaaaaatagcaaaatctgagccacctacattagcacagccatccagatggtcttcaaattttaaggactttctaaagaaatgcttagaaaagaatgtggatgccaggtggactacatctcagctgctgcagcatccctttgttactgttgattccaacaaacccatccgagaattgattgcagaggcgaaggctgaagtaacagaagaagttgaagatggcaaagaggaagatgaagaggaggaaacagaaaattctctgccaatacctgcaagtaagcgtgcatcttctgaccttagtatcgccagctctgaagaagataaactttcacaaaatgcttgtattttggagtctgtctcagaaaaaacagaacgtagtaactctgaagataaactcaacagcaaaattcttaatgaaaaacccaccactgatgaacctgaaaaggctgtggaggatattaatgaacatattaccgatgctcagttagaagcaatgactgaactccatgacagaacagcagtaatcaaggagaatgaaagagagaagaggcccaagcttgaaaatctgcctgacacagaagaccaagaaactgtggacattaattcagtcagtgaaggaaaagagaataatataatgataaccttagaaacaaatattgaacataatctaaaatctgaggaagaaaaggatcaggaaaagcaacagatgtttgaaaataagcttataaaatctgaagaaattaaagatactattttgcaaacagtagatttagtttctcaagagactggagaaaaagaggcaaatattcaggcagttgatagtgaagttgggcttacaaaggaagacacccaagagaaattgggggaagacgacaaaactcaaaaagatgtgatcagcaatacaagtgatgtgataggaacatgtgaggcagcagatgtggctcagaaagtggatgaagacagtgctgaggatacgcagagtaatgatgggaaagaagtggtcgaagtaggccagaaattaattaataagcccatggtgggtcctgaggctggtggtactaaggaagttcctattaaagaaatagttgaaatgaatgaaatagaagaaggtaaaaataaggaacaagcaataaacagttcagagaacataatggacatcaatgaggaaccaggaacaactgaaggtgaagaaatcactgagtcaagtagcactgaagaaatggaggtcagaagtgtggtggctgatactgaccaaaaggctttaggaagtgaagttcaggatgcttctaaagtcactactcagatagataaagagaaaaaagaaattccagtgtcaattaaaaaagagcctgaagttactgtagtttcacagcccactgaacctcagcctgttctaatacccagtattaatatcaactctgacagtggagaaaataaagaagaaataggttctttatcaaaaactgaaactattctgccaccagaatctgagaatccaaaggaaaatgataatgattcaggcactggttccactgctgatactagcagtattgacttgaatttatccatctctagctttctaagtaaaactaaagacagtggatcgatatctttacaagaaacaagaagacaaaagaaaacattgaagaaaacacgcaaatttattgttgatggtgtagaagtgagtgtaacaacatcaaagatagttacagatagtgattccaaaactgaagaattgcggtttcttagacgtcaggaacttcgggaattaagatttcttcagaaagaagagcaaagagcccaacaacagctcaatagcaaactacagcaacaacgagaacaaattttccggcgctttgagcaggaaatgatgagtaaaaagcgacaatatgaccaggaaattgagaatctagaaaaacagcagaaacagactatcgaacgcctggaacaagagcacacaaatcgcttgcgagatgaagccaaacgcatcaaaggagaacaagagaaagagttgtccaaatttcagaatatgctgaagaaccgaaagaaggaggaacaagagtttgttcagaaacaacagcaagaattagatggctctctgaaaaagatcatccagcagcagaaggcagagttagctaatattgagagagagtgcctgaataacaagcaacagctcatgagagctcgagaagctgcaatttgggagctcgaagaacgacacttacaagaaaaacaccagctgctcaaacagcagcttaaagatcagtatttcatgcaaagacatcagctacttaagcgccacgagaaggaaacagagcaaatgcagcgttacaatcaaagacttattgaggaattgaaaaacagacagactcaagaaagagcaagactgcccaagattcagcgcagtgaagccaagactcgaatggccatgtttaagaagagtttgagaattaactcaacagccacaccagatcaggaccgtgataaaattaaacagtttgctgcacaagaagaaaagaggcagaaaaatgagagaatggctcagcatcagaaacatgagaatcaaatgcgagatcttcagttgcagtgtgaagccaatgtccgcgaactgcatcagctgcagaatgaaaaatgccacttgttggttgagcatgagactcagaaactgaaggagttagatgaggaacatagccaagaattaaaggagtggagagagaaattgagacctaggaaaaagacactggaagaagagtttgccaggaaactacaggaacaggaagtattctttaaaatgactggggagtctgaatgccttaacccatcaacacagagccggatttccaaattttatcctattcccagcttgcattccaccggatcataacaaagggaagcattctgtgcgtgggtttggctctttcagtatgtcattctgttctcatcttctgccacagtctctcagatagctcatgaagacaatcacctgcctcaccttctaggtgttttccttttttgttttttttgttttgttttgtttttaagcaaagatgaagggaaaacgaactaagacagacgctaggccatgttggcaaagtagcatcttggtgactaaggtgactttgtatattcatcttaaaaattatgttctttagacactgctacctgaaaactgttggagaaataatgtttaaagttatttaagaaaaactgttacatcactaagtattaataaattcttcttacctgacgtaacttctcaatgcctaaattctgtagttgaagctctgctgcagagagttgggataattttcttttggtggatcagctctcataaaaaagctatgatttgctcaaatatgctgttgactcagtaaatgaatatatttttttctttaaataggaacaacctcttttaaaagagaaaaattatttcagtgatttgtcaaaacgaattacctcttttggcatgagctaataattgagggtgctaattttcttaagatagtgcctaaaacactaaatttcagtcaagtcgtaagtaggattttctttttgatcaacagggacaaaaacatctttagaattaaaaacatggttgttttggaatttttgcttctcttaccgtttgatagaaattttcatcctaaaatacatgtacaaagtttggaaagatgaaaaaaagaggtagcttttagattgcaaactggaaatgtaaaactcatgaaatttaagcaatataggtttagctatctgtgtttattttctaaaataatacctgagctggttaaatgatttctctccatcttagctaattctgtttaaaactctgtcagaggcctgcaggctgtgagttatatttataaatatatcttcagaaattaatcttaaaagaggcattagttcagaatacttttttaaaagtttaaattaaatatttaggcacgtcaggaattacttttccttattttgaaatgaggctacttatgtcttggttttattttgttccatgtttaaatcattcactttgatttgagtgggaaaagcctgaagcctttatcatgtggttgctggtgtgtgtaattattaatgaaatgttcactcctagtcccttatgaggcttagaatttcaaccacgtgtcaggtcagacagtattataaactgtactttgctgtctgagacagcacatttgtgaatgatgcttgctgcctgccattttcaacctattctctcttaagagtgctaggtaccaaattgtgaaagtttgttttcagttatattacttttgaggctggtgaaaaatttaaatgtaactttgtgggaacactgattcatatttagaaaatgtaaatgtctgtagcactttcttgcagttaatttgaaaactttggatgctgaaccttgtttgtcagtgatttagatgatttaaaaatgcatgtgtgatttgaattttataattgttttgacaagcataatttacttggacaacttcgtaggtagccttaacttctggccaagtttgttttttatataaatatatatacatatatacatattatgtatggttgtaaattcatacacttatcacatgaatgtgttactgtatacaaaactcttaatgctttattctcaaatgctgggttgaaaaatgttttgaaagccttttaaaatatatatctttataaagtaatattcaggatgatgataaaaattgtttatattgttatgataaaaatgacagtataatgttgcccagtgtatttaatgatttatttgaagagggattgggaaggaacgtcttcataccactttctcctttgaaattttcagtttattgacttttaaaaaatgaatacctcaggcagtagacattttttttctagtatcatttaattgataccctgtgcgctaaatagtgtgtggtgcctgattaatttggtctgaatatttgattctttctgttcctttcaacttgacattcagattattgactcaaggagagaggctcagagtggaatggttggcgctgtgggtaaggttggatctcccttaaaactgccttttggattcagtgtttgtgcttgagttcgctttcaaatatgaccataatcgtgtgggtgcaagactgtacagtgatacatatgtagaggtaaagcattcattttaatacttaaagttatataaatcttttcaaaaagtgttttgttataaaatacgctgtttgtacccataccagcccacctcttctgaggccctgtattcaaatagatgatagtgatctatctttcctgcatgaagtgtaggtggcgagtgggcgaggggcgcagacttctttgaaatcgaagggtacagtcaaatctactgctgatttggttgttttgttgctgtggcagaatatgccatgaaacacatacagacttctccgaacgtgcaccctcatcagccacctcctcccctctttccctgagtgctgtgaacacagcagacctgcacacttctgcagatccagctcctacagcttggggcactaggctgcctttcctagtcctgtcaacaaccatacagtgcgaattgctgaattagctgctattctatgtggagtcacattaagctttttcttatctttttctatggggaagctatagggtgggtaaggaaaaaatgttgaatgcttttactttgctgaaaatattagaactctcttgtgacaggatacagcaaattataattaaatataaattaccagaaccagagctacctctaagtcatacttcctcaagcacaaagctctcaggcatatgagacccaccttaatgaagggtctctgatttcttgagcatcagcgagtttcagaagtgactatttttttgtactcttctagtttccttgtaactatacactttttcccattccacactgtgcttaaatgacaaagactcttctgagaagccaaattctgtccaagtattaactagagatattgttgattaaagaaaatctagaactgaagtgaaagaagagagttccagttctaatagtcttttgattaacaattcttttctgagaaatgatttttataagaaatggggtgattctttaaatgcttttcttaagttgaaggcacaacagttaatggctgtattgttgctattccgttgctgacatgtttttgataaagctttaacattcctgctactaattttggcggagagtgtttgccaggtttcaatgtgggctgcagctttttgtgctccttctctggtttgcagtgtaatgagttcataagctaaattttcagaaagaattttgtttaagattatgcctcttatctacttgagagcaacatgtcttttcaatcatgggattgacacatgaaaaataaagttatttcttaatcaa

SEQ ID NO: 186739 - DNA, 7766 bp, Homo sapiens
  Payload ID: 16769
  Gene Symbol: SLK
  Gene Name: STE20-like kinase
  Uniprot ID: Q9H2G2
  ENST ID: ENST00000369755
  CDS Start-End: 546-4253
gcggcggcggcgccccagacccgaggggacgcgcgggccttgcgccgcgggagcggacggcggcggaggagaccctaggctcgcggcccgaggcgggagggctcggcttctcgactgcccgcctccgaggccgccggccgcttctctctcccagagtggccgccgcccctggagactcgccgtgacacgggcctaagccgccgccgcgggagtcctgaccgctcggacccgtcggatcaggccgggtgggagcgagcttgcgggcaggtgccgctcccggagggtgggccggaggcgaggcgcccaccgcgcggctcgcgggccgggctcggcggaggggccgctcgcgcagcacccccaccgcgggccggagcccgggtcgccgccccgccttctcccgggaccgcccggccggagctgcgggggccgagggacgccgcgcccgccgccgccagccgggctcgcgcgggagagcagggaagagaaactttgccttttattgtttttagtccttaagtgcaaggaactctgtgttgggaggaaaaatgtccttcttcaatttccgtaagatcttcaagttggggagcgagaagaagaagaagcagtacgaacacgtgaagagggacctgaaccccgaagacttttgggagattataggagaactgggcgacggagcctttgggaaagtgtacaaggcccagaataaagagaccagtgttttagctgctgcaaaagtgattgacactaaatctgaagaagaacttgaagattacatggtagagattgacatattagcatcttgtgatcacccaaatatagtcaagcttctagatgccttctattatgagaacaatctttggatcctcattgaattttgtgcaggtggagcagtagatgctgtgatgcttgaacttgagagaccattaactgagtcccaaatacaagtagtttgcaagcagactttagatgcattgaactacttacatgataataagatcatccacagagatctgaaggctggcaacattctctttaccttagatggagatatcaaattggcggattttggagtatcagctaaaaacacgaggacaattcaaagaagagattcctttattggtacaccatattggatggctcctgaagtagtcatgtgtgaaacatctaaggacagaccctatgactacaaagctgatgtttggtccctgggtatcactttaatagaaatggctgagatagaaccacctcatcatgaattaaatccaatgcgagtgctgctaaaaatagcaaaatctgagccacctacattagcacagccatccagatggtcttcaaattttaaggactttctaaagaaatgcttagaaaagaatgtggatgccaggtggactacatctcagctgctgcagcatccctttgttactgttgattccaacaaacccatccgagaattgattgcagaggcgaaggctgaagtaacagaagaagttgaagatggcaaagaggaagatgaagaggaggaaacagaaaattctctgccaatacctgcaagtaagcgtgcatcttctgaccttagtatcgccagctctgaagaagataaactttcacaaaatgcttgtattttggagtctgtctcagaaaaaacagaacgtagtaactctgaagataaactcaacagcaaaattcttaatgaaaaacccaccactgatgaacctgaaaaggctgtggaggatattaatgaacatattaccgatgctcagttagaagcaatgactgaactccatgacagaacagcagtaatcaaggagaatgaaagagagaagaggcccaagcttgaaaatctgcctgacacagaagaccaagaaactgtggacattaattcagtcagtgaaggaaaagagaataatataatgataaccttagaaacaaatattgaacataatctaaaatctgaggaagaaaaggatcaggaaaagcaacagatgtttgaaaataagcttataaaatctgaagaaattaaagatactattttgcaaacagtagatttagtttctcaagagactggagaaaaagaggcaaatattcaggcagttgatagtgaagttgggcttacaaaggaagacacccaagagaaattgggggaagacgacaaaactcaaaaagatgtgatcagcaatacaagtgatgtgataggaacatgtgaggcagcagatgtggctcagaaagtggatgaagacagtgctgaggatacgcagagtaatgatgggaaagaagtggtcgaagtaggccagaaattaattaataagcccatggtgggtcctgaggctggtggtactaaggaagttcctattaaagaaatagttgaaatgaatgaaatagaagaaggtaaaaataaggaacaagcaataaacagttcagagaacataatggacatcaatgaggaaccaggaacaactgaaggtgaagaaatcactgagtcaagtagcactgaagaaatggaggtcagaagtgtggtggctgatactgaccaaaaggctttaggaagtgaagttcaggatgcttctaaagtcactactcagatagataaagagaaaaaagaaattccagtgtcaattaaaaaagagcctgaagttactgtagtttcacagcccactgaacctcagcctgttctaatacccagtattaatatcaactctgacagtggagaaaataaagaagaaataggttctttatcaaaaactgaaactattctgccaccagaatctgagaatccaaaggaaaatgataatgattcaggcactggttccactgctgatactagcagtattgacttgaatttatccatctctagctttctaagtaaaactaaagacagtggatcgatatctttacaagaaacaagaagacaaaagaaaacattgaagaaaacacgcaaatttattgttgatggtgtagaagtgagtgtaacaacatcaaagatagttacagatagtgattccaaaactgaagaattgcggtttcttagacgtcaggaacttcgggaattaagatttcttcagaaagaagagcaaagagcccaacaacagctcaatagcaaactacagcaacaacgagaacaaattttccggcgctttgagcaggaaatgatgagtaaaaagcgacaatatgaccaggaaattgagaatctagaaaaacagcagaaacagactatcgaacgcctggaacaagagcacacaaatcgcttgcgagatgaagccaaacgcatcaaaggagaacaagagaaagagttgtccaaatttcagaatatgctgaagaaccgaaagaaggaggttataaatgaagtggagaaagcacccaaagagctgagaaaagagctcatgaaacgcaggaaagaggagcttgcacaaagccagcatgctcaggaacaagagtttgttcagaaacaacagcaagaattagatggctctctgaaaaagatcatccagcagcagaaggcagagttagctaatattgagagagagtgcctgaataacaagcaacagctcatgagagctcgagaagctgcaatttgggagctcgaagaacgacacttacaagaaaaacaccagctgctcaaacagcagcttaaagatcagtatttcatgcaaagacatcagctacttaagcgccacgagaaggaaacagagcaaatgcagcgttacaatcaaagacttattgaggaattgaaaaacagacagactcaagaaagagcaagactgcccaagattcagcgcagtgaagccaagactcgaatggccatgtttaagaagagtttgagaattaactcaacagccacaccagatcaggaccgtgataaaattaaacagtttgctgcacaagaagaaaagaggcagaaaaatgagagaatggctcagcatcagaaacatgagaatcaaatgcgagatcttcagttgcagtgtgaagccaatgtccgcgaactgcatcagctgcagaatgaaaaatgccacttgttggttgagcatgagactcagaaactgaaggagttagatgaggaacatagccaagaattaaaggagtggagagagaaattgagacctaggaaaaagacactggaagaagagtttgccaggaaactacaggaacaggaagtattctttaaaatgactggggagtctgaatgccttaacccatcaacacagagccggatttccaaattttatcctattcccagcttgcattccaccggatcataacaaagggaagcattctgtgcgtgggtttggctctttcagtatgtcattctgttctcatcttctgccacagtctctcagatagctcatgaagacaatcacctgcctcaccttctaggtgttttccttttttgttttttttgttttgttttgtttttaagcaaagatgaagggaaaacgaactaagacagacgctaggccatgttggcaaagtagcatcttggtgactaaggtgactttgtatattcatcttaaaaattatgttctttagacactgctacctgaaaactgttggagaaataatgtttaaagttatttaagaaaaactgttacatcactaagtattaataaattcttcttacctgacgtaacttctcaatgcctaaattctgtagttgaagctctgctgcagagagttgggataattttcttttggtggatcagctctcataaaaaagctatgatttgctcaaatatgctgttgactcagtaaatgaatatatttttttctttaaataggaacaacctcttttaaaagagaaaaattatttcagtgatttgtcaaaacgaattacctcttttggcatgagctaataattgagggtgctaattttcttaagatagtgcctaaaacactaaatttcagtcaagtcgtaagtaggattttctttttgatcaacagggacaaaaacatctttagaattaaaaacatggttgttttggaatttttgcttctcttaccgtttgatagaaattttcatcctaaaatacatgtacaaagtttggaaagatgaaaaaaagaggtagcttttagattgcaaactggaaatgtaaaactcatgaaatttaagcaatataggtttagctatctgtgtttattttctaaaataatacctgagctggttaaatgatttctctccatcttagctaattctgtttaaaactctgtcagaggcctgcaggctgtgagttatatttataaatatatcttcagaaattaatcttaaaagaggcattagttcagaatacttttttaaaagtttaaattaaatatttaggcacgtcaggaattacttttccttattttgaaatgaggctacttatgtcttggttttattttgttccatgtttaaatcattcactttgatttgagtgggaaaagcctgaagcctttatcatgtggttgctggtgtgtgtaattattaatgaaatgttcactcctagtcccttatgaggcttagaatttcaaccacgtgtcaggtcagacagtattataaactgtactttgctgtctgagacagcacatttgtgaatgatgcttgctgcctgccattttcaacctattctctcttaagagtgctaggtaccaaattgtgaaagtttgttttcagttatattacttttgaggctggtgaaaaatttaaatgtaactttgtgggaacactgattcatatttagaaaatgtaaatgtctgtagcactttcttgcagttaatttgaaaactttggatgctgaaccttgtttgtcagtgatttagatgatttaaaaatgcatgtgtgatttgaattttataattgttttgacaagcataatttacttggacaacttcgtaggtagccttaacttctggccaagtttgttttttatataaatatatatacatatatacatattatgtatggttgtaaattcatacacttatcacatgaatgtgttactgtatacaaaactcttaatgctttattctcaaatgctgggttgaaaaatgttttgaaagccttttaaaatatatatctttataaagtaatattcaggatgatgataaaaattgtttatattgttatgataaaaatgacagtataatgttgcccagtgtatttaatgatttatttgaagagggattgggaaggaacgtcttcataccactttctcctttgaaattttcagtttattgacttttaaaaaatgaatacctcaggcagtagacattttttttctagtatcatttaattgataccctgtgcgctaaatagtgtgtggtgcctgattaatttggtctgaatatttgattctttctgttcctttcaacttgacattcagattattgactcaaggagagaggctcagagtggaatggttggcgctgtgggtaaggttggatctcccttaaaactgccttttggattcagtgtttgtgcttgagttcgctttcaaatatgaccataatcgtgtgggtgcaagactgtacagtgatacatatgtagaggtaaagcattcattttaatacttaaagttatataaatcttttcaaaaagtgttttgttataaaatacgctgtttgtacccataccagcccacctcttctgaggccctgtattcaaatagatgatagtgatctatctttcctgcatgaagtgtaggtggcgagtgggcgaggggcgcagacttctttgaaatcgaagggtacagtcaaatctactgctgatttggttgttttgttgctgtggcagaatatgccatgaaacacatacagacttctccgaacgtgcaccctcatcagccacctcctcccctctttccctgagtgctgtgaacacagcagacctgcacacttctgcagatccagctcctacagcttggggcactaggctgcctttcctagtcctgtcaacaaccatacagtgcgaattgctgaattagctgctattctatgtggagtcacattaagctttttcttatctttttctatggggaagctatagggtgggtaaggaaaaaatgttgaatgcttttactttgctgaaaatattagaactctcttgtgacaggatacagcaaattataattaaatataaattaccagaaccagagctacctctaagtcatacttcctcaagcacaaagctctcaggcatatgagacccaccttaatgaagggtctctgatttcttgagcatcagcgagtttcagaagtgactatttttttgtactcttctagtttccttgtaactatacactttttcccattccacactgtgcttaaatgacaaagactcttctgagaagccaaattctgtccaagtattaactagagatattgttgattaaagaaaatctagaactgaagtgaaagaagagagttccagttctaatagtcttttgattaacaattcttttctgagaaatgatttttataagaaatggggtgattctttaaatgcttttcttaagttgaaggcacaacagttaatggctgtattgttgctattccgttgctgacatgtttttgataaagctttaacattcctgctactaattttggcggagagtgtttgccaggtttcaatgtgggctgcagctttttgtgctccttctctggtttgcagtgtaatgagttcataagctaaattttcagaaagaattttgtttaagattatgcctcttatctacttgagagcaacatgtcttttcaatcatgggattgacacatgaaaaataaagttatttcttaatcaa

SEQ ID NO: 186740 - DNA, 2962 bp, Homo sapiens
  Payload ID: 16770
  Gene Symbol: STRADA
  Gene Name: STE20-related kinase adaptor alpha
  ENST ID: ENST00000245865
  CDS Start-End: 211-915
gcttgctaactccaggaacaggtttaagtttttgaaactgaagtaggcctacacagtaggaactcatgtcatttcttgtaagtaaaccagagcgaatcaggcggtgggtctcggaaaagttcattgttgagggcttaagagatttggaactatttggagaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagggttatgatgccaagtctgacatctacagtgtgggaatcacagcctgtgaactggccaacggccatgtcccctttaaggatatgcctgccacccagggtgaagactctacggtaaaaggaatttgatgccttggaaagggagagcggaaactgtgagccctgctttccagccatggcgaaagcgggtacttttgtgcaacccctctcctttcacgttggcctggctagggcggagctgccacgccagtgaccagcgtttctttgggaaaattggacttactccacttccaccttttccactcttcaaatgatcacatttgcatattgggaacagtgtatttgtgaagagactctcaggccttccagggaccaccccccccccccacccgctacagcccaggtcctggttctgtcctccccagatgctgctagagaaactgaacggcacagtgccctgcctgttggataccagcaccatccccgctgaggagctgaccatgagcccttcgcgctcagtggccaactctggcctgagtgacagcctgaccaccagcaccccccggccctccaacggtgactcgccctcccacccctaccaccgaaccttctccccccacttccaccactttgtggagcagtgccttcagcgcaacccggatgccaggtatccctgctggcctgggcctgggcttcgggagagcagagggtgctcaggagggtaaggccagggtgtgaagggacttacctcccaaaggttctgcaggggaatctggagctacacacaggagggatcagctcctgggtgtgtcagaggccagcctggggagctctggccactgcttcccatgagctgagggagagggagaggggacccgaggctgaggcataagtggcaggatttcgggaagctggggacacggcagtgatgctgcggtctctcctcccctttccctccaggcccagtgccagcaccctcctgaaccactctttcttcaagcaggtatcgtagccccttcgttctggttctggttctagttctggttctaacaactcacaatccctttagctttctctcccctccctttgaatgagagaaactaccccgcttccgaagcccctgaaagacactgctccttcctctcatggagttggctccgacagcccgtctgccaccaggccatggttccttgccccatggtgtcctgggacccagagcaacaggatctgtcacccacctctctcttctcccccagatcaagcgacgtgcctcagaggctttgcccgaattgcttcgtcctgtcacccccatcaccaattttgagggcagccagtctcaggaccacagtggaatctttggcctggtaacaaacctggaagagctggaggtggacgattgggagttctgagcctctgcaaactgtgcgcattctccagccagggatgcagaggccacccagaggcccttcctgagggccggccacattcccgccctcctgggcagattgggtagaaaggacattcttccaggaaagttgactgctgactgattgggaaagaaaatcctggagagacacttcactgctccaaggcttttgagacacaagggaatctcaacaaccagggatcaggagggtccaaagccgacattcccagtcctgtgagctcaggtgacctcctccgcagaagagagatgctgctctggccctgggagctgaattccaagcccagggtttggctccttaaacccgaggaccgccacctcttcccagtgcttgcgaccagcctcattctatttaactttgctctcagatgcctcagatgctataggtcagtgaaagggcaagtagtaagctgcctgcctcccttccctcagacctctccctcataattccagagaagggcatttctgtctttttaagcacagactaaggctggaacagtccatccttatccctcttctggcttgggccctgacacctaagtctttcccacggtttatgtgtgtgcctcattcctttcccaccaagaatccatcttagcgcctcctgccagctgccctggtgctttctccaagggccatcagtgtcttgcctagcttgagggcttaagtccttatgctgtgttagtttcgttgtcagaacaaattaaaattttcagagacgctgctggagaa

SEQ ID NO: 186741 - DNA, 2143 bp, Homo sapiens
  Payload ID: 16770
  Gene Symbol: STRADA
  Gene Name: STE20-related kinase adaptor alpha
  Uniprot ID: Q7RTN6
  ENST ID: ENST00000336174
  CDS Start-End: 114-1409
gcggcgcggcagtaaaactgaggaggcggagccaagacggtcggggctgcttgctaactccaggaacaggtttaagtttttgaaactgaagtaggcctacacagtaggaactcatgtcatttcttgtaagtaaaccagagcgaatcaggcggtgggtctcggaaaagttcattgttgagggcttaagagatttggaactatttggagagcagcctccgggtgacactcggagaaaaaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccccgctgaggagctgaccatgagcccttcgcgctcagtggccaactctggcctgagtgacagcctgaccaccagcaccccccggccctccaacggtgactcgccctcccacccctaccaccgaaccttctccccccacttccaccactttgtggagcagtgccttcagcgcaacccggatgccaggcccagtgccagcaccctcctgaaccactctttcttcaagcagatcaagcgacgtgcctcagaggctttgcccgaattgcttcgtcctgtcacccccatcaccaattttgagggcagccagtctcaggaccacagtggaatctttggcctggtaacaaacctggaagagctggaggtggacgattgggagttctgagcctctgcaaactgtgcgcattctccagccagggatgcagaggccacccagaggcccttcctgagggccggccacattcccgccctcctgggcagattgggtagaaaggacattcttccaggaaagttgactgctgactgattgggaaagaaaatcctggagagacacttcactgctccaaggcttttgagacacaagggaatctcaacaaccagggatcaggagggtccaaagccgacattcccagtcctgtgagctcaggtgacctcctccgcagaagagagatgctgctctggccctgggagctgaattccaagcccagggtttggctccttaaacccgaggaccgccacctcttcccagtgcttgcgaccagcctcattctatttaactttgctctcagatgcctcagatgctataggtcagtgaaagggcaagtagtaagctgcctgcctcccttccctcagacctctccctcataattccagagaagggcatttctgtctttttaagcacagactaaggctggaacagtccatccttatccctcttctggcttgggccctgacacctaagtctttcccacggtttatgtgtgtgcctcattcctttcccaccaagaatccatcttagcgcctcctgccagctgccctggtgctttctccaagggccatcagtgtcttgcctagcttgagggcttaagtccttatgctgtgttagtttcgttgtcagaa

SEQ ID NO: 186742 - DNA, 2121 bp, Homo sapiens
  Payload ID: 16770
  Gene Symbol: STRADA
  Gene Name: STE20-related kinase adaptor alpha
  Uniprot ID: Q7RTN6
  ENST ID: ENST00000375840
  CDS Start-End: 233-1354
cggagccaagacggtcggggctgcttgctaactccaggaacaggtttaagtttttgaaactgaagtaggcctacacagtaggaactcatgtcatttcttgtaagtaaaccagagcgaatcaggcggtgggtctcggaaaagttcattgttgagggcttaagagatttggaactatttggagaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccccgctgaggagctgaccatgagcccttcgcgctcagtggccaactctggcctgagtgacagcctgaccaccagcaccccccggccctccaacggtgactcgccctcccacccctaccaccgaaccttctccccccacttccaccactttgtggagcagtgccttcagcgcaacccggatgccaggcccagtgccagcaccctcctgaaccactctttcttcaagcagatcaagcgacgtgcctcagaggctttgcccgaattgcttcgtcctgtcacccccatcaccaattttgagggcagccagtctcaggaccacagtggaatctttggcctggtaacaaacctggaagagctggaggtggacgattgggagttctgagcctctgcaaactgtgcgcattctccagccagggatgcagaggccacccagaggcccttcctgagggccggccacattcccgccctcctgggcagattgggtagaaaggacattcttccaggaaagttgactgctgactgattgggaaagaaaatcctggagagacacttcactgctccaaggcttttgagacacaagggaatctcaacaaccagggatcaggagggtccaaagccgacattcccagtcctgtgagctcaggtgacctcctccgcagaagagagatgctgctctggccctgggagctgaattccaagcccagggtttggctccttaaacccgaggaccgccacctcttcccagtgcttgcgaccagcctcattctatttaactttgctctcagatgcctcagatgctataggtcagtgaaagggcaagtagtaagctgcctgcctcccttccctcagacctctccctcataattccagagaagggcatttctgtctttttaagcacagactaaggctggaacagtccatccttatccctcttctggcttgggccctgacacctaagtctttcccacggtttatgtgtgtgcctcattcctttcccaccaagaatccatcttagcgcctcctgccagctgccctggtgctttctccaagggccatcagtgtcttgcctagcttgagggcttaagtccttatgctgtgttagtttcgttgtcagaacaaattaaaattttcagagacgctgctggagaa

SEQ ID NO: 186743 - DNA, 2762 bp, Homo sapiens
  Payload ID: 16770
  Gene Symbol: STRADA
  Gene Name: STE20-related kinase adaptor alpha
  Uniprot ID: Q7RTN6
  ENST ID: ENST00000392950
  CDS Start-End: 275-1321
cggcgcggcggcggctgctagggcctgccgcagccgcggccactcggaaagggcgggacttccccgcagggcggggtggggcggagcgctctatcagtcctcccggtcgccccactgcgcatggcacgttgcgtactcccctcccagcaaccggtctggcggcggcgcggcagtaaaactgaggaggcggagccaagacggtcggggctgcttgctaactccaggaacaggtttaagtttttgaaactgaagtaggcctacacagtaggaactcatgtcatttcttaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccccgctgaggagctgaccatgagcccttcgcgctcagtggccaactctggcctgagtgacagcctgaccaccagcaccccccggccctccaacggtgactcgccctcccacccctaccaccgaaccttctccccccacttccaccactttgtggagcagtgccttcagcgcaacccggatgccaggtatccctgctggcctgggcctgggcttcgggagagcagagggtgctcaggagggtaaggccagggtgtgaagggacttacctcccaaaggttctgcaggggaatctggagctacacacaggagggatcagctcctgggtgtgtcagaggccagcctggggagctctggccactgcttcccatgagctgagggagagggagaggggacccgaggctgaggcataagtggcaggatttcgggaagctggggacacggcagtgatgctgcggtctctcctcccctttccctccaggcccagtgccagcaccctcctgaaccactctttcttcaagcaggtatcgtagccccttcgttctggttctggttctagttctggttctaacaactcacaatccctttagctttctctcccctccctttgaatgagagaaactaccccgcttccgaagcccctgaaagacactgctccttcctctcatggagttggctccgacagcccgtctgccaccaggccatggttccttgccccatggtgtcctgggacccagagcaacaggatctgtcacccacctctctcttctcccccagatcaagcgacgtgcctcagaggctttgcccgaattgcttcgtcctgtcacccccatcaccaattttgagggcagccagtctcaggaccacagtggaatctttggcctggtaacaaacctggaagagctggaggtggacgattgggagttctgagcctctgcaaactgtgcgcattctccagccagggatgcagaggccacccagaggcccttcctgagggccggccacattcccgccctcctgggcagattgggtagaaaggacattcttccaggaaagttgactgctgactgattgggaaagaaaatcctggagagacacttcactgctccaaggcttttgagacacaagggaatctcaacaaccagggatcaggagggtccaaagccgacattcccagtcctgtgagctcaggtgacctcctccgcagaagagagatgctgctctggccctgggagctgaattccaagcccagggtttggctccttaaacccgaggaccgccacctcttcccagtgcttgcgaccagcctcattctatttaactttgctctcagatgcctcagatgctataggtcagtgaaagggcaagtagtaagctgcctgcctcccttccctcagacctctccctcataattccagagaagggcatttctgtctttttaagcacagactaaggctggaacagtccatccttatccctcttctggcttgggccctgacacctaagtctttcccacggtttatgtgtgtgcctcattcctttcccaccaagaatccatcttagcgcctcctgccagctgccctggtgctttctccaagggccatcagtgtcttgcctagcttgagggcttaagtccttatgctgtgttagtttcgttgtcagaacaaattaaaattttcagagacgc

SEQ ID NO: 186744 - DNA, 1398 bp, Homo sapiens
  Payload ID: 16770
  Gene Symbol: STRADA
  Gene Name: STE20-related kinase adaptor alpha
  Uniprot ID: Q7RTN6
  ENST ID: ENST00000447001
  CDS Start-End: 183-1082
atcagtcctcccggtcgccccactgcgcatggcacgttgcgtactcccctcccagcaaccggtctggcggcggcgcggcagtaaaactgaggaggcggagccaagacggtcggggctgcttgctaactccaggaacaggtttaagtttttgaaactgaagtaggcctacacagtaggaactcatgtcatttcttgtaagtaaaccagagcgaatcaggcggtgggtctcggaaaagttcattgttgagggcttaagagatttggaactatttggaggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccccgctgaggagctgaccatgagcccttcgcgctcagtggccaactctggcctgagtgacagcctgaccaccagcaccccccggccctccaacggcccagtgccagcaccctcctgaaccactctttcttcaagcagatcaagcgacgtgcctcagaggctttgcccgaattgcttcgtcctgtcacccccatcaccaattttgagggcagccagtctcaggaccacagtggaatctttggcctggtaacaaacctggaagagctggaggtggacgattgggagttctgagcctctgcaaactgtgcgcattctccagccagggatgcagaggccacccagaggcccttcctgagggccggccacattcccgccctcctgggcagattgggtagaaaggacattcttccaggaaagttgactgctgactgatt

SEQ ID NO: 186745 - DNA, 604 bp, Homo sapiens
  Payload ID: 16770
  Gene Symbol: STRADA
  Gene Name: STE20-related kinase adaptor alpha
  ENST ID: ENST00000579549
  CDS Start-End: 388-604
aaaactgaggaggcggagccaagacggtcggggctgcttgctaactccaggaacaggtacctgcctggcggggtgcctggtacgctgccggggccagtccctcctggctctgccaccgattccatctccccaggcccgggccttcgtcggagcggccatcctgggctcacctcaccctccacgggccccctttttaacccgcgtcctcgactcccgcaatgaggcgccgcagcccgagagcagaataggcttgggcctggcggggagacgctgaagcggagttgccgggcgagagaggcgggctcctgctttccccttcctccccaccccctaggacttccaggtttaagtttttgaaactgaagtaggcctacacagtaggaactcatgtcatttcttaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatg

SEQ ID NO: 186746 - DNA, 563 bp, Homo sapiens
  Payload ID: 16770
  Gene Symbol: STRADA
  Gene Name: STE20-related kinase adaptor alpha
  ENST ID: ENST00000584110
  CDS Start-End: 533-563
aaaactgaggaggcggagccaagacggtcggggctgcttgctaactccaggaacaggtacctgcctggcggggtgcctggtacgctgccggggccagtccctcctggctctgccaccgattccatctccccaggcccgggccttcgtcggagcggccatcctgggctcacctcaccctccacgggccccctttttaacccgcgtcctcgactcccgcaatgaggcgccgcagcccgagagcagaataggcttgggcctggcggggagacgctgaagcggagttgccgggcgagagaggcgggctcctgctttccccttcctccccaccccctaggacttccaggtttaagtttttgaaactgaagtaggcctacacagtaggaactcatgtcatttcttgtaagtaaaccagagcgaatcaggcggtgggtctcggaaaagttcattgttgagggcttaagagatttggaactatttggagaccaatgatgcgagctcagagtcaatagcatccttctctaaacaggaggtcatgagtagctttctgccagagggagggtgtt

SEQ ID NO: 186747 - DNA, 1168 bp, Homo sapiens
  Payload ID: 16770
  Gene Symbol: STRADA
  Gene Name: STE20-related kinase adaptor alpha
  ENST ID: ENST00000579340
  CDS Start-End: 282-803
ccctcccagcaaccggtctggcggcggcgcggcagtaaaactgaggaggcggagccaagacggtcggggctgcttgctaactccaggaacaggtttaagtttttgaaactgaagtaggcctacacagtaggaactcatgtcatttcttgtaagtaaaccagagcgaatcaggcggtgggtctcggaaaagttcattgttgagggcttaagagatttggaactatttggagaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccccgctgaggagctgaccatgagcccttcgcgctcagtggccaactctggcctgagtgacagcctgaccaccagcaccccccggccctccaacggtgactcgccctcccacccctaccaccgaaccttctccccccacttccaccactttgtggagcagtgccttcagcgcaacccggatgccaggtatccctgctggcctgggcctgggcttcgggagagcagagggtgctcaggagggtaaggccagggtgtgaagggacttacctcccaaaggttctgcaggggaatctggagctacacacaggagggatcagct

SEQ ID NO: 186748 - DNA, 1159 bp, Homo sapiens
  Payload ID: 16770
  Gene Symbol: STRADA
  Gene Name: STE20-related kinase adaptor alpha
  Uniprot ID: Q7RTN6
  ENST ID: ENST00000582137
  CDS Start-End: 101-1045
aaaactgaggaggcggagccaagacggtcggggctgcttgctaactccaggaacaggtttaagtttttgaaactgaagtaggcctacacagtaggaactcatgtcatttcttgtaagtaaaccagagcgaatcaggaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccccgctgaggagctgaccatgagcccttcgcgctcagtggccaactctggcctgagtgacagcctgaccaccagcaccccccggccctccaacggcccagtgccagcaccctcctgaaccactctttcttcaagcagatcaagcgacgtgcctcagaggctttgcccgaattgcttcgtcctgtcacccccatcaccaattttgagggcagccagtctcaggaccacagtg

SEQ ID NO: 186749 - DNA, 563 bp, Homo sapiens
  Payload ID: 16770
  Gene Symbol: STRADA
  Gene Name: STE20-related kinase adaptor alpha
  ENST ID: ENST00000580338
  CDS Start-End: 328-563
tactcccctcccagcaaccggtctggcggcggcgcggcagtaaaactgaggaggcggagccaagacggtcggggctgcttgctaactccaggaacagacttaaaatttataagctgatgatgagcacttaacagtattgtttaagtttttgaaactgaagtaggcctacacagtaggaactcatgtcatttcttgtaagtaaaccagagcgaatcaggcggtgggtctcggaaaagttcattgttgagggcttaagagatttggaactatttggagaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttt

SEQ ID NO: 186750 - DNA, 525 bp, Homo sapiens
  Payload ID: 16770
  Gene Symbol: STRADA
  Gene Name: STE20-related kinase adaptor alpha
  ENST ID: ENST00000580288
  CDS Start-End: 390-525
gtaaaactgaggaggcggagccaagacggtcggggctgcttgctaactccaggaacaggtacctgcctggcggggtgcctggtacgctgccggggccagtccctcctggctctgccaccgattccatctccccaggcccgggccttcgtcggagcggccatcctgggctcacctcaccctccacgggccccctttttaacccgcgtcctcgactcccgcaatgaggcgccgcagcccgagagcagaataggcttgggcctggcggggagacgctgaagcggagttgccgggcgagagaggcgggctcctgctttccccttcctccccaccccctaggacttccaggtttaagtttttgaaactgaagtaggcctacacagtaggaactcatgtcatttcttgtaagtaaaccagagcgaatcaggcggtgggtctcggaaaagttcattgttgagggcttaagagatttggaactatttggagagcagcctccgggtgacactcggagaaaaaccaatgatgcga

SEQ ID NO: 186751 - DNA, 560 bp, Homo sapiens
  Payload ID: 16770
  Gene Symbol: STRADA
  Gene Name: STE20-related kinase adaptor alpha
  ENST ID: ENST00000578801
  CDS Start-End: 1-396
ctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacagaatctccagggttatgatgccaagtctgacatctacagtgtgggaatcacagcctgtgaactggccaacggccatgtcccctttaaggatatgcctgccacccagggtgaagactctacggtaaaaggaatttgatgccttggaaagggagagcggaaactgtgagccctgctttccagccatggcgaaagcgggtacttttgtgcaacccctctcctttcacgttggcctggctagggcggagctgccacgccagtgaccagcgtttctttgggaaaattggactta

SEQ ID NO: 186752 - DNA, 938 bp, Homo sapiens
  Payload ID: 16770
  Gene Symbol: STRADA
  Gene Name: STE20-related kinase adaptor alpha
  ENST ID: ENST00000581243
  CDS Start-End: 135-257
ctcccagcaaccggtctggcggcggcgcggcagtaaaactgaggaggcggagccaagacggtcggggctgcttgctaactccaggaacaggtttaagtttttgaaactgaagtaggcctacacagtaggaactcatgtcatttcttgtaagtaaaccagagcgaatcaggcggtgggtctcggaaaagttcattgttgagggcttaagagatttggaactatttggaggagagtcaccaaaaagtagagagcaatagaaggaggaggagaataggattcacatgtattgaatgtcttttatacaccagaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcag

SEQ ID NO: 186753 - DNA, 582 bp, Homo sapiens
  Payload ID: 16770
  Gene Symbol: STRADA
  Gene Name: STE20-related kinase adaptor alpha
  ENST ID: ENST00000582030
  CDS Start-End: 432-582
aaaactgaggaggcggagccaagacggtcggggctgcttgctaactccaggaacaggcccgggccttcgtcggagcggccatcctgggctcacctcaccctccacgggccccctttttaacccgcgtcctcgactcccgcaatgaggcgccgcagcccgagagcagaataggcttgggcctggcggggagacgctgaagcggagttgccgggcgagagaggcgggctcctgctttccccttcctccccaccccctaggacttccaggtttaagtttttgaaactgaagtaggcctacacagtaggaactcatgtcatttcttcggtgggtctcggaaaagttcattgttgagggcttaagagatttggaactatttggagaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttcca

SEQ ID NO: 186754 - DNA, 961 bp, Homo sapiens
  Payload ID: 16770
  Gene Symbol: STRADA
  Gene Name: STE20-related kinase adaptor alpha
  ENST ID: ENST00000582026
  CDS Start-End: 1-167
ccagcaccccccggccctccaacggtgactcgccctcccacccctaccaccgaaccttctccccccacttccaccactttgtggagcagtgccttcagcgcaacccggatgccaggcccagtgccagcaccctcctgaaccactctttcttcaagcaggtatcgtagccccttcgttctggttctggttctagttctggttctaacaactcacaatccctttagctttctctcccctccctttgaatgagagaaactaccccgcttccgaagcccctgaaagacactgctccttcctctcatggagttggctccgacagcccgtctgccaccaggccatggttccttgccccatggtgtcctgggacccagagcaacaggatctgtcacccacctctctcttctcccccagatcaagcgacgtgcctcagaggctttgcccgaattgcttcgtcctgtcacccccatcaccaattttgagggcagccagtctcaggaccacagtggaatctttggcctggtaacaaacctggaagagctggaggtggacgattgggagttctgagcctctgcaaactgtgcgcattctccagccagggatgcagaggccacccagaggcccttcctgagggccggccacattcccgccctcctgggcagattgggtagaaaggacattcttccaggaaagttgactgctgactgattgggaaagaaaatcctggagagacacttcactgctccaaggcttttgagacacaagggaatctcaacaaccagggatcaggagggtccaaagccgacattcccagtcctgtgagctcaggtgacctcctccgcagaagagagatgctgctctggccctgggagctgaattccaagcccagggtttggctccttaaacccgaggaccgccacctcttcccagtgcttgcgaccagcctcattctatttaactttgc

SEQ ID NO: 186755 - DNA, 798 bp, Homo sapiens
  Payload ID: 16770
  Gene Symbol: STRADA
  Gene Name: STE20-related kinase adaptor alpha
  ENST ID: ENST00000578008
  CDS Start-End: 1-504
aatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagggtgaagactctacggtaaaaggaatttgatgccttggaaagggagagcggaaactgtgagccctgctttccagccatggcgaaagcgggtacttttgtgcaacccctctcctttcacgttggcctggctagggcggagctgccacgccagtgaccagcgtttctttgggaaaattggacttactccacttccaccttttccactcttcaaatgatcacatttgcatattgggaacagtgtatttgtgaagagactctcaggccttccagggaccaccccccccccccacccgctacagcccaggtcctggttctgtcctcccc

SEQ ID NO: 186756 - DNA, 705 bp, Homo sapiens
  Payload ID: 16770
  Gene Symbol: STRADA
  Gene Name: STE20-related kinase adaptor alpha
  ENST ID: ENST00000617949
  CDS Start-End: 1-705
atgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagggttatgatgccaagtctgacatctacagtgtgggaatcacagcctgtgaactggccaacggccatgtcccctttaaggatatgcctgccacccagggtgaagactctacggtaaaaggaatttga

SEQ ID NO: 186757 - DNA, 2293 bp, Homo sapiens
  Payload ID: 16771
  Gene Symbol: STRADB
  Gene Name: STE20-related kinase adaptor beta
  Uniprot ID: Q9C0K7
  ENST ID: ENST00000194530
  CDS Start-End: 366-1622
ccccgccttctcgctgcccagccccggggagggaggcggggccgcgaccccggcgcgggtggggcgaatgcgttcccagcgggtagcctgggactggtgcagagttccaagcccacggccccggtcgcggcctcgccgccctcccgcgccccgcgccgggagcgggcctagagcgctcgcctcgcccctccgcgagcagggctctggcgcccgcccctgtccgcaccgctggcagcctgaagagagtcgctggccgtggtcgccgctaggtaggatatatctgcatcttgaaaggaagataaaacaaaagccttctttggaatagatggatttttgtcactttctgtgtgaactaaagtgattcaatgtctcttttggattgcttctgcacttcaagaacacaagttgaatcactcagacctgaaaaacagtctgaaaccagtatccatcaatacttggttgatgagccaaccctttcctggtcacgtccatccactagagccagtgaagtactatgttccaccaacgtttctcactatgagctccaagtagaaataggaagaggatttgacaacttgacttctgtccatcttgcacggcatactcccacaggaacactggtaactataaaaattacaaatctggaaaactgcaatgaagaacgcctgaaagctttacagaaagccgtgattctatcccactttttccggcatcccaatattacaacttattggacagttttcactgttggcagctggctttgggttatttctccatttatggcctatggttcagcaagtcaactcttgaggacctattttcctgaaggaatgagtgaaactttaataagaaacattctctttggagccgtgagagggttgaactatctgcaccaaaatggctgtattcacaggagtattaaagccagccatatcctcatttctggtgatggcctagtgaccctctctggcctgtcccatctgcatagtttggttaagcatggacagaggcatagggctgtgtatgatttcccacagttcagcacatcagtgcagccgtggctgagtccagaactactgagacaggatttacatgggtataatgtgaagtcagatatttacagtgttgggattacagcatgtgaattagccagtgggcaggtgcctttccaggacatgcatagaactcagatgctgttacagaaactgaaaggtcctccttatagcccattggatatcagtattttccctcaatcagaatccagaatgaaaaattcccagtcaggtgtagactctgggattggagaaagtgtgcttgtctccagtggaactcacacagtaaatagtgaccgattacacacaccatcctcaaaaactttctctcctgccttctttagcttggtacagctctgtttgcaacaagatcctgagaaaaggccatcagcaagcagtttattgtcccatgttttcttcaaacagatgaaagaagaaagccaggattcaatactttcactgttgcctcctgcttataacaagccatcaatatcattgcctccagtgttaccttggactgagccagaatgtgattttcctgatgaaaaagactcatactgggaattctagggctgccaaatcattttatgtcctatatacttgacactttctccttgctgctttttcttctgtatttctaggtacaaataccagaattatacttgaaaatacagttggtgcactggagaatctattatttaaaaccactctgttcaaaggggcaccagtttgtagtccctctgtttcgcacagagtactatgacaaggaaacatcagaattactaatctagctagtgtcatttattctggaatttttttctaagctgtgactaactctttttatctctcaatataatttttgagccagttaatttttttcagtattttgctgtcccttgggaatgggccctcagaggacagtgcttccaagtacatcttctcccagattctctggcctttttaatgagctattgttaaaccaacaggctagtttatcttacatcagacccttttctggtagagggaaaatgtttgtgctttccctttttcttctgttaatacttatggtaacacctaactgagcctcactcacattaaatgattcacttgaaatatatacagaaattgtaatttgcttttttttaaacaagggggctaaagtaacactttcctacttatgtaaattatagatcctaaattcacgcaccccgtgggagctcaataaagatttactgaattga

SEQ ID NO: 186758 - DNA, 2190 bp, Homo sapiens
  Payload ID: 16771
  Gene Symbol: STRADB
  Gene Name: STE20-related kinase adaptor beta
  Uniprot ID: Q9C0K7
  ENST ID: ENST00000392249
  CDS Start-End: 239-1372
cggcctcgccgccctcccgcgccccgcgccgggagcgggcctagagcgctcgcctcgcccctccgcgagcagggctctggcgcccgcccctgtccgcaccgctggcagcctgaagagagtcgctggccgtggtcgccgctaggtaggatatatctgcatcttgaaaggaagataaaacaaaagccttctttggaatagatggatttttgtcactttctgtgtgaactaaagtgattcaatgtctcttttggattgcttctgcacttcaagaacacaagttgaatcactcagacctgaaaaacagtctgaaaccagtatccatcaatacttggttgatgagccaaccctttcctggtcacgtccatccactagagccagtgaagtactatgttccaccaacgtttctcactatgagctccaagtagaaataggaagaggatttgacaacttgacttctgtccatcttgcacggcatactcccacaggaacactggtaactataaaaattacaaatctggaaaactgcaatgaagaacgcctgaaagctttacagaaagccgtgattctatcccactttttccggcatcccaatattacaacttattggacagttttcactgttggcagctggctttgggttatttctccatttatggcctatggttcagcaagtcaactcttgaggacctattttcctgaaggaatgagtgaaactttaataagaaacattctctttggagccgtgagagggttgaactatctgcaccaaaatggctgtattcacaggagtattaaagccagccatatcctcatttctggtgatggcctagtgaccctctctggcctgtcccatctgcatagtttggttaagcatggacagaggcatagggctgtgtatgatttcccacagttcagcacatcagtgcagccgtggctgagtccagaactactgagacaggatttacatgggtataatgtgaagtcagatatttacagtgttgggattacagcatgtgaattagccagtgggcaggtgcctttccaggacatgcatagaactcagatgctgttacagaaactgaaaggtcctccttatagcccattggatatcagtattttccctcaatcagaatccagaatgaaaaattcccagtcaggtgtagactctgggattggagaaagtgtgcttgtctccagtggaactcacacagtaaatagtgaccgattacacacaccatcctcaaaaactttctctcctgccttctttagcttggtacagctctgtttgcaacaagatcctgagaaaaggccatcagcaagcagtttattgtcccatgttttcttcaaacagccttattttgagtttctttaacagatgaaagaagaaagccaggattcaatactttcactgttgcctcctgcttataacaagccatcaatatcattgcctccagtgttaccttggactgagccagaatgtgattttcctgatgaaaaagactcatactgggaattctagggctgccaaatcattttatgtcctatatacttgacactttctccttgctgctttttcttctgtatttctaggtacaaataccagaattatacttgaaaatacagttggtgcactggagaatctattatttaaaaccactctgttcaaaggggcaccagtttgtagtccctctgtttcgcacagagtactatgacaaggaaacatcagaattactaatctagctagtgtcatttattctggaatttttttctaagctgtgactaactctttttatctctcaatataatttttgagccagttaatttttttcagtattttgctgtcccttgggaatgggccctcagaggacagtgcttccaagtacatcttctcccagattctctggcctttttaatgagctattgttaaaccaacaggctagtttatcttacatcagacccttttctggtagagggaaaatgtttgtgctttccctttttcttctgttaatacttatggtaacacctaactgagcctcactcacattaaatgattcacttgaaatatatacagaaattgtaatttgcttttttttaaacaagggggctaaagtaacactttcctacttatgtaaattatagatcctaaattcacgcaccccgtgggagctcaataaagatttactgaattga

SEQ ID NO: 186759 - DNA, 576 bp, Homo sapiens
  Payload ID: 16771
  Gene Symbol: STRADB
  Gene Name: STE20-related kinase adaptor beta
  ENST ID: ENST00000447698
  CDS Start-End: 301-414
gaatgcgttcccagcgggtagcctgggactggtgcagagttccaagcccacggccccggtcgcggcctcgccgccctcccgcgccccgcgccgggagcgggcctagagcgctcgcctcgcccctccgcgagcagggctctggcgcccgcccctgtccgcaccgctggcagcctgaagagagtcgctggccgtggtcgccgctaggtaggatatatctgcatcttgaaaggaagataaaacaaaagccttctttggaatagatggatttttgtcactttctgtgtgaactaaagtgattcaatgtctcttttggattgcttctgcacttcaagaacacaagttgaatcactcagacctgaaaaacagtctgaaaccagtatccatcaatacttggaagaggatttgacaacttgacttctgtccatcttgcacggcatactcccacaggaacactggtaactataaaaattacaaatctggaaaactgcaatgaagaacgcctgaaagctttacagaaagccgtgattctatcccactttttccggcatcccaatattacaacttattggacagttt

SEQ ID NO: 186760 - DNA, 772 bp, Homo sapiens
  Payload ID: 16771
  Gene Symbol: STRADB
  Gene Name: STE20-related kinase adaptor beta
  ENST ID: ENST00000458269
  CDS Start-End: 191-772
agaacctggatcttccgctgccattcttcagcaaagaactgcttctcacttaaatagttttgtcgacgcaagctaaggcgatgcagtgctgtagccaaatcactatctcctgagggtcctggttggcccatcttctgggagctcctataggaaaatcgcgttcactgattagatcttgaggatcatcagcatgacccagacctctcctttctataatggaagaggatttgacaacttgacttctgtccatcttgcacggcatactcccacaggaacactggtaactataaaaattacaaatctggaaaactgcaatgaagaacgcctgaaagctttacagaaagccgtgattctatcccactttttccggcatcccaatattacaacttattggacagttttcactgttggcagctggctttgggttatttctccatttatggcctatggttcagcaagtcaactcttgaggacctattttcctgaaggaatgagtgaaactttaataagaaacattctctttggagccgtgagagggttgaactatctgcaccaaaatggctgtattcacaggagtattaaagccagccatatcctcatttctggtgatggcctagtgaccctctctggcctgtcccatctgcatagtttggttaagcatggacagaggcatagggctgtgtatgatttcccacagttcagcacatcagtgcagccgtggctgagtccagaactactgagacaggatttacatgggtataatgtgaagtca

SEQ ID NO: 186761 - DNA, 616 bp, Homo sapiens
  Payload ID: 16771
  Gene Symbol: STRADB
  Gene Name: STE20-related kinase adaptor beta
  ENST ID: ENST00000415688
  CDS Start-End: 1-268
gccagtgggcaggtgcctttccaggacatgcatagaactcagcttggtacagctctgtttgcaacaagatcctgagaaaaggccatcagcaagcagtttattgtcccatgttttcttcaaacagatgaaagaagaaagccaggattcaatactttcactgttgcctcctgcttataacaagccatcaatatcattgcctccagtgttaccttggactgagccagaatgtgattttcctgatgaaaaagactcatactgggaattctagggctgccaaatcattttatgtcctatatacttgacactttctccttgctgctttttcttctgtatttctaggtacaaataccagaattatacttgaaaatacagttggtgcactggagaatctattatttaaaaccactctgttcaaaggggcaccagtttgtagtccctctgtttcgcacagagtactatgacaaggaaacatcagaattactaatctagctagtgtcatttattctggaatttttttctaagctgtgactaactctttttatctctcaatataatttttgagccagttaatttttttcagtattttgctgtcccttgggaatgggccctcagagga

SEQ ID NO: 186762 - DNA, 1515 bp, Homo sapiens
  Payload ID: 16772
  Gene Symbol: STEAP1B
  Gene Name: STEAP family member 1B
  Uniprot ID: Q6NZ63
  ENST ID: ENST00000404369
  CDS Start-End: 417-1445
aatatgcccccgggtaatcttatacacgctgaagtctgagaaccactgctctagagaaatgcacaaacgttccttagtggagattaaacaaaaggcgaggggttggagggcgcgaaacggacctcaagggcagggcagacggcatttgagaggaaactgggagaggccggagtgcgacttggggagtcttagcctccaaggacgttcccgaaccctgcggacgcggggcgccagcaggtggcgctggacgcgcaactgacaaggaggcggggcctgcagcaggcttggaggcttcgcgctctggaggctcaggcgccgcgtggggccggcacctcccggcagcagcggcagctgagactcacggtcaagctacggcgaggagtgggtggctgaagccatactattttatagaattaatggaaagcagaaaagacatcacaaaccaagaagaaatttggaaaatgaagcctaggagaaatttagaagacaacgattatttgcatgaggacacgggagagaccagcatgctaaaaagacctgtgcttttgcatttgcagcaaacagcccatgctgatgaatttgactgcccttcagaacttcagcacgcacaggaactctttccacagtggcacttgccaattaaaatagctgctgttatggcatctctgacttttctttacactcttctgagggaagtaattcaccctttagcaacttcccatcaacaatatttttataaaattccaatcctggtcatcaacaaagtcttgccaatggtttccatcactctcttggcattggtttacctaccaggtgtgatagcagcaattgtccaagttcataatggaaccaagtataagaagtttccacattggttggataagtggatgttaacaagaaagcagtttgggcttctcagtttgttttttgctgtactgcatgcaatttatactctgtcttacgcaatgaggcgatcctacagatacaagttgctaaactgggcatatcaacaggtccaacaaaataaagaagatgcctggattgagcatgatgtttggagaatggagatttatgtgtctctgggaattgtgggactggcaatactggctctgttggctgtgacatctattccatctgtgagtgactctttgacatggagagaatttcactatattcaggctatactgactggaagcctggtagctttgtgcaactttcaggccactaaactggccaagacacaactggtaggcacaccaaatttctggcaggagcagcagtgtggaatccatttcccaccaccttccaagactaggagttatatatacttcattttatcagcagccagcccttcaaagggaaatgttagctctcacatgtttcagcttcatctagaaaatctcaataaaaaagacaagttattgctgatcatctttcagatttaagcatgcatgaaagtgagaaccttgttccctgctcatacatcttacatacttgcagaccagaccatggtag

SEQ ID NO: 186763 - DNA, 1193 bp, Homo sapiens
  Payload ID: 16772
  Gene Symbol: STEAP1B
  Gene Name: STEAP family member 1B
  Uniprot ID: Q6NZ63
  ENST ID: ENST00000406890
  CDS Start-End: 96-833
ggggccggcacctcccggcagcagcggcagctgagactcacggtcaagctacggcgaggagtgggtggctgaagccatactattttatagaattaatggaaagcagaaaagacatcacaaaccaagaagaaatttggaaaatgaagcctaggagaaatttagaagacaacgattatttgcaaacagcccatgctgatgaatttgactgcccttcagaacttcagcacgcacaggaactctttccacagtggcacttgccaattaaaatagctgctgttatggcatctctgacttttctttacactcttctgagggaagtaattcaccctttagcaacttcccatcaacaatatttttataaaattccaatcctggtcatcaacaaagtcttgccaatggtttccatcactctcttggcattggtttacctaccaggtgtgatagcagcaattgtccaagttcataatggaaccaagtataagaagtttccacattggttggataagtggatgttaacaagaaagcagtttgggcttctcagtttgttttttgctgtactgcatgcaatttatactctgtcttacgcaatgaggcgatcctacagatacaagttgctaaactgggcatatcaacaggtccaacaaaataaagaagatgcctggattgagcatgatgtttggagaatggagatttatgtgtctctgggaattgtgggactggcaatactggctctgttggctgtgacatctattccatctgtgagtgactctttgacatggagagaatttcactatattcaggtacatggtaggatcaacttcctgaccttgtgacagatcctgccagtaacatgagaggaaatgagaacgaggctttggagcacagcattggattgctcatgcagaacaccacccagtgccctttccctctgccacaatgaacagccatgctgcaggtgacggctgctctgtcaacatggatccggcagggcagatgagtggatcccccagcggactcatgagagagcaaacaaaaagtccatatgtgttgtgctaatccactgagattgtgttggttgttacggagcctaacctagcctatcccgacacgaggatcagacatgataatcaaatgtgtttataaagtgttggatggaaatattctgacaacattaaaagactctacccaaggaa

SEQ ID NO: 186764 - DNA, 797 bp, Homo sapiens
  Payload ID: 16772
  Gene Symbol: STEAP1B
  Gene Name: STEAP family member 1B
  ENST ID: ENST00000439708
  CDS Start-End: 148-797
cagatgaatgcatgatatctcttggtaaaatggcccagaagaaacacaggaaggagttatgaaaagataacacccgtaagtgtgactacacattttgtgatccagtcatcatttctgtggctgaagccatactattttatagaattaatggaaagcagaaaagacatcacaaaccaagaagaaatttggaaaatgaagcctaggagaaatttagaagacaacgattatttgcatgaggacacgggagagaccagcatgctaaaaagacctgtgcttttgcatttgcagcaaacagcccatgctgatgaatttgactgcccttcagaacttcagcacgcacaggaactctttccacagtggcacttgccaattaaaatagctgctgttatggcatctctgacttttctttacactcttctgagggaagtaattcaccctttagcaacttcccatcaacaatatttttataaaattccaatcctggtcatcaacaaagtcttgccaatggtttccatcactctcttggcattggtttacctaccaggtgtgatagcagcaattgtccaagttcataatggaaccaagtataagaagtttccacattggttggataagtggatgttaacaagaaagcagtttgggcttctcagtttgttttttgctgtactgcatgcaatttatactctgtcttacgcaatgaggcgatcctacagatacaagttgctaaactgggcatatcaacaggtccaacaaaataaagaagatgcctggattgagcatgatgtttggagaatgga

SEQ ID NO: 186765 - DNA, 1004 bp, Homo sapiens
  Payload ID: 16772
  Gene Symbol: STEAP1B
  Gene Name: STEAP family member 1B
  ENST ID: ENST00000424363
  CDS Start-End: 243-1004
tcgcgctctggaggctcaggcgccgcgtggggccggcacctcccggcagcagcggcagctgagactcacggtcaagctacggcgaggagtggggttgaccagaagactgggcacatcattaattcagcacaactcaccattcccactggaaacatactggcaattcacatcttccaaacaaggaccaacctcttactccaaaagaaaaatggtggctgaagccatactattttatagaattaatggaaagcagaaaagacatcacaaaccaagaagaaatttggaaaatgaagcctaggagaaatttagaagacaacgattatttgcatgaggacacgggagagaccagcatgctaaaaagacctgtgcttttgcatttgcagcaaacagcccatgctgatgaatttgactgcccttcagaacttcagcacgcacaggaactctttccacagtggcacttgccaattaaaatagctgctgttatggcatctctgacttttctttacactcttctgagggaagtaattcaccctttagcaacttcccatcaacaatatttttataaaattccaatcctggtcatcaacaaagtcttgccaatggtttccatcactctcttggcattggtttacctaccaggtgtgatagcagcaattgtccaagttcataatggaaccaagtataagaagtttccacattggttggataagtggatgttaacaagaaagcagtttgggcttctcagtttgttttttgctgtactgcatgcaatttatactctgtcttacgcaatgaggcgatcctacagatacaagttgctaaactgggcatatcaacaggtccaacaaaataaagaagatgcctggattgagcatgatgtttggagaatggagatttatgtgtctctgggaattgtgggactggcaatactggctctgttggctgtgacatctattccatctgtgagtgactctttgacatggagagaatttcactatattcag

SEQ ID NO: 186766 - DNA, 6873 bp, Homo sapiens
  Payload ID: 16773
  Gene Symbol: STEAP2
  Gene Name: STEAP family member 2, metalloreductase
  Uniprot ID: Q8NFT2
  ENST ID: ENST00000287908
  CDS Start-End: 394-1866
gccccctccgagctccccgactcctccccgcgctccacggctcttcccgactccagtcagcgttcctcgggccctcggcgccacgagctgtccgggcacgcagcccctagcggcgcgtcgctgccaagccggcctccgcgcgcctccctccttccttctcccctggctgttcgcgatccagcttgggtaggcggggaagcagctggagtgcgaccgccgcggcagccaccctgcaaccgccagtcggaggtgcagtccgtaggccctggcccccgggtgggcccttggggagtcggcgccgctcccggggagctgcaaggctcgcccctgcccggcgtggagggcgcggggggcgcggaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccgaaagctaaaacgaattaaaaaaggctgggaaaagagccaatttctggaagaaggtatgggaggaacaattcctcatgtctccccggagagggtcacagtaatgtgatgacaaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcttccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcttgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaactaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttccccccaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaacttctgttttgaaa

SEQ ID NO: 186767 - DNA, 7033 bp, Homo sapiens
  Payload ID: 16773
  Gene Symbol: STEAP2
  Gene Name: STEAP family member 2, metalloreductase
  Uniprot ID: Q8NFT2
  ENST ID: ENST00000394621
  CDS Start-End: 507-1979
gccccctccgagctccccgactcctccccgcgctccacggctcttcccgactccagtcagcgttcctcgggccctcggcgccacgagctgtccgggcacgcagcccctagcggcgcgtcgctgccaagccggcctccgcgcgcctccctccttccttctcccctggctgttcgcgatccagcttgggtaggcggggaagcagctggagtgcgaccgccgcggcagccaccctgcaaccgccagtcggaggtgcagtccgtaggccctggcccccgggtgggcccttggggagtcggcgccgctcccggggagctgcaaggctcgcccctgcccggcgtggagggcgcggggggcgcggagaaagtgaagagaggaaattggaaaattgtgagtggaccttctgatactgctcctccttgcgtggaaaaggggaaagaactgcatgcatattattcagcgtcctatattcaaaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccgaaagctaaaacgaattaaaaaaggctgggaaaagagccaatttctggaagaaggtatgggaggaacaattcctcatgtctccccggagagggtcacagtaatgtgatgacaaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcttccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcttgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaactaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttccccccaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaacttctgttttgaaatgttgtatacacgtggatttttttctcattaaataataattctagta

SEQ ID NO: 186768 - DNA, 6612 bp, Homo sapiens
  Payload ID: 16773
  Gene Symbol: STEAP2
  Gene Name: STEAP family member 2, metalloreductase
  Uniprot ID: Q8NFT2
  ENST ID: ENST00000394622
  CDS Start-End: 170-1642
gatccagcttgggtaggcggggaagcagctggagtgcgaccgccgcggcagccaccctgcaaccgccagtcggagagctaagggcaagtcctgaggttgggcccaggagaaagaaggcaaggagacattgtcccaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccgaaagctaaaacgaattaaaaaaggctgggaaaagagccaatttctggaagaaggtatgggaggaacaattcctcatgtctccccggagagggtcacagtaatgtgatgacaaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcttccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcttgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaactaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttccccccaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaata

SEQ ID NO: 186769 - DNA, 2456 bp, Homo sapiens
  Payload ID: 16773
  Gene Symbol: STEAP2
  Gene Name: STEAP family member 2, metalloreductase
  Uniprot ID: Q8NFT2
  ENST ID: ENST00000394626
  CDS Start-End: 336-1700
agcgttcctcgggccctcggcgccacgagctgtccgggcacgcagcccctagcggcgcgtcgctgccaagccggcctccgcgcgcctccctccttccttctcccctggctgttcgcgatccagcttgggtaggcggggaagcagctggagtgcgaccgccgcggcagccaccctgcaaccgccagtcggaggtgcagtccgtaggccctggcccccgggtgggcccttggggagtcggcgccgctcccggggagctgcaaggctcgcccctgcccggcgtggagggcgcggggggcgcggaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctggatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaacttctgttttgaaatgttgtatacacgtggatttttttctcattaaataataattctagta

SEQ ID NO: 186770 - DNA, 2261 bp, Homo sapiens
  Payload ID: 16773
  Gene Symbol: STEAP2
  Gene Name: STEAP family member 2, metalloreductase
  Uniprot ID: Q8NFT2
  ENST ID: ENST00000394629
  CDS Start-End: 188-1552
ttctgctatagagatggaacagtatatggaaagctcccaagaaagtgaagagaggaaattggaaaattgtgagtggaccttctgatactgctcctccttgcgtggaaaaggggaaagaactgcatgcatattattcagcgtcctatattcaaaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctggatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaacttctgttttgaaa

SEQ ID NO: 186771 - DNA, 2072 bp, Homo sapiens
  Payload ID: 16773
  Gene Symbol: STEAP2
  Gene Name: STEAP family member 2, metalloreductase
  Uniprot ID: Q8NFT2
  ENST ID: ENST00000394632
  CDS Start-End: 170-1429
gatccagcttgggtaggcggggaagcagctggagtgcgaccgccgcggcagccaccctgcaaccgccagtcggagagctaagggcaagtcctgaggttgggcccaggagaaagaaggcaaggagacattgtcccaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactattta

SEQ ID NO: 186772 - DNA, 1372 bp, Homo sapiens
  Payload ID: 16773
  Gene Symbol: STEAP2
  Gene Name: STEAP family member 2, metalloreductase
  ENST ID: ENST00000402625
  CDS Start-End: 149-1360
ggaggtgcagtccgtaggccctggcccccgggtgggcccttggggagtcggcgccgctcccggggagctgcaaggctcgcccctgcccggcgtggagggcgcggggggcgcggaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtggcctagcgctaccctgttgtcctaaagagtttctgct

SEQ ID NO: 186773 - DNA, 902 bp, Homo sapiens
  Payload ID: 16773
  Gene Symbol: STEAP2
  Gene Name: STEAP family member 2, metalloreductase
  ENST ID: ENST00000428074
  CDS Start-End: 358-902
caagcagagctctccttcctgaacaaaatgagtccacctggggtttattttctttaaagatttgctcaatagagattttattatctttggtttaaaataaaagttaaaatgatatatttactattttaatgagttacatttaatgttttatggcaacaaaaaagaaatatctgattctgatgtgatttttcagatcatagactacatgtctaaagaagcctataagaaattatggcctatgaagtgtggaatctgagactgctggcaagatggccgactaggaacagctctggtgcacagctcccagcaagatccacgcaggaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgc

SEQ ID NO: 186774 - DNA, 579 bp, Homo sapiens
  Payload ID: 16773
  Gene Symbol: STEAP2
  Gene Name: STEAP family member 2, metalloreductase
  ENST ID: ENST00000426158
  CDS Start-End: 316-579
taggcggggaagcagctggagtgcgaccgccgcggcagccaccctgcaaccgccagtcggaggtgcagtccgtaggccctggcccccgggtgggcccttggggagtcggcgccgctcccggggagctgcaaggctcgcccctgcccggcgtggagggcgcggggggcgcggagtgaagagaggaaattggaaaattgtgagtggaccttctgatactgctcctccttgcgtggaaaaggggaaagaactgcatgcatattattcagcgtcctatattcaaaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatata

SEQ ID NO: 186775 - DNA, 3915 bp, Homo sapiens
  Payload ID: 16774
  Gene Symbol: STEAP3
  Gene Name: STEAP family member 3, metalloreductase
  Uniprot ID: Q658P3
  ENST ID: ENST00000393106
  CDS Start-End: 135-1601
accgccttcgccgcggaccttcagctgccgcggtcgctccgagcggcgggccgcagaggttcaagcgattctcctgcttcagcctccggagtagctgggattacaggcacgtgccaacacacccagccaccaaaatgccagaagagatggacaagccactgatcagcctccacctggtggacagcgatagtagccttgccaaggtccccgatgaggcccccaaagtgggcatcctgggtagcggggactttgcccgctccctggccacacgcctggtgggctctggcttcaaagtggtggtggggagccgcaaccccaaacgcacagccaggctgtttccctcagcggcccaagtgactttccaagaggaggcagtgagctccccggaggtcatctttgtggctgtgttccgggagcactactcttcactgtgcagtctcagtgaccagctggcgggcaagatcctggtggatgtgagcaaccctacagagcaagagcaccttcagcatcgtgagtccaatgctgagtacctggcctccctcttccccacttgcacagtggtcaaggccttcaatgtcatctctgcctggaccctgcaggctggcccaagggatggtaacaggcaggtgcccatctgcggtgaccagccagaagccaagcgtgctgtctcggagatggcgctcgccatgggcttcatgcccgtggacatgggatccctggcgtcagcctgggaggtggaggccatgcccctgcgcctcctcccggcctggaaggtgcccaccctgctggccctggggctcttcgtctgcttctatgcctacaacttcgtccgggacgttctgcagccctatgtgcaggaaagccagaacaagttcttcaagctgcccgtgtccgtggtcaacaccacactgccgtgcgtggcctacgtgctgctgtcactcgtgtacttgcccggcgtgctggcggctgccctgcagctgcggcgcggcaccaagtaccagcgcttccccgactggctggaccactggctacagcaccgcaagcagatcgggctgctcagcttcttctgcgccgccctgcacgccctctacagcttctgcttgccgctgcgccgcgcccaccgctacgacctggtcaacctggcagtcaagcaggtcttggccaacaagagccacctctgggtggaggaggaggtctggcggatggagatctacctctccctgggagtgctggccctcggcacgttgtccctgctggccgtgacctcactgccgtccattgcaaactcgctcaactggagggagttcagcttcgttcagtcctcactgggctttgtggccctcgtgctgagcacactgcacacgctcacctacggctggacccgcgccttcgaggagagccgctacaagttctacctgcctcccaccttcacgctcacgctgctggtgccctgcgtcgtcatcctggccaaagccctgtttctcctgccctgcatcagccgcagactcgccaggatccggagaggctgggagagggagagcaccatcaagttcacgctgcccacagaccacgccctggccgagaagacgagccacgtatgaggtgcctgccctgggctctggaccccgggcacacgagggacggtgccctgagcccgttaggttttcttttcttggtggtgcaaagtggtataactgtgtgcaaataggaggtttgaggtccaaattcctgggactcaaatgtatgcagtactattcagaatgatatacacacatatgtgtatatgtatttacatatattccacatatataacaggatttgcaattatacatagctagctaaaaagttgggtctctgagatttcaacttgtagatttaaaaacaagtgccgtacgttaagagaagagcagatcatgctattgtgacatttgcagagatatacacacactttttgtacagaagaggcttgtgctgtggtgggttcgatttatccctgcccaccccacccccacaacttcccttttgctacttccccaaggctcttgcagagctagggctctgaaggggagggaaggcaacggctctgcccagagccatccctggagcatgtgagcagcggctggtctcttccctccacctggggcagcagcaggaggcctggggaggaggaaaatcaggcagtcggcctggagtctgtgcctggtcctttgcccggtggtgggaggatggagggattgggctgaagctgctccacctcatccttgctgagtgggggagacattttccctgaaagtcagaagtcaccatagagcctgcaaatggatcctcctgtgagagtgacgtcacctcctttccagagccattagtgagcctggcttgggaacaagtgtaatttccttccctcctttaacctggcgatgagcgtcctttaaaccactgtgccttctcaccctttccatcttcagtttgaatgactcccaggaaggcctagagcagaccctttagaaatcagcccaagggggagagcaagagaaaacactctagggagtaaagctccccgggcgtcagagttgagccctgcctgggctgaaggactgtcttcacgaagtcagtcctgaggaaaaatattggggactccaaatgtcctctggcagaggacccagaaaaccacactggctccaacttcctcctcatggggcattacacttcaaaacagtggggagcaacttttccaccaaagctacaaacctaaaatgctgctgccccaaagcacaagagggaagagcaccgccggggccacaggacgtctgtcctccagtcacaggccatccttgctgctccctactgactctagcttacttcccctgtgaagaaacaggtgttctcggctgagcccccaaccctctgcagaaccaggttgatctgccacagaaaaagcatctttgaagacaaagagggtgaggtcttcatgagtctcctgggcccaaagccatcttctgatggaaggaagagagtagggccagtgaaggctgcccagagagaatgtcacagatgaggctgcccctgccccccccccgccagggaggtttcatgagctcatgtctatgcagcacataagggttcttcagtgaaaagcaggagaagagcccactgcaaggatagctcattaggcacatgaccgatgcagggaaggccatgccggggaagctcttcctgcaggtattttccatctgctgtgccaaggctgagcggcagaaacttgtctcataaattggcactgatggagcatcagctgtggcccacagagagccttgctgagaagggggcaggtaaagcagagattttagcattgccttggcataacaagggcccatcgattccctactaatgagaggcagggagagcatgggcaatggagacccaccaatgatccccaaccccggtgggtactggctgcctgccctgggccagggaatggctccttataccaaagatgctggcacatagcagaacccagtgcacgtcctccccttcccacccacctctggctgaaggtgctcaagagggaagcaattataaggtgggtggcaggagggaacaggtgccacctgctggacaatcacacgaaaggcaggcgggctgtgtactgggccctgactgtgcgtccactgctgtcttccctacctcaccaggctactggcagcagcatcccgagagcacatcatctccacagcctggtaaattccatgtgcctctgggtacaaaagtgcctcaacgacatgctctggaaatcccaaatgccacagtctgaggttgatatctaaaatctatgccttcaaaagagtctctgttttttttttttaacctggtagacagtataaaagcagtgcaaataaacacctaaccttctgcaaa

SEQ ID NO: 186776 - DNA, 1871 bp, Homo sapiens
  Payload ID: 16774
  Gene Symbol: STEAP3
  Gene Name: STEAP family member 3, metalloreductase
  Uniprot ID: Q658P3
  ENST ID: ENST00000393107
  CDS Start-End: 45-1511
agctgccgcggtcgctccgagcggcgggccgcagagccaccaaaatgccagaagagatggacaagccactgatcagcctccacctggtggacagcgatagtagccttgccaaggtccccgatgaggcccccaaagtgggcatcctgggtagcggggactttgcccgctccctggccacacgcctggtgggctctggcttcaaagtggtggtggggagccgcaaccccaaacgcacagccaggctgtttccctcagcggcccaagtgactttccaagaggaggcagtgagctccccggaggtcatctttgtggctgtgttccgggagcactactcttcactgtgcagtctcagtgaccagctggcgggcaagatcctggtggatgtgagcaaccctacagagcaagagcaccttcagcatcgtgagtccaatgctgagtacctggcctccctcttccccacttgcacagtggtcaaggccttcaatgtcatctctgcctggaccctgcaggctggcccaagggatggtaacaggcaggtgcccatctgcggtgaccagccagaagccaagcgtgctgtctcggagatggcgctcgccatgggcttcatgcccgtggacatgggatccctggcgtcagcctgggaggtggaggccatgcccctgcgcctcctcccggcctggaaggtgcccaccctgctggccctggggctcttcgtctgcttctatgcctacaacttcgtccgggacgttctgcagccctatgtgcaggaaagccagaacaagttcttcaagctgcccgtgtccgtggtcaacaccacactgccgtgcgtggcctacgtgctgctgtcactcgtgtacttgcccggcgtgctggcggctgccctgcagctgcggcgcggcaccaagtaccagcgcttccccgactggctggaccactggctacagcaccgcaagcagatcgggctgctcagcttcttctgcgccgccctgcacgccctctacagcttctgcttgccgctgcgccgcgcccaccgctacgacctggtcaacctggcagtcaagcaggtcttggccaacaagagccacctctgggtggaggaggaggtctggcggatggagatctacctctccctgggagtgctggccctcggcacgttgtccctgctggccgtgacctcactgccgtccattgcaaactcgctcaactggagggagttcagcttcgttcagtcctcactgggctttgtggccctcgtgctgagcacactgcacacgctcacctacggctggacccgcgccttcgaggagagccgctacaagttctacctgcctcccaccttcacgctcacgctgctggtgccctgcgtcgtcatcctggccaaagccctgtttctcctgccctgcatcagccgcagactcgccaggatccggagaggctgggagagggagagcaccatcaagttcacgctgcccacagaccacgccctggccgagaagacgagccacgtatgaggtgcctgccctgggctctggaccccgggcacacgagggacggtgccctgagcccgttaggttttcttttcttggtggtgcaaagtggtataactgtgtgcaaataggaggtttgaggtccaaattcctgggactcaaatgtatgcagtactattcagaatgatatacacacatatgtgtatatgtatttacatatattccacatatataacaggatttgcaattatacatagctagctaaaaagttgggtctctgagatttcaacttgtagatttaaaaacaagtgccgtacgttaagagaagagcagatcatgctattgtgacatttgcagagatatacacacactttttgtacagaa

SEQ ID NO: 186777 - DNA, 4262 bp, Homo sapiens
  Payload ID: 16774
  Gene Symbol: STEAP3
  Gene Name: STEAP family member 3, metalloreductase
  Uniprot ID: Q658P3
  ENST ID: ENST00000393110
  CDS Start-End: 452-1948
accgccttcgccgcggaccttcagctgccgcggtcgctccgagcggcgggccgcagagatgacatttattcattttatgcatcctgggttctactggtcgtcccacctcagttcctgtagcaaagagacttgagtctgagccactaattatcacccgtgaggtttcctccccgagcaggaagcagcaggccagagctgcgctctctcagtgcactctccaaccaagcatcagtcaccactcccggtccagcccctgtggccaagagctggcgtgcaggctgcgggaggcagctggctgtgcaagaccctggcagggccctcgcctcctgagaaaccgagagtcagaaccaaagccaggctgtcctggttggagactgagccagaaagggtggctcacctcacggtgaggctgtcgagtgacctgagagcctcagaccctcacgtcagccggatgtcgcaccagcctgctgttgccaccaaaatgccagaagagatggacaagccactgatcagcctccacctggtggacagcgatagtagccttgccaaggtccccgatgaggcccccaaagtgggcatcctgggtagcggggactttgcccgctccctggccacacgcctggtgggctctggcttcaaagtggtggtggggagccgcaaccccaaacgcacagccaggctgtttccctcagcggcccaagtgactttccaagaggaggcagtgagctccccggaggtcatctttgtggctgtgttccgggagcactactcttcactgtgcagtctcagtgaccagctggcgggcaagatcctggtggatgtgagcaaccctacagagcaagagcaccttcagcatcgtgagtccaatgctgagtacctggcctccctcttccccacttgcacagtggtcaaggccttcaatgtcatctctgcctggaccctgcaggctggcccaagggatggtaacaggcaggtgcccatctgcggtgaccagccagaagccaagcgtgctgtctcggagatggcgctcgccatgggcttcatgcccgtggacatgggatccctggcgtcagcctgggaggtggaggccatgcccctgcgcctcctcccggcctggaaggtgcccaccctgctggccctggggctcttcgtctgcttctatgcctacaacttcgtccgggacgttctgcagccctatgtgcaggaaagccagaacaagttcttcaagctgcccgtgtccgtggtcaacaccacactgccgtgcgtggcctacgtgctgctgtcactcgtgtacttgcccggcgtgctggcggctgccctgcagctgcggcgcggcaccaagtaccagcgcttccccgactggctggaccactggctacagcaccgcaagcagatcgggctgctcagcttcttctgcgccgccctgcacgccctctacagcttctgcttgccgctgcgccgcgcccaccgctacgacctggtcaacctggcagtcaagcaggtcttggccaacaagagccacctctgggtggaggaggaggtctggcggatggagatctacctctccctgggagtgctggccctcggcacgttgtccctgctggccgtgacctcactgccgtccattgcaaactcgctcaactggagggagttcagcttcgttcagtcctcactgggctttgtggccctcgtgctgagcacactgcacacgctcacctacggctggacccgcgccttcgaggagagccgctacaagttctacctgcctcccaccttcacgctcacgctgctggtgccctgcgtcgtcatcctggccaaagccctgtttctcctgccctgcatcagccgcagactcgccaggatccggagaggctgggagagggagagcaccatcaagttcacgctgcccacagaccacgccctggccgagaagacgagccacgtatgaggtgcctgccctgggctctggaccccgggcacacgagggacggtgccctgagcccgttaggttttcttttcttggtggtgcaaagtggtataactgtgtgcaaataggaggtttgaggtccaaattcctgggactcaaatgtatgcagtactattcagaatgatatacacacatatgtgtatatgtatttacatatattccacatatataacaggatttgcaattatacatagctagctaaaaagttgggtctctgagatttcaacttgtagatttaaaaacaagtgccgtacgttaagagaagagcagatcatgctattgtgacatttgcagagatatacacacactttttgtacagaagaggcttgtgctgtggtgggttcgatttatccctgcccaccccacccccacaacttcccttttgctacttccccaaggctcttgcagagctagggctctgaaggggagggaaggcaacggctctgcccagagccatccctggagcatgtgagcagcggctggtctcttccctccacctggggcagcagcaggaggcctggggaggaggaaaatcaggcagtcggcctggagtctgtgcctggtcctttgcccggtggtgggaggatggagggattgggctgaagctgctccacctcatccttgctgagtgggggagacattttccctgaaagtcagaagtcaccatagagcctgcaaatggatcctcctgtgagagtgacgtcacctcctttccagagccattagtgagcctggcttgggaacaagtgtaatttccttccctcctttaacctggcgatgagcgtcctttaaaccactgtgccttctcaccctttccatcttcagtttgaatgactcccaggaaggcctagagcagaccctttagaaatcagcccaagggggagagcaagagaaaacactctagggagtaaagctccccgggcgtcagagttgagccctgcctgggctgaaggactgtcttcacgaagtcagtcctgaggaaaaatattggggactccaaatgtcctctggcagaggacccagaaaaccacactggctccaacttcctcctcatggggcattacacttcaaaacagtggggagcaacttttccaccaaagctacaaacctaaaatgctgctgccccaaagcacaagagggaagagcaccgccggggccacaggacgtctgtcctccagtcacaggccatccttgctgctccctactgactctagcttacttcccctgtgaagaaacaggtgttctcggctgagcccccaaccctctgcagaaccaggttgatctgccacagaaaaagcatctttgaagacaaagagggtgaggtcttcatgagtctcctgggcccaaagccatcttctgatggaaggaagagagtagggccagtgaaggctgcccagagagaatgtcacagatgaggctgcccctgccccccccccgccagggaggtttcatgagctcatgtctatgcagcacataagggttcttcagtgaaaagcaggagaagagcccactgcaaggatagctcattaggcacatgaccgatgcagggaaggccatgccggggaagctcttcctgcaggtattttccatctgctgtgccaaggctgagcggcagaaacttgtctcataaattggcactgatggagcatcagctgtggcccacagagagccttgctgagaagggggcaggtaaagcagagattttagcattgccttggcataacaagggcccatcgattccctactaatgagaggcagggagagcatgggcaatggagacccaccaatgatccccaaccccggtgggtactggctgcctgccctgggccagggaatggctccttataccaaagatgctggcacatagcagaacccagtgcacgtcctccccttcccacccacctctggctgaaggtgctcaagagggaagcaattataaggtgggtggcaggagggaacaggtgccacctgctggacaatcacacgaaaggcaggcgggctgtgtactgggccctgactgtgcgtccactgctgtcttccctacctcaccaggctactggcagcagcatcccgagagcacatcatctccacagcctggtaaattccatgtgcctctgggtacaaaagtgcctcaacgacatgctctggaaatcccaaatgccacagtctgaggttgatatctaaaatctatgccttcaaaagagtctctgttttttttttttaacctggtagacagtataaaagcagtgcaaataaacacctaaccttctgcaaa

SEQ ID NO: 186778 - DNA, 2103 bp, Homo sapiens
  Payload ID: 16774
  Gene Symbol: STEAP3
  Gene Name: STEAP family member 3, metalloreductase
  ENST ID: ENST00000409811
  CDS Start-End: 45-1418
agctgccgcggtcgctccgagcggcgggccgcagagccaccaaaatgccagaagagatggacaagccactgatcagcctccacctggtggacagcgatagtagccttgccaaggtccccgatgaggcccccaaagtgggcatcctgggtagcggggactttgcccgctccctggccacacgcctggtgggctctggcttcaaagtggtggtggggagccgcaaccccaaacgcacagccaggctgtttccctcagcggcccaagtgactttccaagaggaggcagtgagctccccggaggtcatctttgtggctgtgttccgggagcactactcttcactgtgcagtctcagtgaccagctggcgggcaagatcctggtggatgtgagcaaccctacagagcaagagcaccttcagcatcgtgagtccaatgctgagtacctggcctccctcttccccacttgcacagtggtcaaggccttcaatgtcatctctgcctggaccctgcaggctggcccaagggatggtaacaggcaggtgcccatctgcggtgaccagccagaagccaagcgtgctgtctcggagatggcgctcgccatgggcttcatgcccgtggacatgggatccctggcgtcagcctgggaggtggaggccatgcccctgcgcctcctcccggcctggaaggtgcccaccctgctggccctggggctcttcgtctgcttctatgcctacaacttcgtccgggacgttctgcagccctatgtgcaggaaagccagaacaagttcttcaagctgcccgtgtccgtggtcaacaccacactgccgtgcgtggcctacgtgctgctgtcactcgtgtacttgcccggcgtgctggcggctgccctgcagctgcggcgcggcaccaagtaccagcgcttccccgactggctggaccactggctacagcaccgcaagcagatcgggctgctcagcttcttctgcgccgccctgcacgccctctacagcttctgcttgccgctgcgccgcgcccaccgctacgacctggtcaacctggcagtcaagcaggtcttggccaacaagagccacctctgggtggaggaggaggtctggcggatggagatctacctctccctgggagtgctggccctcggcacgttgtccctgctggccgtgacctcactgccgtccattgcaaactcgctcaactggagggagttcagcttcgttcagtgtgtggcaacttccagtgcaggaaacacaggcagtggaacccgaagacctgaatctcagtcccaagacccccacttacctgccccgcatcatcagacaagtttcctaggccctcggagcttctgctgctcacttgtgcctgtgtccaccccatatggtcatcaagaggatttgagctggacacgttaaatgcaggatgcgtgcagccaacagtggcatgctggcttttgagtcctcactgggctttgtggccctcgtgctgagcacactgcacacgctcacctacggctggacccgcgccttcgaggagagccgctacaagttctacctgcctcccaccttcacgctcacgctgctggtgccctgcgtcgtcatcctggccaaagccctgtttctcctgccctgcatcagccgcagactcgccaggatccggagaggctgggagagggagagcaccatcaagttcacgctgcccacagaccacgccctggccgagaagacgagccacgtatgaggtgcctgccctgggctctggaccccgggcacacgagggacggtgccctgagcccgttaggttttcttttcttggtggtgcaaagtggtataactgtgtgcaaataggaggtttgaggtccaaattcctgggactcaaatgtatgcagtactattcagaatgatatacacacatatgtgtatatgtatttacatatattccacatatataacaggatttgcaattatacatagctagctaaaaagttgggtctctgagatttcaacttgtagatttaaaaacaagtgccgtacgttaagagaagagcagatcatgctattgtgacatttgcagagatatacacacactttttgtacagaa

SEQ ID NO: 186779 - DNA, 2321 bp, Homo sapiens
  Payload ID: 16775
  Gene Symbol: STEAP4
  Gene Name: STEAP family member 4
  Uniprot ID: Q687X5
  ENST ID: ENST00000301959
  CDS Start-End: 100-951
gagctgcaggcgcggcgaaacttccctctacccgcccggcccgcggcgcgcaccgttggcgctggacgcttcctccttggaagcgcctctccctcagttatggagaaaacttgtatagatgcacttcctcttactatgaattcttcagaaaagcaagagactgtatgtatttttggaactggtgattttggaagatcactgggattgaaaatgctccagtgtggttattctgttgtttttggaagtcgaaacccccagaagaccaccctactgcccagtggtgcagaagtcttgagctattcagaagcagccaagaagtctggcatcataatcatagcaatccacagagagcattatgattttctcacagaattaactgaggttctcaatggaaaaatattggtagacatcagcaacaacctcaaaatcaatcaatatccagaatctaatgcagagtaccttgctcatttggtgccaggagcccacgtggtaaaagcatttaacaccatctcagcctgggctctccagtcaggagcactggatgcaagtcggcaggcaatactcaagaaggagaatccatttagcacctcctcagcctggctcagtgattcatatgtggctttgggaatacttgggttttttctgtttgtactcttgggaatcacttctttgccatctgttagcaatgcagtcaactggagagagttccgatttgtccagtccaaactgggttatttgaccctgatcttgtgtacagcccacaccctggtgtacggtgggaagagattcctcagcccttcaaatctcagatggtatcttcctgcagcctacgtgttagggcttatcattccttgcactgtgctggtgatcaagtttgtcctaatcatgccatgtgtagacaacacccttacaaggatccgccagggctgggaaaggaactcaaaacactagaaaaagcattgaatggaaaatcaatatttaaaacaaagttcaatttagctggatttctgaactatggttttgaatgtttaaagaagaatgatgggtacagttaggaaagtttttttcttacaccgtgactgagggaaacattgcttgtctttgagaaattgactgacatactggaagagaacaccattttatctcaggttagtgaagaatcagtgcaggtccctgactcttattttcccagaggccatggagctgagattgagactagccttgtggtttcacactaaagagtttccttgttatgggcaacatgcatgacctaatgtcttgcaaaatccaatagaagtattgcagcttccttctctggctcaagggctgagttaagtgaaaggaaaaacagcacaatggtgaccactgataaaggctttattaggtatatctgaggaagtgggtcacatgaaatgtaaaaagggaatgaggtttttgttgttttttggaagtaaaggcaaacataaatattaccatgatgaattctagtgaaatgaccccttgactttgcttttcttaatacagatatttactgagaggaactatttttataacacaagaaaaatttacaattgattaaaagtatccatgtcttggatacatacgtatctatagagctggcatgtaattcttcctctataaagaataggtataggaaagactgaataaaaatggagggatatccccttggatttcacttgcattgtgcaataagcaaagaagggttgataaaagttcttgatcaaaaagttcaaagaaaccagaattttagacagcaagctaaataaatattgtaaaattgcactatattaggttaagtattatttaggtattataatatgctttgtaaattttatattccaaatattgctcaatatttttcatctattaaattaatttctagtgtaaataagtagcttctatatctgtcttagtctattataattgtaaggagtaaaattaaatgaatagtctgcaggtataaatttgaacaatgcatagatgatcgaaaattacggaaaatcatagggcagagaggtgtgaagattcatcattatgtgaaatttggatctttctcaaatccttgctgaaatttaggatggttctcactgtttttctgtgctgatagtaccctttccaaggtgaccttcagggggattaaccttcctagctcaagcaatgagctaaaaggagccttatgcatgatcttcccacatatcaaaataactaaaaggcactgagtttggcatttttctgcctgctctgctaagacctttttttttttttactttcattataacatattatacatgacattatac

SEQ ID NO: 186780 - DNA, 9988 bp, Homo sapiens
  Payload ID: 16775
  Gene Symbol: STEAP4
  Gene Name: STEAP family member 4
  Uniprot ID: Q687X5
  ENST ID: ENST00000380079
  CDS Start-End: 103-1482
gctgagctgcaggcgcggcgaaacttccctctacccgcccggcccgcggcgcgcaccgttggcgctggacgcttcctccttggaagcgcctctccctcagttatggagaaaacttgtatagatgcacttcctcttactatgaattcttcagaaaagcaagagactgtatgtatttttggaactggtgattttggaagatcactgggattgaaaatgctccagtgtggttattctgttgtttttggaagtcgaaacccccagaagaccaccctactgcccagtggtgcagaagtcttgagctattcagaagcagccaagaagtctggcatcataatcatagcaatccacagagagcattatgattttctcacagaattaactgaggttctcaatggaaaaatattggtagacatcagcaacaacctcaaaatcaatcaatatccagaatctaatgcagagtaccttgctcatttggtgccaggagcccacgtggtaaaagcatttaacaccatctcagcctgggctctccagtcaggagcactggatgcaagtcggcaggtgtttgtgtgtggaaatgacagcaaagccaagcaaagagtgatggatattgttcgtaatcttggacttactccaatggatcaaggatcactcatggcagccaaagaaattgaaaagtaccccctgcagctatttccaatgtggaggttccccttctatttgtctgctgtgctgtgtgtcttcttgtttttctattgtgttataagagacgtaatctacccttatgtttatgaaaagaaagataatacatttcgtatggctatttccattccaaatcgtatctttccaataacagcacttacactgcttgctttggtttacctccctggtgttattgctgccattctacaactgtaccgaggcacaaaataccgtcgattcccagactggcttgaccactggatgctttgccgaaagcagcttggcttggtagctctgggatttgccttccttcatgtcctctacacacttgtgattcctattcgatattatgtacgatggagattgggaaacttaaccgttacccaggcaatactcaagaaggagaatccatttagcacctcctcagcctggctcagtgattcatatgtggctttgggaatacttgggttttttctgtttgtactcttgggaatcacttctttgccatctgttagcaatgcagtcaactggagagagttccgatttgtccagtccaaactgggttatttgaccctgatcttgtgtacagcccacaccctggtgtacggtgggaagagattcctcagcccttcaaatctcagatggtatcttcctgcagcctacgtgttagggcttatcattccttgcactgtgctggtgatcaagtttgtcctaatcatgccatgtgtagacaacacccttacaaggatccgccagggctgggaaaggaactcaaaacactagaaaaagcattgaatggaaaatcaatatttaaaacaaagttcaatttagctggatttctgaactatggttttgaatgtttaaagaagaatgatgggtacagttaggaaagtttttttcttacaccgtgactgagggaaacattgcttgtctttgagaaattgactgacatactggaagagaacaccattttatctcaggttagtgaagaatcagtgcaggtccctgactcttattttcccagaggccatggagctgagattgagactagccttgtggtttcacactaaagagtttccttgttatgggcaacatgcatgacctaatgtcttgcaaaatccaatagaagtattgcagcttccttctctggctcaagggctgagttaagtgaaaggaaaaacagcacaatggtgaccactgataaaggctttattaggtatatctgaggaagtgggtcacatgaaatgtaaaaagggaatgaggtttttgttgttttttggaagtaaaggcaaacataaatattaccatgatgaattctagtgaaatgaccccttgactttgcttttcttaatacagatatttactgagaggaactatttttataacacaagaaaaatttacaattgattaaaagtatccatgtcttggatacatacgtatctatagagctggcatgtaattcttcctctataaagaataggtataggaaagactgaataaaaatggagggatatccccttggatttcacttgcattgtgcaataagcaaagaagggttgataaaagttcttgatcaaaaagttcaaagaaaccagaattttagacagcaagctaaataaatattgtaaaattgcactatattaggttaagtattatttaggtattataatatgctttgtaaattttatattccaaatattgctcaatatttttcatctattaaattaatttctagtgtaaataagtagcttctatatctgtcttagtctattataattgtaaggagtaaaattaaatgaatagtctgcaggtataaatttgaacaatgcatagatgatcgaaaattacggaaaatcatagggcagagaggtgtgaagattcatcattatgtgaaatttggatctttctcaaatccttgctgaaatttaggatggttctcactgtttttctgtgctgatagtaccctttccaaggtgaccttcagggggattaaccttcctagctcaagcaatgagctaaaaggagccttatgcatgatcttcccacatatcaaaataactaaaaggcactgagtttggcatttttctgcctgctctgctaagacctttttttttttttactttcattataacatattatacatgacattatacaaaaatgattaaaatatattaaaacaacatcaacaatccaggatatttttctataaaactttttaaaaataattgtatctatatattcaattttacatcctttttcaaaggctttgtttttctaaaggctttgttttcctttttattatttttttcttttttatttttttgagacagtcttgctctgtcgctcaggctggagtgcagtggcacgatctcagctcactgcaacctcctcctcccaggttcaagtgattcttgttcatcagcctcccgagtagctgggactacaggcatgtgccactatgcccagctaatttttgtacttttagtagagacagggtttcaccacattggtcaggctggtcttgaaatgctggcgtcaagtgatctgcctgcctccgcctcacaaagcactgggattacaggcatgaatctggccttacgtaatatattttcttaatggctgcataatatcacatcaaataggcatttttcaaacctctttccttattaaacatgtagactatatccattttttactaaaataaataacatttcagataatatctttgcactgataatgttgccaagccatttctaaagtgaccttatcaatttaattaccattggatgagggtgttgctttcatcgcaccattgtagattgtcttttttatttcaatttgcgtttatttataactggttgcaaaggtacacagaacacacgctccttcaacttatctttgataaacccaagcaaggatacaaaaagttggacgacattgagtagagtcatggtatacggtgctgaccctacagtatcagtggaaaagataaggaaaatgtcactactcacctatgttatgcaaaacagttaggtgtgctggggctggatactgctcttttacttgagcattggttgattaaagtttaggtaccatccaggctggtctagagaagtctttggagttaaccatgctctttttgttaaagaagagagtaatgtgtttatcctggctcatagtccgtcaccgaaaatagaaaatgccatccataggtaaaatgctgacctatagaaaaaaatgaactctacttttatagcctagtaaaaatgctctacctgagtagttaaaagcaattcatgaagcctgaagctaaagagcactctgatggttttggcataatagctgcatttccagacctgacctttggccccaaccacaagtgctccaagccccaccagctgaccaaagaaagcccaagttctccttctgtccttcccacaacctccctgctcccaaaactatgaaattaatttgaccatattaacacagctgactcctccagtttacttaaggtagaaagaatgagtttacaacagatgaaaataagtgctttgggcgaactgtattccttttaacagatccaaactattttacatttaaaaaaaaagttaaactaaacttctttactgctgatatgtttcctgtattctagaaaaatttttacactttcacattatttttgtacactttccccatgttaagggatgatggcttttataaatgtgtattcattaaatgttactttaaaaatatttcctagttttgtttaattctggttttaactcatcagcattccaaataaagttactaaaaggttttgaatcacagtagttccagcatctgggactaaaaatacttcccttcagggataagcaaaagagaaggcagtgcatgggtttgaaagtgcattaacagatctgcagcttcttgcaatgtaagcttgagctcagcggggtggcacagtccagtatgctgtgtgtgcttcagtattaccctcagagaggggagagcatcagatggctaaatggggaggactgcactatcccacgctggatttttgtgagaatttggaggtaaaaaaggctttccttctccatgcagacgccacagggataaggctaatggcttgacaagcagacttcaggttggattcagactgcgtgactgggcattaaatgccttgcacaactggactgctgcagctctgatgggtgttatcctgctttcaaaaatagtattaaaacttacaaataaagagaggactgacaacctggaggaagctggaagcaaatggaaagcccctactgaaaaagccatttcaattagaaattcattcaggagctcttcattcatctattgttcagggatcacaaaagagccatgataatgataaatgcatattatgcatttcacctctgagagcataaaagcttctggaactctgttccaaaattaaggtgtaatggcagtcatggtactgcacacagtagttgcaattttcattctccatcatcacaaccatcatcttcactaccacttctccaacacacacacacacacacacacacacacacacacaccccatgagagcccacagatagccttacagggtcctacttcaattttctataatgaattaggtttacattctagaaaaatccttcactcttctaaaggtttgttcagtagaatttgggaaaagagtataagttactcttcaatgtatcagaagcatttggaccaggtgactccatcttcaatagaggctgagtaaaataagcctgagactggccgggcgcagtgactcacacctgtaatcccagcactttgggaggccaagtcaggtggatcacctgaggtcaggagtttgagaccagcctggccaacatggtgaaaccccatctctactaaaaatataaaaaattagccagcatggtggcgcatgcctgtaatcccagctactctggaggctgaggcaggagaagtgcttggacccaggaagcagaggttacaatgagccaagatcgcgccattgcactccagcctgggtgacaagagtgaaactccgtctcaaaataaataaataaataaataagactgagacctactgggctgcattcccaggacagcaggtgttcttagtcacaggatgagataggagtaagcacaaggtacaggtcacaaagaccttgctgataaaacaggatgcaataaagaagccgtccaaaacctaccaaaaccaagatggcaatgaaagtgatctttggctgtctcagctgttcattatatgctaattataatatattagcagcctaaaatacactcccactagcaccatgacagtttacaaattccatggccacatccagaagttaccctatatgttctaaaagcaggaggagccctcagttctgggaatcatctgcccctttcctgaacatctcatgaataatccatcccttgtttagcatataatcaagaaataactataactatactcagccaggcagcccatgccactgctctgcctatgaaatagcccttttattcctttacagtcttaataaacttgctttcattttatggattcacctcaaattctttcttgtgcaagatccaagaactctctcttggggtctgtattggaccccctttctggtaacatatgcattacctctcctcaagctcgaggcaaagtcctaaagtttcggataagacccatatgagggaggtgaaggatgaagggattgagggcaaagggactgagaaaaggggagtgtggaagagcaagacagtgctcttgccattacccagcaaaagccaaaaggatccagtactacttgctttctgctgtaagggaattttggaaggcttttaatgatacttacagcagagtgccatgcgtaaagcctatgctaacaatttcacatgcattatcttatttaatcctcataacagttctctaaggttctcttcttatccttatttatcagaagaggaaactgagctttgaaatctcagtactttgactaagttcacacaactaatgagaggcagagctgggatctaggcagtctgactccaggcccatctccttttaacacaacgatataataggggacacccatgctgtcctcttaaatgtccctttgaatccacaaaatagactaagtgaacgaaaccactgcaactcttcttaaaaacatttttaaagacaagaagcttattcgcattttaaatattcctgattgcccagtcctcaatactccaggtttatctatgctgatttcaattcgtcctctaaggttgtagaaacacaggatctgtggttcccgcattaagttcaattccattgcaattgccattttaatcttcccactctagtctggccacaaggtttcctaaactctaaagggagctttgttctggtggagggaggtaaaatccccagacctgaggactcgaaggggcagtcaaggagaggatagctcttctccagagcttaaaggcaaatattttctttttccctggtttctcaccttattgctttgtgtactgagtgaacttatttgtttttgagatccagtaacccatgcaagaaatttcataacacttctcatttagtactttaatactagttgaagaatctagggttacacacacacacacacacacacaccaggcttagttccattacctatagctgtaaaaatgagatttttttctcagttttgtgaaaatgaaaggctgctggactggaactcacagtattgtatatcaaaaagtatcagattgtgataaaatagaaacccagaattaaacttggccttatgatttttagaaagtcaacagattttgaaggagcccacccagtgtattcatttcatttttactaatcctttctttcatgctaagatagagatgaaaaagaatgacagacttcctgttctcatttcattacagcaaaataaataagttttagtgttccatagctctgtaggatgactatagttaaaaataacatataatttcaaatagccaggaggacattgactgttcccaacacaaagaaatgataaatgtttgcaatgatggatatgctaattacactgatctgatcactatacattgtacatacataaacatgactatgtacctcatggatatgtacaactgttatttgtcagttttagaaaataaaaaagcagaagagatctgctaccaaatgcaggaattttctatagagtctgttatagctagccttctacaggcttaactcttctcatgatggagtattgaccatcaccaacaggaaatcttttgttttaggcactccaggaaattatcagggagttctctctgtagataaccaaagtttccctagttgtacttctacccatttttcttagtgtgatcatttaaagcagtgcctcaccaactatcagagatgggggccagtaatttttgtttcatttttttccagttcattacaaatcaatgcatatgtctgtaaaacacaaaatcacacccttaaatgtgatggcaacatcaaattgccataaaagtttctaaacttttcaccccaatttctgaatttatcacagactggtaaaaaacagctcacaagccagcaccacgggcagaccacactttgcacagtgctcaaacgtaggcctaacaacctggcttggcttggcacttctaaaaaccgatcctgaggcaaggcttcttgtaaaagagtttatactggaagttaaaaatcatcaaattattagatactgggaatggagtagtaaagtagacagagcagggaaggaataaagtatgaattttcaagctggttacccatctgggcaactggagctcagttttgctgggaaagtctggaagacagtgtcagatataactaagagttattcccatcaaggggaaaggaaactgtgcttttcatccaccaaatccttgcttaacattggaatacagatgcttccaagacattaactttgtggcacttctggcttttcctacacacttattgtgtatgccaccatgtctagggggaaaaaggcccacaggcaaagaggtaccagcattcataccaccagctttcagcttgtagaggtggccgccaagaggaactcgtagttggcagtgccaactacaactactacaccaaccagctggaaactatacaaagagtatgaacaaagttcacaggagaaacaaggctctgcaacatatgaaaatatattctacttcattcataatgagacgcatgaaaattgtaactgtatcaataccatttctcacctagtagatgggcaaaaatccaaatgtttgagcacacattctgtgggtgaggctgtggaaacgtaggttcacatacattgctcttggatatgcagattaggaccgctcctgtggagagcagttagggaatatctttcaaaattaaaaaatgcagagttaagttttgatccaggagtctcactcctgagaatttatgctatagatatgcctacaagcatttgagatgaaaaagaagcattgctatttgtttttcttgtttttcatgaataacattgtaaaagtagaatatgggcagtgattcaagcattcatctttgggactggttaaggaaactatgatgctttcacagaatgaaattctatgcagctgtttaaaacaaaccaagacaccttctttcacatatatggaaagatgtccaaaatatactgttcagtttttaaaaaggtacaaaataacatatatagtatgattccttttgcatatgtgtatttgcttttaattgcctaaagaaactctcagaaggattcaaaagatccataccaaacaagatgggagaacagaggagtagtgacaggagtagaagcactgtagaccttttcatatcattttggtttttaaattacatgagtaggttacctaattattaaaataaatttaatttaaaaggtaatgggggataggaagaaatttgttaaaagatacaaaattacagctagataggaagattaagttgtagtgttctatagctctgtaggatgactacagttaacaataatatatattctaaatagctagaaggaggatattgaatgttctcaacagaaagaaatgataaatgcttaagatgatggatatactaattaccctaatctgatcactgtatattttgtgtattgcaatgtcactatgtaccccataaatatgtataattatcgtgtgtcaattaaaaatttttaattaaaaaattataaacaaaaaa

SEQ ID NO: 186781 - DNA, 2332 bp, Homo sapiens
  Payload ID: 16775
  Gene Symbol: STEAP4
  Gene Name: STEAP family member 4
  ENST ID: ENST00000414498
  CDS Start-End: 191-1210
ggcgcggcgaaacttccctctacccgcccggcccgcggcgcgcaccgttggcgctggacgcttcctccttggaagcgcctctccctcaggtctcaagaactgttttgagatgcaggaattcatctaattttcactgccgggcgaggtgtgagagccctagcatctgaaagtggtcgacttgcgagttgttatggagaaaacttgtatagatgcacttcctcttactatgaattcttcagaaaagcaagagactgtatgtatttttggaactggtgattttggaagatcactgggattgaaaatgctccagtgtggttattctgttgtttttggaagtcgaaacccccagaagaccaccctactgcccagtggtgcagaagtcttgagctattcagaagcagccaagaagtctggcatcataatcatagcaatccacagagagcattatgattttctcacagaattaactgaggttctcaatggaaaaatattggtagacatcagcaacaacctcaaaatcaatcaatatccagaatctaatgcagagtaccttgctcatttggtgccaggagcccacgtggtaaaagcatttaacaccatctcagcctgggctctccagtcaggagcactggatgcaagtcggcaggtgtttgtgtgtggaaatgacagcaaagccaagcaaagagtgatggatattgttcgtaatcttggacttactccaatggatcaaggatcactcatggcagccaaagaaattgaaaagtaccccctgcagctatttccaatgtggaggttccccttctatttgtctgctgtgctgtgtgtcttcttgtttttctattgtgttataagagacgtaatctacccttatgtttatgaaaagaaagataatacatttcgtatggctatttccattccaaatcgtatctttccaataacagcacttacactgcttgctttggtttacctccctggtgttattgctgccattctacaactgtaccgaggcacaaaataccgtcgattcccagactggcttgaccactggatgctttgccgaaagcagcttggcttggtagctctgggatttgccttccttcatgtcctctacacacttgtgattcctattcgatattatgtacgatggagattgggaaacttaaccgttacccaggtaaatctcttcttatatattttcttctgctcctgaaatcagagactattgctacatcatattccatttcataattatagaaagtcactcttctaagcatcttcttttttaaagtaactagaattagaaatgtcatgtcagttttttaaaatgaatccagtttagatctcatacaactattaagaataaaagtttgccgggggcggtggctcactcccataatcccagcactttgggattccgaggcaggtgaatcatgtggtcaagagatcaagaccatcctggccaacatggtgaaaccccatctctactaaaaatacaaaaattagctgggcatggtggcgggtacctctaatcccagctacccaggaggctgaggcaggagaatcgcttgaacccaggaggcagaggttgcagtgagccgagatcgtgccactgcactccagcctgggtgacagagcaagactccatctcaaaaagaaaaaaaaaaaaagaaagaaaaaaaatgatactttccaggttcgcttgggtccagatctgtattcccagggctcatagagatattggcaaactgacagatttcatggctcaagaaacctaaagacacctacttgaattcctttggttggcagtcaaatgttaactagtgtgttttcaagcttctattcttaggcatgttacttccttttggaagtcaaaaccaaccatcttttaagtaagagggctaaccaaatatgtgccacactaaagcaaacaaattcacaaaagagcgcttataattcccttaatgtttgacttgggggaagttgacctcaataactagaaaaccaaataattctgagcaaatatcaaatattgtcttatgcataatcaaaagattcagtgagaatcagctgaaggagttttaagacattctcagaggaagtgctataagtcagttctagtttagaaatagctagttttgatagatcttacttcagtctcaaaaattattagttagtcattaatgatgcttctatgggtttctctacattattttcccaacaaatacatgtaagtttcctgggtaagagtcacactacaagtgtctgattcctctcaacttgtggtgcaagactgatgtattatattatgatgtatttattatcatgtataata

SEQ ID NO: 186782 - DNA, 5362 bp, Homo sapiens
  Payload ID: 16776
  Gene Symbol: SCD
  Gene Name: stearoyl-CoA desaturase (delta-9-desaturase)
  Uniprot ID: O00767
  ENST ID: ENST00000370355
  CDS Start-End: 382-1461
gtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttttgggttaaaagatggttgtagcatttaaaatggaaaattttctccttggtttgctagtatcttgggtgtattctctgtaagtgtagctcaaataggtcatcatgaaaggttaaaaaagcgaggtggccatgttatgctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttgggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctgattgcactg

SEQ ID NO: 186783 - DNA, 1995 bp, Homo sapiens
  Payload ID: 16777
  Gene Symbol: SCD5
  Gene Name: stearoyl-CoA desaturase 5
  Uniprot ID: Q86SK9
  ENST ID: ENST00000273908
  CDS Start-End: 236-1006
agccatatgggggatacgccagcaacagacgccggccgccaagatctgcatccctaggccacgctaagaccctggggaagagcgcaggagcccgggagaagggctggaaggaggggactggacgtgcggagaattcccccctaaaaggcagaagcccccgcccccaccctcgagctccgctcgggcagagcgcctgcctgcctgccgctgctgcgggcgcccacctcgcccagccatgccaggcccggccaccgacgcggggaagatccctttctgcgacgccaaggaagaaatccgtgccgggctcgaaagctctgagggcggcggcggcccggagaggccaggcgcgcgcgggcagcggcagaacatcgtctggaggaatgtcgtcctgatgagcttgctccacttgggggccgtgtactccctggtgctcatccccaaagccaagccactcactctgctctgggcctacttctgcttcctcctggccgctctgggtgtgacagctggtgcccatcgcttgtggagccacaggtcctaccgggccaagctgcctctgaggatatttctggctgtcgccaactccatggctttccagaatgacatcttcgagtggtccagggaccaccgagcccaccacaagtactcagagacggatgctgacccccacaatgcccgccggggcttcttcttctcccatattgggtggctgtttgttcgcaagcatcgagatgttattgagaaggggagaaagcttgacgtcactgacctgcttgctgatcctgtggtccggatccagagaaatacacagcacatccagaaagaaggaagagctctcaatcaagaggcagcgtgtgagatgcttcgtgaatggcatcaagggcatatattgaaagtcacccttcccggattacacattttagctttgttacatactcattgtaaccactccgaaaagtgctgcttgatgctgcgtgctctttctgtgtccctggaggtattctgaaggtcagaagagagatatacaacagcgaggcttggtgataacgtatagaataacagacggggactccacacccaggccttttttaacggtgtgaagcatagacagagctgcagtctgtgctaacattaggttatttattgattcaatcagttgacacaaggaggcagctacggggaggtaaaatatggtcctaaaatcaaaaagatttcagttttgtcattctgtctctgagattctatttccacatctagagcagggtaataatgatacctaccttacaaaattattgggagaatacattagttaatatatgtgaaagtatggaggagatgtgcaataaatatttgtgttattaactacacatacagcactctataggagatattccatttataaaaactttaggttctaaaaacctgtacacgttgattatttttgtaagtcaaaagtgattaagaggagtttaagctatcatttccagatgtatttctataaataaaaacataagtatattcagttgatttggggtggagagttccatagatgtctgttaggtccgcttggtccagagctgagttcaagtcctgaatatccttgttaattttctgtcttgttgatctgtctaatattgacagtggggtattaaagtctcccactattattatatgggagtctaagtctccttgtaggtctctaagaacttgctttatgaatctgggtgctcctgtattaggtgcatacatatttaggatagttagctcttcttgctgcattgatcccattaccattatataatgcccttctttgtcttttttgatctttgttggtttaaagtctgttttattagagactaggattgcaacccctgctatttttttttttttttttgcttgataaatattcctgtatccctttattttgagcctatatgtgtctttgcacgtgaggtgggtctcctgaatacagcacaccgatgggttttgactcta

SEQ ID NO: 186784 - DNA, 3101 bp, Homo sapiens
  Payload ID: 16777
  Gene Symbol: SCD5
  Gene Name: stearoyl-CoA desaturase 5
  Uniprot ID: Q86SK9
  ENST ID: ENST00000319540
  CDS Start-End: 321-1313
attttcacagctcctcctccccggccgcgcgcccctcccgccccgcgcgcgcctcctctttctcgcggccgagttcagcccgggcagccatatgggggatacgccagcaacagacgccggccgccaagatctgcatccctaggccacgctaagaccctggggaagagcgcaggagcccgggagaagggctggaaggaggggactggacgtgcggagaattcccccctaaaaggcagaagcccccgcccccaccctcgagctccgctcgggcagagcgcctgcctgcctgccgctgctgcgggcgcccacctcgcccagccatgccaggcccggccaccgacgcggggaagatccctttctgcgacgccaaggaagaaatccgtgccgggctcgaaagctctgagggcggcggcggcccggagaggccaggcgcgcgcgggcagcggcagaacatcgtctggaggaatgtcgtcctgatgagcttgctccacttgggggccgtgtactccctggtgctcatccccaaagccaagccactcactctgctctgggcctacttctgcttcctcctggccgctctgggtgtgacagctggtgcccatcgcttgtggagccacaggtcctaccgggccaagctgcctctgaggatatttctggctgtcgccaactccatggctttccagaatgacatcttcgagtggtccagggaccaccgagcccaccacaagtactcagagacggatgctgacccccacaatgcccgccggggcttcttcttctcccatattgggtggctgtttgttcgcaagcatcgagatgttattgagaaggggagaaagcttgacgtcactgacctgcttgctgatcctgtggtccggatccagagaaagtactataagatctccgtggtgctcatgtgctttgtggtccccacgctggtgccctggtacatctggggagagagtctgtggaattcctacttcttggcctctattctccgctataccatctcactcaacatcagctggctggtcaacagcgccgcccacatgtatggaaaccggccctatgacaagcacatcagccctcggcagaacccactcgtcgctctgggtgccattggtgaaggcttccataattaccatcacacctttccctttgactactctgcgagtgaatttggcttaaattttaacccaaccacctggttcattgatttcatgtgctggctggggctggccactgaccgcaaacgggcaaccaagccgatgatcgaggcccggaaggccaggactggagacagcagtgcttgaacttggaacagccatcccacatgtctgccgttgcaacctcggttcatggctttggttacaatagctctcttgtacattggatcgtgggagggggcagagggtggggaaggaacgagtcaatgtggtttgggaatgtttttgtttatctcaaaataatgttgaaatacaattatcaatgaaaaaactttcgtttttttttttgtttgttttgtttttgagacagagtctcactctgtcacccaggctggagtgcagtggcgcagtctcggctcactgcagcctccacctacctggttcaagcaattctcctgcctcagcctcctgagtagctgagattacaggagcctgccaccacacccagctaatttttttgtatttttagtagagacagggtttcatcatgttggccagactggcctcgaattcctgacctcaggcaatccacccgcctcggcctcccaaagagctgggattacaggcgtgagccaccgcaccctgccgaaaaaaacttttttttttttgagacggaggctcgctctgtcccccaggctggagtgcagtggcgagatctcagctcactgcaagctccgcctcccgggttcacgccattctcctgcctcagcctcccgagtagctgggagccagcgcgcccagcctaaaaaacttttcaagtcaatattactacgatttaacattagagtgtggacatgtgatttaatcgctatagctaaaatacgtcaaatatacgttgtcatgtgcttgaacatgatgctaaccctgacaggatgaaggaaagtaatattctttcagtgtagttcaggagagcatttgttttcttttctaccaattaacccatcattgcttttaaacaaccatctgaaggagcagagaggcagggtagaagacagaagggggatctatgtggtaactaaagaatgtttctgttttgttaattattgtgtgtgtgtggttttattgtttgcttaagagaatcaaaaactgaaaaaaatgagaatacaggaaatggctcttgtttatttttttgctgtgtttacagcttgttaatgctctactgtctttgtttcaagagagatttgttcactgcccagctcgttttgtgtcctgagccctatggccagcccaccttataaatcatgcctgtttagatgtttgattttgttctgtttgctattgttatcttaaaggtgtataactctgacatgccagacatcaaattaagctcaaattaagctctcgtttaaatgtttaagcacctaatttatattctaattgatcccagccactgatgcatgtactttagctacttctgctaaataagcatattaattttccacatcagaccatcagatcttgagaaccaacagttatctagaattccgtgtctactaatgtttcacctgcatgcagccttcattaattttgtagcaaaatataaagtgatcattatgtagcttctggattaaaaaaatttgtgtgtgaagttgctttgtaaagtgcatgtggaattaatgggacagtgtgccctttgtgttagatgttagagcaaaagaaagggcttatagtgttagtattggagcactttgaagatagatattttcagaaaagatgtaggatttaaaagttaaattttaaattttagaaaaagatatgatggcaattggaaatagtcacaatgaagttcttcatccagtaggtgtttaacagtgttattttgccactggtaatgtgtaaactgtgagtgatttacaataaatgattatgaattca

SEQ ID NO: 186785 - DNA, 1635 bp, Homo sapiens
  Payload ID: 16778
  Gene Symbol: SLBP
  Gene Name: stem-loop binding protein
  ENST ID: ENST00000318386
  CDS Start-End: 63-896
ctctgcccgcgccgccgccgcctcagcctcggccctgcgctgcgcgcccggcccgtgctgccatggcctgccgcccgcgaagcccgccgaggcatcagagccgctgcgacggtgacgccagcccgccgtcccccgcgcgatggagcctgggacggaagcgcagagccgacggcaggcgctggaggcccgaagacgccgaggaggcagagcaccgcggcgccgagcgcagacccgagagctttaccactcctgaaggccctaaaccccgttccagatgctctgactgggcaagtgcagttgaagaagatgaaatgaggaccagagttaacaaagaaatggcaagcaatatttattttgccctcagatataaaaggaaactcctcatcaatgactttggaagagagagaaaatcatcatcaggaagttctgattcaaaggagtctatgtctactgtgccggctgactttgagacagatgaaagtgtcctaatgaggagacagaagcagatcaactatgggaagaacacaattgcctacgatcgttatattaaagaagtcccaagacaccttcgacaacctggcattcatcccaagacccctaataaatttaagaagtatagtcgacgttcatgggaccagcaaatcaaactctggaaggtggctctgcatttttgggatcctccagcggaagaaggatgtgatttgcaagaaatacaccctgtagaccttgaatctgcagaaagcagctccgagccccagaccagctctcaggatgactttgatgtgtactctggcacacccaccaaggtgagacacatggacagtcaagtggaggatgagtttgatttggaagcttgtttaactgaacccttgagagacttctcagccatgagctaactgccccctggcggccaggaagagaaacagctcctccccgactaggtggaaggctggccaggcaccaagcatgtgtgtgcacttgtacctggtggtttctctgttagcagtccattagctcatgctgaattatttttgccttactttcttaagaaacattaattttatgtatagtgagtatattttgcatgttttaaattgtaaatggagctaagtccaagaaagtacttgaagctctcttccagcgagcttaattgcgtaatccctgttgtcctccagggtaagctgacacgtctacataactggttttccacaggcatcttcagttattgcttgtcaggtggactgttttggatttaaccatgtaatccatgggaccaattgagagtcagctacttttataggcatcaaagtattctcagacacctttaatatctttatggaaacttaatttttggccttttatcaatatgtcataacagcattctgaagtcagacattgttaaattgagctattaaactaatgagttttatgtaagttatatggtcttaatttggtacttgtaaatagcactagttagactctttagaatactccaagagttagggcagcagagtggagcgatttagaaagaacattttaaaacaatcagttaatttaccatgtaaaattgctgtaaatgataatgtgtacagattttctgttcaaatattcaattgtaaacttcttgttaagact

SEQ ID NO: 186786 - DNA, 1623 bp, Homo sapiens
  Payload ID: 16778
  Gene Symbol: SLBP
  Gene Name: stem-loop binding protein
  Uniprot ID: Q14493
  ENST ID: ENST00000429429
  CDS Start-End: 131-826
gagctcgtgagcgccggcgcggggacgcgggtttctgcctcaggccctgccctgctctactctgcgctctctgcccgcgccgccgccgcctcagcctcggccctgcgctgcgcgcccggcccgtgctgccatggcctgccgcccgcgaagcccgccgaggcatcagagccgctgcgacggtgacgccagctttaccactcctgaaggccctaaaccccgttccagatgctctgactgggcaagtgcagttgaagaagatgaaatgaggaccagagttaacaaagaaatggcaagatataaaaggaaactcctcatcaatgactttggaagagagagaaaatcatcatcaggaagttctgattcaaaggagtctatgtctactgtgccggctgactttgagacagatgaaagtgtcctaatgaggagacagaagcagatcaactatgggaagaacacaattgcctacgatcgttatattaaagaagtcccaagacaccttcgacaacctggcattcatcccaagacccctaataaatttaagaagtatagtcgacgttcatgggaccagcaaatcaaactctggaaggtggctctgcatttttgggatcctccagcggaagaaggatgtgatttgcaagaaatacaccctgtagaccttgaatctgcagaaagcagctccgagccccagaccagctctcaggatgactttgatgtgtactctggcacacccaccaaggtgagacacatggacagtcaagtggaggatgagtttgatttggaagcttgtttaactgaacccttgagagacttctcagccatgagctaactgccccctggcggccaggaagagaaacagctcctccccgactaggtggaaggctggccaggcaccaagcatgtgtgtgcacttgtacctggtggtttctctgttagcagtccattagctcatgctgaattatttttgccttactttcttaagaaacattaattttatgtatagtgagtatattttgcatgttttaaattgtaaatggagctaagtccaagaaagtacttgaagctctcttccagcgagcttaattgcgtaatccctgttgtcctccagggtaagctgacacgtctacataactggttttccacaggcatcttcagttattgcttgtcaggtggactgttttggatttaaccatgtaatccatgggaccaattgagagtcagctacttttataggcatcaaagtattctcagacacctttaatatctttatggaaacttaatttttggccttttatcaatatgtcataacagcattctgaagtcagacattgttaaattgagctattaaactaatgagttttatgtaagttatatggtcttaatttggtacttgtaaatagcactagttagactctttagaatactccaagagttagggcagcagagtggagcgatttagaaagaacattttaaaacaatcagttaatttaccatgtaaaattgctgtaaatgataatgtgtacagattttctgttcaaatattcaattgtaaacttcttgttaagactgttacgtttctattgcttttgtatgggatattgcaaaaataaaaaggaaagaaccctc

SEQ ID NO: 186787 - DNA, 558 bp, Homo sapiens
  Payload ID: 16778
  Gene Symbol: SLBP
  Gene Name: stem-loop binding protein
  ENST ID: ENST00000480936
  CDS Start-End: 1-558
aaaggcggttgggggcggggcgcgcagagctcgtgagcgccggcgcggggacgcgggtttctgcctcaggccctgccctgctctactctgcgctctctgcccgcgccgccgccgcctcagcctcggccctgcgctgcgcgcccggcccgaagacgccgaggaggcagagcaccgcggcgccgagcgcagacccgagagctttaccactcctgaaggccctaaaccccgttccagatgctctgactgggcaagtgcagttgaagaagatgaaatgaggaccagagttaacaaagaaatggcaagatataaaaggaaactcctcatcaatgactttggaagagagagaaaatcatcatcaggaagttctgattcaaaggagtctatgtctactgtgccggctgactttgagacagatgaaagtgtcctaatgaggagacagaagcagatcaactatgggaagaacacaattgcctacgatcgttatattaaagaagtcccaagacaccttcgacaacctggcattcatcccaagacccctaataaatttaagaagtatag

SEQ ID NO: 186788 - DNA, 1977 bp, Homo sapiens
  Payload ID: 16778
  Gene Symbol: SLBP
  Gene Name: stem-loop binding protein
  Uniprot ID: Q14493
  ENST ID: ENST00000489418
  CDS Start-End: 368-1180
aggcctctcctcagcccacggcgtccatctggctcccgagccgagggccgggcagtcgggcttcgcggctgcccgcggtcccgaggcctcgccctagccccagtcggctcgcgaggcgcgcacagctgagtggacccctgcggcgtggcccgatggtctcgcccgacccggcgcgcgcgggaggccgaggggcggggcccggcgcccacataaaggcggttgggggcggggcgcgcagagctcgtgagcgccggcgcggggacgcgggtttctgcctcaggccctgccctgctctactctgcgctctctgcccgcgccgccgccgcctcagcctcggccctgcgctgcgcgcccggcccgtgctgccatggcctgccgcccgcgaagcccgccgaggcatcagagccgctgcgacggtgacgccagcccgccgtcccccgcgcgatggagcctgggacggaagcgcagagccgacggcaggcgctggaggcccgaagacgccgaggaggcagagcaccgcggcgccgagcgcagacccgagagctttaccactcctgaaggccctaaaccccgttccagatgctctgactgggcaagtgcagttgaagaagatgaaatgaggaccagagttaacaaagaaatggcaagatataaaaggaaactcctcatcaatgactttggaagagagagaaaatcatcatcaggaagttctgattcaaaggagtctatgtctactgtgccggctgactttgagacagatgaaagtgtcctaatgaggagacagaagcagatcaactatgggaagaacacaattgcctacgatcgttatattaaagaagtcccaagacaccttcgacaacctggcattcatcccaagacccctaataaatttaagaagtatagtcgacgttcatgggaccagcaaatcaaactctggaaggtggctctgcatttttgggatcctccagcggaagaaggatgtgatttgcaagaaatacaccctgtagaccttgaatctgcagaaagcagctccgagccccagaccagctctcaggatgactttgatgtgtactctggcacacccaccaaggtgagacacatggacagtcaagtggaggatgagtttgatttggaagcttgtttaactgaacccttgagagacttctcagccatgagctaactgccccctggcggccaggaagagaaacagctcctccccgactaggtggaaggctggccaggcaccaagcatgtgtgtgcacttgtacctggtggtttctctgttagcagtccattagctcatgctgaattatttttgccttactttcttaagaaacattaattttatgtatagtgagtatattttgcatgttttaaattgtaaatggagctaagtccaagaaagtacttgaagctctcttccagcgagcttaattgcgtaatccctgttgtcctccagggtaagctgacacgtctacataactggttttccacaggcatcttcagttattgcttgtcaggtggactgttttggatttaaccatgtaatccatgggaccaattgagagtcagctacttttataggcatcaaagtattctcagacacctttaatatctttatggaaacttaatttttggccttttatcaatatgtcataacagcattctgaagtcagacattgttaaattgagctattaaactaatgagttttatgtaagttatatggtcttaatttggtacttgtaaatagcactagttagactctttagaatactccaagagttagggcagcagagtggagcgatttagaaagaacattttaaaacaatcagttaatttaccatgtaaaattgctgtaaatgataatgtgtacagattttctgttcaaatattcaattgtaaacttcttgttaagactgttacgtttctattgcttttgtatgggatattgcaaaaataaaaaggaaagaaccctc

SEQ ID NO: 186789 - DNA, 987 bp, Homo sapiens
  Payload ID: 16778
  Gene Symbol: SLBP
  Gene Name: stem-loop binding protein
  ENST ID: ENST00000488267
  CDS Start-End: 130-837
agctcgtgagcgccggcgcggggacgcgggtttctgcctcaggccctgccctgctctactctgcgctctctgcccgcgccgccgccgcctcagcctcggccctgcgctgcgcgcccggcccgtgctgccatggcctgccgcccgcgaagcccgccgaggcatcagagccgctgcgacggtgacgccagcccgccgtcccccgcgcgatggagcctgggacggaagcgcagagccgacggcaggcgctggaggcccgaagacgccgaggaggcagagcaccgcggcgccgagcgcagacccgagagatataaaaggaaactcctcatcaatgactttggaagagagagaaaatcatcatcaggaagttctgattcaaaggagtctatgtctactgtgccggctgactttgagacagatgaaagtgtcctaatgaggagacagaagcagatcaactatgggaagaacacaattgcctacgatcgttatattaaagaagtcccaagacaccttcgacaacctggcattcatcccaagacccctaataaatttaagaagtatagtcgacgttcatgggaccagcaaatcaaactctggaaggtggctctgcatttttgggatcctccagcggaagaaggatgtgatttgcaagaaatacaccctgtagaccttgaatctgcagaaagcagctccgagccccagaccagctctcaggatgactttgatgtgtactctggcacacccaccaaggtgagacacatggacagtcaagtggaggatgagtttgatttggaagcttgtttaactgaacccttgagagacttctcagccatgagctaactgccccctggcggccaggaagagaaacagctcctccccgactaggtggaaggctggccaggcaccaagcatgtgtgtgcacttgtacctggtggtttctctgttagcagtccattagctcatgctgaattatttttgccttactttctt

SEQ ID NO: 186790 - DNA, 1030 bp, Homo sapiens
  Payload ID: 16778
  Gene Symbol: SLBP
  Gene Name: stem-loop binding protein
  ENST ID: ENST00000483348
  CDS Start-End: 1-677
gcccagccgaccgcgtccctccccgcagcccgccgtcccccgcgcgatggagcctgggacggaagcgcagagccgacggcaggcgctggaggcccgaagacgccgaggaggcagagcaccgcggcgccgagcgcagacccgagagatataaaaggaaactcctcatcaatgactttggaagagagagaaaatcatcatcaggaagttctgattcaaaggagtctatgtctactgtgccggctgactttgagacagatgaaagtgtcctaatgaggagacagaagcagatcaactatgggaagaacacaattgcctacgatcgttatattaaagaagtcccaagacaccttcgacaacctggcattcatcccaagacccctaataaatttaagaagtatagtcgacgttcatgggaccagcaaatcaaactctggaaggtggctctgcatttttgggatcctccagcggaagaaggatgtgatttgcaagaaatacaccctgtagaccttgaatctgcagaaagcagctccgagccccagaccagctctcaggatgactttgatgtgtactctggcacacccaccaaggtgagacacatggacagtcaagtggaggatgagtttgatttggaagcttgtttaactgaacccttgagagacttctcagccatgagctaactgccccctggcggccaggaagagaaacagctcctccccgactaggtggaaggctggccaggcaccaagcatgtgtgtgcacttgtacctggtggtttctctgttagcagtccattagctcatgctgaattatttttgccttactttcttaagaaacattaattttatgtatagtgagtatattttgcatgttttaaattgtaaatggagctaagtccaagaaagtacttgaagctctcttccagcgagcttaattgcgtaatccctgttgtcctccagggtaagctgacacgtctacataactggttttccacaggcatcttcagttattgcttgtcaggtggactgttttg

SEQ ID NO: 186791 - DNA, 1104 bp, Homo sapiens
  Payload ID: 16779
  Gene Symbol: STRC
  Gene Name: stereocilin
  ENST ID: ENST00000455136
  CDS Start-End: 1-359
gcagcctggctgccatccgggattacagcccaggaatgaggcctgaacagaaggaggctctggcaaagcgactgctggcccctgaactgtttggggaagtgcctgcctggccccaggagctgctgtgggcagtgctgcccctgctcccccacctccctctggagaactttttgcagctcagccctcaccagatccaggccctggaggatagctggccagcagcaggtctggggccagggcatgcccgccatgtgctgcgcagcctggtaaaccagagtgtccaggatggtgaggagcaggtacgcaggtggcatatgaacttctgggtgtgttgcgctcatctggaggagcggtgctgagcccccgggagctgcgggtctgggcccctctcttctctcagctgggcctccgcttccttcaggagctgtcagagccccagcttagagccatgcttcctgtcctgcagggaactagtgttacacctgctcaggctgtcctgctgcttggacggctccttcctaggcacgatgcacagtttctctggaagaagatgcaagtacccaccaaccttaccctcaggaatctgcaggctctgggcaccctggcaggaggcatgtcctgtgagtttctgcagcagatcaactccatggtagacttccttgaagtggtgcacatgatctatcagctgcccactagagttcgagggagcctgagggcctgtatctgggcagagctacagcggaggatggcaatgccagaaccagaatggacaactgtagggccagaactgaacgggctggatagcaagctactcctggacttaccgatccagttgatggacagactatccaatgaatccattatgttggtggtggagctggtgcaaagagctccagagcagctgctggcactgacccccctccaccaggcagccctggcagagagggcactacaaaacctggctccaaaggagactccagtctcaggggaagtgctggagaccttaggccctttggttggattcctggggacagagagcacacgacagatccccctacagatcctgctgtcccatctcagtcagctgcaaggcttctgcctagg

SEQ ID NO: 186792 - DNA, 4291 bp, Homo sapiens
  Payload ID: 16779
  Gene Symbol: STRC
  Gene Name: stereocilin
  ENST ID: ENST00000440125
  CDS Start-End: 77-1132
cctgccctcacctggctatcccacacaggtgagaataaccagaactcacctccggtaccagtgttcacttggaaacatggctctcagcctctggcccctgctgctgctgctgctgctgctgctgctgctgtcctttgcagtgactctggcccctactgggcctcattccctggaccctggtctctccttcctgaagtcattgctctccactctggaccaggctccccagggctccctgagccgctcacggttctttacattcctggccaacatttcttcttcctttgagcctgggagaatgggggaaggaccagtaggagagcccccacctctccagccgcctgctctgcggctccatgattttctagtgacactgagaggtagccccgactgggagccaatgctagggctgctaggggatatgctggcactgctgggacaggagcagactccccgagatttcctggtgcaccaggcaggggtgctgggtggacttgtggaggtgctgctgggagccttagttcctgggggcccccctaccccaactcggcccccatgcacccgtgatgggccgtctgactgtgtcctggctgctgactggttgccttctctgctgctgttgttagagggcacacgctggcaagctctggtgcaggtgcagcccagtgtggaccccaccaatgccacaggcctcgatgggagggaggcagctcctcactttttgcagggtctgttgggtttgcttaccccaacaggggagctaggctccaaggaggctctttggggcggtctgctacgcacagtgggggcccccctctatgctgcctttcaggaggggctgctccgtgtcactcactccctgcaggatgaggtcttctccattttggggcagccagagcctgataccaatgggcagtgccagggaggtaaccttcaacagctgctcttatggggcgtccggcacaacctttcctgggatgtccaggcgctgggctttctgtctggatcaccacccccaccccctgccctccttcactgcctgagcacgggcgtgcctctgcccagagcttctcagccgtcagcccacatcagcccacgccaacggcgagccatcactgtggaggccctctagggccggcgcagtgtgctacggacgattggggaatacctggaacaagatgaggagcagccaaccccatcaggctttgaacccactgtcaaccccagctctggtataagcaagatggagctgctggcctgctttagtcctgtgctgtgggatctgctccagagggaaaagagtgtttgggccctgcagattctagtgcaggcgtacctgcatatgcccccagaaaacctccagcagctggtgctttcagcagagagggaggctgcacagggcttcctgacactcatgctgcaggggaagctgcaggggaagctgcaggtaccaccatccgaggagcaggccctgggtcgcctgacagccctgctgctccagcggtacccacgcctcacctcccagctcttcattgacctgtcaccactcatccctttcttggctgtctctgacctgatgcgcttcccaccatccctgttagccaacgacagtgtacagcagggctacagagggtcagaggaaaacagtttggaggaagacaaagggttaagacccatgactcctcgcagcctggctgccatccgggattacagcccaggaatgaggcctgaacagaaggaggctctggcaaagcgactgctggcccctgaactgtttggggaagtgcctgcctggccccaggagctgctgtgggcagtgctgcccctgctcccccacctccctctggagaactttttgcagctcagccctcaccagatccaggccctggaggatagctggccagcagcaggtctggggccagggcatgcccgccatgtgctgcgcagcctggtaaaccagagtgtccaggatggtgaggagcaggtacgcaggcttgggcccctcgcctgtttcctgagccctgaggagctgcagagcctagtgcccctgagtgatccaacggggccagtagaacgggggctgctggaatgtgcagccaatgggaccctcagcccagaaggacgggtggcatatgaacttctgggtgtgttgcgctcatctggaggagcggtgctgagcccccgggagctgcgggtctgggcccctctcttctctcagctgggcctccgcttccttcaggagctgtcagagccccagcttagagccatgcttcctgtcctgcagggaactagtgttacacctgctcaggctgtcctgctgcttggacggctccttcctaggcacgatctgctacaactggattccttggctcttctggcaaatcgaagacgctactgggagctgccctggtctgagcagcaggcacagtttctctggaagaagatgcaagtacccaccaaccttaccctcaggaatctgcaggctctgggcaccctggcaggaggcatgtcctgtgagtttctgcagcagatcaactccatggtagacttccttgaagtggtgcacatgatctatcagctgcccactagagttcgagggagcctgagggcctgtatctgggcagagctacagcggaggatggcaatgccagaaccagaatggacaactgtagggccagaactgaacgggctggatagcaagctactcctggacttaccgatccagttgatggacagactatccaatgaatccattatgttggtggtggagctggtgcaaagagctccagagcagctgctggcactgacccccctccaccaggcagccctggcagagagggcactacaaaacctggctccaaaggagactccagtctcaggggaagtgctggagaccttaggccctttggttggattcctggggacagagagcacacgacagatccccctacagatcctgctgtcccatctcagtcagctgcaaggcttctgcctaggagagacatttgccacagagctgggatggctgctattgcaggagtctgttcttgggaaaccagagttgtggagccaggatgaagtagagcaagctggacgcctagtattcactctgtctactgaggcaatttccttgatccccagggaggccttgggtccagagaccctggagcggcttctagaaaagcagcagagctgggagcagagcagagttggacagctgtgtagggagccacagcttgctgccaagaaagcagccctggtagcaggggtggtgcgaccagctgctgaggatcttccagaacctgtgccaaattgtgcagatgtacgagggacattcccagcagcctggtctgcaacccagattgcagagatggagctctcagactttgaggactgcctgacattatttgcaggagacccaggacttgggcctgaggaactgcgggcagccatgggcaaagcaaaacagttgtggggtcccccccggggatttcgtcctgagcagatcctgcagcttggtaggctcttaataggtctaggagatcgggaactacaggagctgatcctagtggactggggagtgctgagcaccctggggcagatagatggctggagcaccactcagctccgcattgtggtctccagtttcctacggcagagtggtcggcatgtgagccacctggacttcgttcatctgacagcgctgggttatactctctgtggactgcggccagaggagctccagcacatcagcagttgggagttcagccaagcagctctcttcctcggcaccctgcatctccagtgctctgaggaacaactggaggttctggcccacctacttgtactgcctggtgggtttggcccaatcagtaactgggggcctgagatcttcactgaaattggcaccatagcagctgggatcccagacctggctctttcagcactgctgcggggacagatccagggcgttactcctcttgccatttctgtcatccctcctcctaaatttgctgtggtgtttagtcccatccaactatctagtctcaccagtgctcaggctgtggctgtcactcctgagcaaatggcctttctgagtcctgagcagcgacgagcagttgcatgggcccaacatgagggaaaggagagcccagaacagcaaggtcgaagtacagcctggggcctccaggactggtcacgaccttcctggtccctggtattgactatcagcttccttggccacctgctatgagcctgtctctacagtagaaggagattgtggggagagaaa

SEQ ID NO: 186793 - DNA, 5680 bp, Homo sapiens
  Payload ID: 16779
  Gene Symbol: STRC
  Gene Name: stereocilin
  Uniprot ID: Q7RTU9
  ENST ID: ENST00000450892
  CDS Start-End: 79-5406
gccctgccctcacctggctatcccacacaggtgagaataaccagaactcacctccggtaccagtgttcacttggaaacatggctctcagcctctggcccctgctgctgctgctgctgctgctgctgctgctgtcctttgcagtgactctggcccctactgggcctcattccctggaccctggtctctccttcctgaagtcattgctctccactctggaccaggctccccagggctccctgagccgctcacggttctttacattcctggccaacatttcttcttcctttgagcctgggagaatgggggaaggaccagtaggagagcccccacctctccagccgcctgctctgcggctccatgattttctagtgacactgagaggtagccccgactgggagccaatgctagggctgctaggggatatgctggcactgctgggacaggagcagactccccgagatttcctggtgcaccaggcaggggtgctgggtggacttgtggaggtgctgctgggagccttagttcctgggggcccccctaccccaactcggcccccatgcacccgtgatgggccgtctgactgtgtcctggctgctgactggttgccttctctgctgctgttgttagagggcacacgctggcaagctctggtgcaggtgcagcccagtgtggaccccaccaatgccacaggcctcgatgggagggaggcagctcctcactttttgcagggtctgttgggtttgcttaccccaacaggggagctaggctccaaggaggctctttggggcggtctgctacgcacagtgggggcccccctctatgctgcctttcaggaggggctgctccgtgtcactcactccctgcaggatgaggtcttctccattttggggcagccagagcctgataccaatgggcagtgccagggaggtaaccttcaacagctgctcttatggggcgtccggcacaacctttcctgggatgtccaggcgctgggctttctgtctggatcaccacccccaccccctgccctccttcactgcctgagcacgggcgtgcctctgcccagagcttctcagccgtcagcccacatcagcccacgccaacggcgagccatcactgtggaggccctctgtgagaaccacttaggcccagcaccaccctacagcatttccaacttctccatccacttgctctgccagcacaccaagcctgccactccacagccccatcccagcaccactgccatctgccagacagctgtgtggtatgcagtgtcctgggcaccaggtgcccaaggctggctacaggcctgccacgaccagtttcctgatgagtttttggatgcgatctgcagtaacctctccttttcagccctgtctggctccaaccgccgcctggtgaagcggctctgtgctggcctgctcccaccccctaccagctgccctgaaggcctgccccctgttcccctcaccccagacatcttttggggctgcttcttggagaatgagactctgtgggctgagcgactgtgtggggaggcaagtctacaggctgtgccccccagcaaccaggcttgggtccagcatgtgtgccagggccccaccccagatgtcactgcctccccaccatgccacattggaccctgtggggaacgctgcccggatgggggcagcttcctggtgatggtctgtgccaatgacaccatgtatgaggtcctggtgcccttctggccttggctagcaggccaatgcaggataagtcgtgggggcaatgacacttgcttcctagaagggctgctgggcccccttctgccctctctgccaccactgggaccatccccactctgtctgacccctggccccttcctccttggcatgctatcccagttgccacgctgtcagtcctctgtcccagctcttgctcaccccacacgcctacactatctcctccgcctgctgaccttcctcttgggtccaggggctgggggcgctgaggcccaggggatgctgggtcgggccctactgctctccagtctcccagacaactgctccttctgggatgcctttcgcccagagggccggcgcagtgtgctacggacgattggggaatacctggaacaagatgaggagcagccaaccccatcaggctttgaacccactgtcaaccccagctctggtataagcaagatggagctgctggcctgctttagtcctgtgctgtgggatctgctccagagggaaaagagtgtttgggccctgcagattctagtgcaggcgtacctgcatatgcccccagaaaacctccagcagctggtgctttcagcagagagggaggctgcacagggcttcctgacactcatgctgcaggggaagctgcaggggaagctgcaggtaccaccatccgaggagcaggccctgggtcgcctgacagccctgctgctccagcggtacccacgcctcacctcccagctcttcattgacctgtcaccactcatccctttcttggctgtctctgacctgatgcgcttcccaccatccctgttagccaacgacagtgtcctggctgccatccgggattacagcccaggaatgaggcctgaacagaaggaggctctggcaaagcgactgctggcccctgaactgtttggggaagtgcctgcctggccccaggagctgctgtgggcagtgctgcccctgctcccccacctccctctggagaactttttgcagctcagccctcaccagatccaggccctggaggatagctggccagcagcaggtctggggccagggcatgcccgccatgtgctgcgcagcctggtaaaccagagtgtccaggatggtgaggagcaggtacgcaggcttgggcccctcgcctgtttcctgagccctgaggagctgcagagcctagtgcccctgagtgatccaacggggccagtagaacgggggctgctggaatgtgcagccaatgggaccctcagcccagaaggacgggtggcatatgaacttctgggtgtgttgcgctcatctggaggagcggtgctgagcccccgggagctgcgggtctgggcccctctcttctctcagctgggcctccgcttccttcaggagctgtcagagccccagcttagagccatgcttcctgtcctgcagggaactagtgttacacctgctcaggctgtcctgctgcttggacggctccttcctaggcacgatctatccctggaggaactctgctccttgcaccttctgctaccaggcctcagcccccagacactccaggccatccctaggcgagtcctggtcggggcttgttcctgcctggcccctgaactgtcacgcctctcagcctgccagaccgcagcactgctgcagacctttcgggttaaagatggtgttaaaaatatgggtacaacaggtgctggtccagctgtgtgtatccctggtcagcctattcccaccacctggccagactgcctgcttcccctgctcccattaaagctgctacaactggattccttggctcttctggcaaatcgaagacgctactgggagctgccctggtctgagcagcaggcacagtttctctggaagaagatgcaagtacccaccaaccttaccctcaggaatctgcaggctctgggcaccctggcaggaggcatgtcctgtgagtttctgcagcagatcaactccatggtagacttccttgaagtggtgcacatgatctatcagctgcccactagagttcgagggagcctgagggcctgtatctgggcagagctacagcggaggatggcaatgccagaaccagaatggacaactgtagggccagaactgaacgggctggatagcaagctactcctggacttaccgatccagttgatggacagactatccaatgaatccattatgttggtggtggagctggtgcaaagagctccagagcagctgctggcactgacccccctccaccaggcagccctggcagagagggcactacaaaacctggctccaaaggagactccagtctcaggggaagtgctggagaccttaggccctttggttggattcctggggacagagagcacacgacagatccccctacagatcctgctgtcccatctcagtcagctgcaaggcttctgcctaggagagacatttgccacagagctgggatggctgctattgcaggagtctgttcttgggaaaccagagttgtggagccaggatgaagtagagcaagctggacgcctagtattcactctgtctactgaggcaatttccttgatccccagggaggccttgggtccagagaccctggagcggcttctagaaaagcagcagagctgggagcagagcagagttggacagctgtgtagggagccacagcttgctgccaagaaagcagccctggtagcaggggtggtgcgaccagctgctgaggatcttccagaacctgtgccaaattgtgcagatgtacgagggacattcccagcagcctggtctgcaacccagattgcagagatggagctctcagactttgaggactgcctgacattatttgcaggagacccaggacttgggcctgaggaactgcgggcagccatgggcaaagcaaaacagttgtggggtcccccccggggatttcgtcctgagcagatcctgcagcttggtaggctcttaataggtctaggagatcgggaactacaggagctgatcctagtggactggggagtgctgagcaccctggggcagatagatggctggagcaccactcagctccgcattgtggtctccagtttcctacggcagagtggtcggcatgtgagccacctggacttcgttcatctgacagcgctgggttatactctctgtggactgcggccagaggagctccagcacatcagcagttgggagttcagccaagcagctctcttcctcggcaccctgcatctccagtgctctgaggaacaactggaggttctggcccacctacttgtactgcctggtgggtttggcccaatcagtaactgggggcctgagatcttcactgaaattggcaccatagcagctgggatcccagacctggctctttcagcactgctgcggggacagatccagggcgttactcctcttgccatttctgtcatccctcctcctaaatttgctgtggtgtttagtcccatccaactatctagtctcaccagtgctcaggctgtggctgtcactcctgagcaaatggcctttctgagtcctgagcagcgacgagcagttgcatgggcccaacatgagggaaaggagagcccagaacagcaaggtcgaagtacagcctggggcctccaggactggtcacgaccttcctggtccctggtattgactatcagcttccttggccacctgctatgagcctgtctctacagtagaaggagattgtggggagagaaatcttaagtcataatgaataaagtgcaaacagaagtgcatcctgattattttcagaagctgatgaggaatatgggtaaaatgttaatgctttccacccacctgagaatcagtgttcctgggttgccatatctggagtctctttccatcataaataatcccactgcctcttttcatttcctgaaggctgctccctcctcaccccaccattagaagtaacacagacagctgcagcata

SEQ ID NO: 186794 - DNA, 2259 bp, Homo sapiens
  Payload ID: 16779
  Gene Symbol: STRC
  Gene Name: stereocilin
  ENST ID: ENST00000432436
  CDS Start-End: 1-1992
acattcctggccaacatttcttcttcctttgagcctgggagaatgggggaaggaccagtaggagagcccccacctctccagccgcctgctctgcggctccatgattttctagtgacactgagaggtagccccgactgggagccaatgctagggctgctaggggatatgctggcactgctgggacaggagcagactccccgagatttcctggtgcaccaggcaggggtgctgggtggacttgtggaggtgctgctgggagccttagttcctgggggcccccctaccccaactcggcccccatgcacccgtgatgggccgtctgactgtgtcctggctgctgactggttgccttctctgctgctgttgttagagggcacacgctggcaagctctggtgcaggtgcagcccagtgtggaccccaccaatgccacaggcctcgatgggagggaggcagctcctcactttttgcagggtctgttgggtttgcttaccccaacaggggagctaggctccaaggaggctctttggggcggtctgctacgcacagtgggggcccccctctatgctgcctttcaggaggggctgctccgtgtcactcactccctgcaggatgaggtcttctccattttggggcagccagagcctgataccaatgggcagtgccagggaggtaaccttcaacagctgctcttatggggcgtccggcacaacctttcctgggatgtccaggcgctgggctttctgtctggatcaccacccccaccccctgccctccttcactgcctgagcacgggcgtgcctctgcccagagcttctcagccgtcagcccacatcagcccacgccaacggcgagccatcactgtggaggccctctgtgagaaccacttaggcccagcaccaccctacagcatttccaacttctccatccacttgctctgccagcacaccaagcctgccactccacagccccatcccagcaccactgccatctgccagacagctgtgtggtatgcagtgtcctgggcaccaggtgcccaaggctggctacaggcctgccacgaccagtttcctgatgagtttttggatgcgatctgcagtaacctctccttttcagccctgtctggctccaaccgccgcctggtgaagcggctctgtgctggcctgctcccaccccctaccagctgccctgaaggcctgccccctgttcccctcaccccagacatcttttggggctgcttcttggagaatgagactctgtgggctgagcgactgtgtggggaggcaagtctacaggctgtgccccccagcaaccaggcttgggtccagcatgtgtgccagggccccaccccagatgtcactgcctccccaccatgccacattggaccctgtggggaacgctgcccggatgggggcagcttcctggtgatggtctgtgccaatgacaccatgtatgaggtcctggtgcccttctggccttggctagcaggccaatgcaggataagtcgtgggggcaatgacacttgcttcctagaagggctgctgggcccccttctgccctctctgccaccactgggaccatccccactctgtctgacccctggccccttcctccttggcatgctatcccagttgccacgctgtcagtcctctgtcccagctcttgctcaccccacacgcctacactatctcctccgcctgctgaccttcctcttgggtccaggggctgggggcgctgaggcccaggggatgctgggtcgggccctactgctctccagtctcccagacaactgctccttctgggatgcctttcgcccagagggccggcgcagtgtgctacggacgattggggaatacctggaacaagatgaggagcagccaaccccatcaggctttgaacccactgtcaaccccagctctggtataagcaagatggagctgctggcctgctttagtgtgagtgctctgccagagggaaagctcctagaacagtgagaaggccctccaggggaattcctcgaatactcagaggcagtagtgtggggtagtagttgaagcacacagctctagagtcagacaggcttggattcatatcttggttctgtgaccagccttgaatgagttatttaacttctctgagcaatatttttctcgtctcatttataaactagggatgataatggtatatgagataatacatgctgtgggcttagcacagtgcatgatacacaaacatgcaataaatattaccttgttattctt

SEQ ID NO: 186795 - DNA, 5386 bp, Homo sapiens
  Payload ID: 16779
  Gene Symbol: STRC
  Gene Name: stereocilin
  ENST ID: ENST00000428650
  CDS Start-End: 77-2986
cctgccctcacctggctatcccacacaggtgagaataaccagaactcacctccggtaccagtgttcacttggaaacatggctctcagcctctggcccctgctgctgctgctgctgctgctgctgctgctgtcctttgcagtgactctggcccctactgggcctcattccctggaccctggtctctccttcctgaagtcattgctctccactctggaccaggctccccagggctccctgagccgctcacggttctttacattcctggccaacatttcttcttcctttgagcctgggagaatgggggaaggaccagtaggagagcccccacctctccagccgcctgctctgcggctccatgattttctagtgacactgagaggtagccccgactgggagccaatgctagggctgctaggggatatgctggcactgctgggacaggagcagactccccgagatttcctggtgcaccaggcaggggtgctgggtggacttgtggaggtgctgctgggagccttagttcctgggggcccccctaccccaactcggcccccatgcacccgtgatgggccgtctgactgtgtcctggctgctgactggttgccttctctgctgctgttgttagagggcacacgctggcaagctctggtgcaggtgcagcccagtgtggaccccaccaatgccacaggcctcgatgggagggaggcagctcctcactttttgcagggtctgttgggtttgcttaccccaacaggggagctaggctccaaggaggctctttggggcggtctgctacgcacagtgggggcccccctctatgctgcctttcaggaggggctgctccgtgtcactcactccctgcaggatgaggtcttctccattttggggcagccagagcctgataccaatgggcagtgccagggaggtaaccttcaacagctgctcttatggggcgtccggcacaacctttcctgggatgtccaggcgctgggctttctgtctggatcaccacccccaccccctgccctccttcactgcctgagcacgggcgtgcctctgcccagagcttctcagccgtcagcccacatcagcccacgccaacggcgagccatcactgtggaggccctctgtgagaaccacttaggcccagcaccaccctacagcatttccaacttctccatccacttgctctgccagcacaccaagcctgccactccacagccccatcccagcaccactgccatctgccagacagctgtgtggtatgcagtgtcctgggcaccaggtgcccaaggctggctacaggcctgccacgaccagtttcctgatgagtttttggatgcgatctgcagtaacctctccttttcagccctgtctggctccaaccgccgcctggtgaagcggctctgtgctggcctgctcccaccccctaccagctgccctgaaggcctgccccctgttcccctcaccccagacatcttttggggctgcttcttggagaatgagactctgtgggctgagcgactgtgtggggaggcaagtctacaggctgtgccccccagcaaccaggcttgggtccagcatgtgtgccagggccccaccccagatgtcactgcctccccaccatgccacattggaccctgtggggaacgctgcccggatgggggcagcttcctggtgatggtctgtgccaatgacaccatgtatgaggtcctggtgcccttctggccttggctagcaggccaatgcaggataagtcgtgggggcaatgacacttgcttcctagaagggctgctgggcccccttctgccctctctgccaccactgggaccatccccactctgtctgacccctggccccttcctccttggcatgctatcccagttgccacgctgtcagtcctctgtcccagctcttgctcaccccacacgcctacactatctcctccgcctgctgaccttcctcttgggtccaggggctgggggcgctgaggcccaggggatgctgggtcgggccctactgctctccagtctcccagacaactgctccttctgggatgcctttcgcccagagggccggcgcagtgtgctacggacgattggggaatacctggaacaagatgaggagcagccaaccccatcaggctttgaacccactgtcaaccccagctctggtataagcaagatggagctgctggcctgctttagtcctgtgctgtgggatctgctccagagggaaaagagtgtttgggccctgcagattctagtgcaggcgtacctgcatatgcccccagaaaacctccagcagctggtgctttcagcagagagggaggctgcacagggcttcctgacactcatgctgcaggggaagctgcaggggaagctgcaggtaccaccatccgaggagcaggccctgggtcgcctgacagccctgctgctccagcggtacccacgcctcacctcccagctcttcattgacctgtcaccactcatccctttcttggctgtctctgacctgatgcgcttcccaccatccctgttagccaacgacagtgtacagcagggctacagagggtcagaggaaaacagtttggaggaagacaaagggttaagacccatgactcctcgcagcctggctgccatccgggattacagcccaggaatgaggcctgaacagaaggaggctctggcaaagcgactgctggcccctgaactgtttggggaagtgcctgcctggccccaggagctgctgtgggcagtgctgcccctgctcccccacctccctctggagaactttttgcagctcagccctcaccagatccaggccctggaggatagctggccagcagcaggtctggggccagggcatgcccgccatgtgctgcgcagcctggtaaaccagagtgtccaggatggtgaggagcaggtacgcaggtggcatatgaacttctgggtgtgttgcgctcatctggaggagcggtgctgagcccccgggagctgcgggtctgggcccctctcttctctcagctgggcctccgcttccttcaggagctgtcagagccccagcttagagccatgcttcctgtcctgcagggaactagtgttacacctgctcaggctgtcctgctgcttggacggctccttcctaggcacgatctatccctggaggaactctgctccttgcaccttctgctaccaggcctcagcccccagacactccaggccatccctaggcgagtcctggtcggggcttgttcctgcctggcccctgaactgtcacgcctctcagcctgccagaccgcagcactgctgcagacctttcgggttaaagatggtgttaaaaatatgggtacaacaggtgctggtccagctgtgtgtatccctggtcagcctattcccaccacctggccagactgcctgcttcccctgctcccattaaagctgctacaactggattccttggctcttctggcaaatcgaagacgctactgggagctgccctggtctgagcagcaggcacagtttctctggaagaagatgcaagtacccaccaaccttaccctcaggaatctgcaggctctgggcaccctggcaggaggcatgtcctgtgagtttctgcagcagatcaactccatggtagacttccttgaagtggtgcacatgatctatcagctgcccactagagttcgagggagcctgagggcctgtatctgggcagagctacagcggaggatggcaatgccagaaccagaatggacaactgtagggccagaactgaacgggctggatagcaagctactcctggacttaccgatccagttgatggacagactatccaatgaatccattatgttggtggtggagctggtgcaaagagctccagagcagctgctggcactgacccccctccaccaggcagccctggcagagagggcactacaaaacctgattcctgtctacaaggcctggcccctgttttgcctctgggttctgttccttgataatatgcttcacgttacttgtccatacctcttggagtccgagaaatctcttggagtccacctctcagtctttctgcctgctcctatctgggctcattgcttaaggaagtgaacaaaggctccaaaggagactccagtctcaggggaagtgctggagaccttaggccctttggttggattcctggggacagagagcacacgacagatccccctacagatcctgctgtcccatctcagtcagctgcaaggcttctgcctaggagagacatttgccacagagctgggatggctgctattgcaggagtctgttcttgggaaaccagagttgtggagccaggatgaagtagagcaagctggacgcctagtattcactctgtctactgaggcaatttccttgatccccagggaggccttgggtccagagaccctggagcggcttctagaaaagcagcagagctgggagcagagcagagttggacagctgtgtagggagccacagcttgctgccaagaaagcagccctggtagcaggggtggtgcgaccagctgctgaggatcttccagttgtggggtcccccccggggatttcgtcctgagcagatcctgcagcttggtaggctcttaataggtctaggagatcgggaactacaggagctgatcctagtggactggggagtgctgagcaccctggggcagatagatggctggagcaccactcagctccgcattgtggtctccagtttcctacggcagagtggtcggcatgtgagccacctggacttcgttcatctgacagcgctgggttatactctctgtggactgcggccagaggagctccagcacatcagcagttgggagttcagccaagcagctctcttcctcggcaccctgcatctccagtgctctgaggaacaactggaggttctggcccacctacttgtactgcctggtgggtttggcccaatcagtaactgggggcctgagatcttcactgaaattggcaccatagcagctgggatcccagacctggctctttcagcactgctgcggggacagatccagggcgttactcctcttgccatttctgtcatccctcctcctaaatttgctgtggtgtttagtcccatccaactatctagtctcaccagtgctcaggctgtggctgtcactcctgagcaaatggcctttctgagtcctgagcagcgacgagcagttgcatgggcccaacatgagggaaaggagagcccagaacagcaaggtcgaagtacagcctggggcctccaggactggtcacgaccttcctggtccctggtattgactatcagcttccttggccacctgctatgagcctgtctctacagtagaaggagattgtggggagagaaa

SEQ ID NO: 186796 - DNA, 5305 bp, Homo sapiens
  Payload ID: 16779
  Gene Symbol: STRC
  Gene Name: stereocilin
  ENST ID: ENST00000541030
  CDS Start-End: 2188-5196
gccctgccctcacctggctatcccacacaggtgagaataaccagaactcacctccggtaccagtgttcacttggaaacatggctctcagcctctggcccctgctgctgctgctgctgctgctgctgctgctgtcctttgcagtgactctggcccctactgggcctcattccctggaccctggtctctccttcctgaagtcattgctctccactctggaccaggctccccagggctccctgagccgctcacggttctttacattcctggccaacatttcttcttcctttgagcctgggagaatgggggaaggaccagtaggagagcccccacctctccagccgcctgctctgcggctccatgattttctagtgacactgagaggtagccccgactgggagccaatgctagggctgctaggggatatgctggcactgctgggacaggagcagactccccgagatttcctggtgcaccaggcaggggtgctgggtggacttgtggaggtgctgctgggagccttagttcctgggggcccccctaccccaactcggcccccatgcacccgtgatgggccgtctgactgtgtcctggctgctgactggttgccttctctgctgctgttgttagagggcacacgctggcaagctctggtgcaggtgcagcccagtgtggaccccaccaatgccacaggcctcgatgggagggaggcagctcctcactttttgcagggtctgttgggtttgcttaccccaacaggggagctaggctccaaggaggctctttggggcggtctgctacgcacagtgggggcccccctctatgctgcctttcaggaggggctgctccgtgtcactcactccctgcaggatgaggtcttctccattttggggcagccagagcctgataccaatgggcagtgccagggaggtaaccttcaacagctgctcttatggggcgtccggcacaacctttcctgggatgtccaggcgctgggctttctgtctggatcaccacccccaccccctgccctccttcactgcctgagcacgggcgtgcctctgcccagagcttctcagccgtcagcccacatcagcccacgccaacggcgagccatcactgtggaggccctctgtgagaaccacttaggcccagcaccaccctacagcatttccaacttctccatccacttgctctgccagcacaccaagcctgccactccacagccccatcccagcaccactgccatctgccagacagctgtgtggtatgcagtgtcctgggcaccaggtgcccaaggctggctacaggcctgccacgaccagtttcctgatgagtttttggatgcgatctgcagtaacctctccttttcagccctgtctggctccaaccgccgcctggtgaagcggctctgtgctggcctgctcccaccccctaccagctgccctgaaggcctgccccctgttcccctcaccccagacatcttttggggctgcttcttggagaatgagactctgtgggctgagcgactgtgtggggaggcaagtctacaggctgtgccccccagcaaccaggcttgggtccagcatgtgtgccagggccccaccccagatgtcactgcctccccaccatgccacattggaccctgtggggaacgctgcccggatgggggcagcttcctggtgatggtctgtgccaatgacaccatgtatgaggtcctggtgcccttctggccttggctagcaggccaatgcaggataagtcgtgggggcaatgacacttgcttcctagaagggctgctgggcccccttctgccctctctgccaccactgggaccatccccactctgtctgacccctggccccttcctccttggcatgctatcccagttgccacgctgtcagtcctctgtcccagctcttgctcaccccacacgcctacactatctcctccgcctgctgaccttcctcttgggtccaggggctgggggcgctgaggcccaggggatgctgggtcgggccctactgctctccagtctcccagacaactgctccttctgggatgcctttcgcccagagggccggcgcagtgtgctacggacgattggggaatacctggaacaagatgaggagcagccaaccccatcaggctttgaacccactgtcaaccccagctctggtataagcaagatggagctgctggcctgctttagtcctgtgctgtgggatctgctccagagggaaaagagtgtttgggccctgcagattctagtgcaggcgtacctgcatatgcccccagaaaacctccagcagctggtgctttcagcagagagggaggctgcacagggcttcctgacactcatgctgcaggggaagctgcaggggaagctgcaggtaccaccatccgaggagcaggccctgggtcgcctgacagccctgctgctccagcggtacccacgcctcacctcccagctcttcattgacctgtcaccactcatccctttcttggctgtctctgacctgatgcgcttcccaccatccctgttagccaacgacagtgtacagcagggctacagagggtcagaggaaaacagtttggaggaagacaaagggttaagacccatgactcctcgcagcctggctgccatccgggattacagcccaggaatgaggcctgaacagaaggaggctctggcaaagcgactgctggcccctgaactgtttggggaagtgcctgcctggccccaggagctgctgtgggcagtgctgcccctgctcccccacctccctctggagaactttttgcagctcagccctcaccagatccaggccctggaggatagctggccagcagcaggtctggggccagggcatgcccgccatgtgctgcgcagcctggtaaaccagagtgtccaggatggtgaggagcaggtacgcaggcttgggcccctcgcctgtttcctgagccctgaggagctgcagagcctagtgcccctgagtgatccaacggggccagtagaacgggggctgctggaatgtgcagccaatgggaccctcagcccagaaggacgggtggcatatgaacttctgggtgtgttgcgctcatctggaggagcggtgctgagcccccgggagctgcgggtctgggcccctctcttctctcagctgggcctccgcttccttcaggagctgtcagagccccagcttagagccatgcttcctgtcctgcagggaactagtgttacacctgctcaggctgtcctgctgcttggacggctccttcctaggcacgatctgctacaactggattccttggctcttctggcaaatcgaagacgctactgggagctgccctggtctgagcagcaggcacagtttctctggaagaagatgcaagtacccaccaaccttaccctcaggaatctgcaggctctgggcaccctggcaggaggcatgtcctgtgagtttctgcagcagatcaactccatggtagacttccttgaagtggtgcacatgatctatcagctgcccactagagttcgagggagcctgagggcctgtatctgggcagagctacagcggaggatggcaatgccagaaccagaatggacaactgtagggccagaactgaacgggctggatagcaagctactcctggacttaccgatccagttgatggacagactatccaatgaatccattatgttggtggtggagctggtgcaaagagctccagagcagctgctggcactgacccccctccaccaggcagccctggcagagagggcactacaaaacctggctccaaaggagactccagtctcaggggaagtgctggagaccttaggccctttggttggattcctggggacagagagcacacgacagatccccctacagatcctgctgtcccatctcagtcagctgcaaggcttctgcctaggagagacatttgccacagagctgggatggctgctattgcaggagtctgttcttgggaaaccagagttgtggagccaggatgaagtagagcaagctggacgcctagtattcactctgtctactgaggcaatttccttgatccccagggaggccttgggtccagagaccctggagcggcttctagaaaagcagcagagctgggagcagagcagagttggacagctgtgtagggagccacagcttgctgccaagaaagcagccctggtagcaggggtggtgcgaccagctgctgaggatcttccagaacctgtgccaaattgtgcagatgtacgagggacattcccagcagcctggtctgcaacccagattgcagagatggagctctcagactttgaggactgcctgacattatttgcaggagacccaggacttgggcctgaggaactgcgggcagccatgggcaaagcaaaacagttgtggggtcccccccggggatttcgtcctgagcagatcctgcagcttggtaggctcttaataggtctaggagatcgggaactacaggagctgatcctagtggactggggagtgctgagcaccctggggcagatagatggctggagcaccactcagctccgcattgtggtctccagtttcctacggcagagtggtcggcatgtgagccacctggacttcgttcatctgacagcgctgggttatactctctgtggactgcggccagaggagctccagcacatcagcagttgggagttcagccaagcagctctcttcctcggcaccctgcatctccagtgctctgaggaacaactggaggttctggcccacctacttgtactgcctggtgggtttggcccaatcagtaactgggggcctgagatcttcactgaaattggcaccatagcagctgggatcccagacctggctctttcagcactgctgcggggacagatccagggcgttactcctcttgccatttctgtcatccctcctcctaaatttgctgtggtgtttagtcccatccaactatctagtctcaccagtgctcaggctgtggctgtcactcctgagcaaatggcctttctgagtcctgagcagcgacgagcagttgcatgggcccaacatgagggaaaggagagcccagaacagcaaggtcgaagtacagcctggggcctccaggactggtcacgaccttcctggtccctggtattgactatcagcttccttggccacctgctatgagcctgtctctacagtagaaggagattgtggggagagaaatcttaagtcataatgaataaagtgcaaacagaagtgcatcctgattattttcagaagctgatgaggaata

SEQ ID NO: 186797 - DNA, 1113 bp, Homo sapiens
  Payload ID: 16780
  Gene Symbol: SARM1
  Gene Name: sterile alpha and TIR motif containing 1
  ENST ID: ENST00000579593
  CDS Start-End: 1-323
tggccagtctcctgaaggtgcacctgcagctgcatggcttcagtgtcttcattgatgtggagaagctggaagcaggcaagttcgaggacaaactcatccagagtgtcatgggtgcccgcaactttgtgttggtgctatcacctggagcactggacaagtgcatgcaagaccatgactgcaaggattgggtgcataaggagattgtgactgctttaagctgcggcaagaacattgtgcccatcattgatggcttcgagtggcctgagccccaggtcctgcctgaggacatgcaggctgtgcttactttcaacggtatcaagtgagccccagggccctgggaccaggggggtagggtacaaatcaccatgacaggcagagtgtgggcaaacagctgactagcagctccctctgcccagctgtctgaaccacattggctcctgtgcccacaggtggtcccacgaataccaggaggccaccattgagaagatcatccgcttcctgcagggccgctcctcccgggactcatctgcaggctctgacaccagtttggagggtgctgcacccatgggtccaacctaaccagtccccagttccccagccctgctgtgacttccatttccatcgtcctttctgaaggaacagctcctgaaaccagtctccctgggctgagacaacctgggctcttcttaggaaatggctctccctccccctgtcccccaccctcatggcccacctccaacccactttcctcagtatctggagagggaagggaagtcaggcttgggcacgggaggttagaactcccccaggccctgccattgggttgtctgtctccgtcatggggagggtccctgctcagttctggagacactggagttggggtgggggtggttctgcattcccttctcctgctgatagcagtcagcttgaggaggatgacggaaggcagcctcagacaggaattaaggcaatgcccaggcgggcctgggcactgtattctgagcaagggcctgggcccaggagccagccagggatgagtgccatcatggctctccactcagactgtgcctggcccctgcacttacaacttcctgccgctctgtggccttgccc

SEQ ID NO: 186798 - DNA, 897 bp, Homo sapiens
  Payload ID: 16780
  Gene Symbol: SARM1
  Gene Name: sterile alpha and TIR motif containing 1
  ENST ID: ENST00000578128
  CDS Start-End: 1-772
caacctggcggactggctgggcagcctggacccgcgcttccgccagtacacctacggcctggtcagctgcggcctggaccgctccctgctgcaccgcgtgtctgagcagcagctgctggaagactgcggcatccacctgggcgtgcaccgcgcccgcatcctcacggcggccagagtgagtgatgcggaggggccaccttcaccatgctgcctattgcccacttcagaaatgctacactccccgctgccctgtactggtggcaaacccagtggggacactccagatgtcttcatcagctaccgccggaactcaggttcccagctggccagtctcctgaaggtgcacctgcagctgcatggcttcagtgtcttcattgatgtggagaagctggaagcaggcaagttcgaggacaaactcatccagagtgtcatgggtgcccgcaactttgtgttggtgctatcacctggagcactggacaagtgcatgcaagaccatgactgcaaggattgggtgcataaggagattgtgactgctttaagctgcggcaagaacattgtgcccatcattgatggcttcgagtggcctgagccccaggtcctgcctgaggacatgcaggctgtgcttactttcaacggtatcaagtggtcccacgaataccaggaggccaccattgagaagatcatccgcttcctgcagggccgctcctcccgggactcatctgcaggctctgacaccagtttggagggtgctgcacccatgggtccaacctaaccagtccccagttccccagccctgctgtgacttccatttccatcgtcctttctgaaggaacagctcctgaaaccagtctccctgggctgagacaacctgggctcttcttaggaaatggctctccc

SEQ ID NO: 186799 - DNA, 563 bp, Homo sapiens
  Payload ID: 16780
  Gene Symbol: SARM1
  Gene Name: sterile alpha and TIR motif containing 1
  ENST ID: ENST00000582323
  CDS Start-End: 1-355
actcctcccccaggagcagcaggtggatggcgacctgcttctgcggctcacggaggaggaactccagaccgacctgggcatgaaatcgggcatcacccgcaagaggttctttagggagctcacggagctcaagaccttcgccaactattctacgtgcgaccgcagcaacctggcggactggctgggcagcctggacccgcgcttccgccagtacacctacggcctggtcagctgcggcctggaccgctccctgctgcaccgcgtgtctgagcagcagctgctggaagactgcggcatccacctgggcgtgcaccgcgcccgcatcctcacggcggccagagcaattacagactaagcacccacaagacacaagggactgagctttggctgcattcttatgcttcaaccaaagcagaaatgctacactccccgctgccctgtactggtggcaaacccagtggggacactccagatgtcttcatcagctaccgccggaactcaggttcccagctggccagtctcctgaaggtgcacctgcagctgcatggcttcagtgtcttcat

SEQ ID NO: 186800 - DNA, 10309 bp, Homo sapiens
  Payload ID: 16780
  Gene Symbol: SARM1
  Gene Name: sterile alpha and TIR motif containing 1
  Uniprot ID: Q6SZW1
  ENST ID: ENST00000585482
  CDS Start-End: 372-2546
gctgctcctccggggcgtggctgctgccgagcatctcccagctcagccgagcccgtgcccaggccacgctttgttccagccgccgcctcctctaccctacggcgtccggagccatccctcgcctgctcgctctctcctttcgcccactccctgcatctgggcctgcatcacctttgccaaccgctcccccgatcctgccgacactcctcccccaaacttctgaccggcacccttgcctggtacccttctctccattcctccccctccatcttctttccccgacccctctcgggtccctcttttcccaaaacccgggtctctccgcgtggccccgcctccaggccggggatgtcccccgcggccccgcgcccatggtcctgacgctgcttctctccgcctacaagctgtgtcgcttcttcgccatgtcgggcccacggccgggcgccgagcggctggcggtgcctgggccagatgggggcggtggcacgggcccatggtgggctgcgggtggccgcgggccccgcgaagtgtcgccgggggcaggcaccgaggtgcaggacgccctggagcgcgcgctgccggagctgcagcaggccttgtccgcgctgaagcaggcgggcggcgcgcgggccgtgggcgccggcctggccgaggtcttccaactggtggaggaggcctggctgctgccggccgtgggccgcgaggtagcccagggtctgtgcgacgccatccgcctcgatggcggcctcgacctgctgttgcggctgctgcaggcgccggagttggagacgcgtgtgcaggccgcgcgcctgctggagcagatcctggtggctgagaaccgagaccgcgtggcgcgcattgggctgggcgtgatcctgaacctggcgaaggaacgcgaacccgtagagctggcgcggagcgtggcaggcatcttggagcacatgttcaagcattcggaggagacatgccagaggctggtggcggccggcggcctggacgcggtgctgtattggtgccgccgcacggaccccgcgctgctgcgccactgcgcgctggcgctgggcaactgcgcgctgcacgggggccaggcggtgcagcgacgcatggtagagaagcgcgcagccgagtggctcttcccgctcgccttctccaaggaggacgagctgcttcggctgcacgcctgcctcgcagtagcggtgttggcgactaacaaggaggtggagcgcgaggtggagcgctcgggcacgctggcgctcgtggagccgcttgtggcctcgctggaccctggccgcttcgcccgctgtctggtggacgccagcgacacaagccagggccgcgggcccgacgacctgcagcgcctcgtgccgttgctcgactctaaccgcttggaggcgcagtgcatcggggctttctacctctgcgccgaggctgccatcaagagcctgcaaggcaagaccaaggtgttcagcgacatcggcgccatccagagcctgaaacgcctggtttcctactctaccaatggcactaagtcggcgctggccaagcgcgcgctgcgcctgctgggcgaggaggtgccacggcccatcctgccctccgtgcccagctggaaggaggccgaggttcagacgtggctgcagcagatcggtttctccaagtactgcgagagcttccgggagcagcaggtggatggcgacctgcttctgcggctcacggaggaggaactccagaccgacctgggcatgaaatcgggcatcacccgcaagaggttctttagggagctcacggagctcaagaccttcgccaactattctacgtgcgaccgcagcaacctggcggactggctgggcagcctggacccgcgcttccgccagtacacctacggcctggtcagctgcggcctggaccgctccctgctgcaccgcgtgtctgagcagcagctgctggaagactgcggcatccacctgggcgtgcaccgcgcccgcatcctcacggcggccagagaaatgctacactccccgctgccctgtactggtggcaaacccagtggggacactccagatgtcttcatcagctaccgccggaactcaggttcccagctggccagtctcctgaaggtgcacctgcagctgcatggcttcagtgtcttcattgatgtggagaagctggaagcaggcaagttcgaggacaaactcatccagagtgtcatgggtgcccgcaactttgtgttggtgctatcacctggagcactggacaagtgcatgcaagaccatgactgcaaggattgggtgcataaggagattgtgactgctttaagctgcggcaagaacattgtgcccatcattgatggcttcgagtggcctgagccccaggtcctgcctgaggacatgcaggctgtgcttactttcaacggtatcaagtggtcccacgaataccaggaggccaccattgagaagatcatccgcttcctgcagggccgctcctcccgggactcatctgcaggctctgacaccagtttggagggtgctgcacccatgggtccaacctaaccagtccccagttccccagccctgctgtgacttccatttccatcgtcctttctgaaggaacagctcctgaaaccagtctccctgggctgagacaacctgggctcttcttaggaaatggctctccctccccctgtcccccaccctcatggcccacctccaacccactttcctcagtatctggagagggaagggaagtcaggcttgggcacgggaggttagaactcccccaggccctgccattgggttgtctgtctccgtcatggggagggtccctgctcagttctggagacactggagttggggtgggggtggttctgcattcccttctcctgctgatagcagtcagcttgaggaggatgacggaaggcagcctcagacaggaattaaggcaatgcccaggcgggcctgggcactgtattctgagcaagggcctgggcccaggagccagccagggatgagtgccatcatggctctccactcagactgtgcctggcccctgcacttacaacttcctgccgctctgtggccttgccctgtaatcactcagtgcccttagctagcctgactaagtcccagatcccctacagcttccttcggtgtggtatcttttgccacatccagggcgagggttgaggcaaaccagccctccctctgacttccttgtcactgcagccagctttgctgcacttgctggtgcacaggagcctcctgtttgggcctgggtctgggcatggggaggccgtgcctcaaagcccaccctaccccatgccttggtgctgtgcctcaggctccttcctggtctggcccagctggcttccccagcccctcagccatccagggctacccactgcttactcagggaccaggcagcccccatggcagtaaaagcagcctagacagaacctgcagctctgtggaaagaggcaaagtcctgaaaaggcaaagggttgtcacttagggcagcttctccaactttaacatgcatccaagtcacctgggaatgttgttaaaatcaggagatctggggtggggcctaggactctgcatttcttacagattcccaggtgagctgatgctggtggttaagggtagcaaatctctaaagcacgaagccctcacaaatctttgccatttcccaaacactccgctccatggtctccagtcatcagagcaactctacctggtattatcatccccattttacagataatgacactgaggctcagaaaggttgaggataagcccactttcctgtcattagtggcagccccagatccagacctaggcctcctggcacccagtccactggcagtggaattgctttcctgagaatcattctgaggctgggctattgcttctcccttgcttcaaagaatctagcagcgggggataggattttgcaacaaaaagctgacccagaggccatacagagcaggaatatcccattgccccctcctccactgggttcagagggtaagaaagcaccctccaataaacccaggctccaggccgtgggggctgctgaaggctctttccccgcaagggccaggtgttgacaccttaaagctggctgcgcccccagccccactcttggctgtgctggccaggtgactcctagttcttggccacatcatcagaaagtcaaaggtctcactccaggtttggggctccttccttccactcccctccctgccagagtctgtcttggccagtgccagcctcgatgctttggttttgaccccacctgatcctcctttcctcatgcagcacaagtgctcaccggggccagagccagggcatggatatgacaagcagggcagcctggacactgccctcacaggacagcgccaataacaatacagtgtctgagtatctccaggggatgatttctggctctttgtctccaatcagtcccactccctcctgaggtccccaagggcagtattcagagaggtttcctgcgttttatttctatttggtataccctccactgttgtccactgccctgtgtggccttctggttgacctctgcccgatcttctgtctctctgagggaatcagagtccagcatccagccccagctggaacagctgaagtcacaagcctcctctaagccaaggccagtgtgttcagaggtgactgccacccatactaggacaaacacagctcagatcaccaggtcaagcacctaggcctggcttctcctgagacagaggactcagaagtggcctttcctccaaagcctgctcagacacaggtctgtagggccagggtgttctgcttggctgggctgcagctgctacccctcggttggggctgagtcagccagatcctccccctacttctccccaagggccaagaactgctcagggacattaaaggtcaaaagtccagccacactcattcatcctttccccaggcccatgaagagaggcatctcattgtagaatgtatgaggaagtgggaagtatctcagagaatcagctaagtttcctaacttgtccatccaaatgtgatcaccacgattcaacaatttggggcattgctgatctagccgttcctagtggggcttgctcaaggttgcacagcgagtcagtagaagccctggctggccccacttggtaccaatccaccaggcagctcagggctcctgcccagcccagcagcttctgttgtctaacgtatggcaggcagactgggagcaggaaaacagagggccccaaagcccaaggcaccagaaggtttgtttcagtttgctgaagctgatttgtaatgattggcactcttcagccaggggagtgggtaggccatagccaaggatcgattccccaaccacagcaaaggcaacactcttcctccagagatcaccaagcccctcttacctccctccctccttcccaaggctggcactaaccaggtaccacattcattgttaaggaatggctgatgactgctacacgtgttgggaacctggttggggctgtgcagtttgggctggaaggagagatgccagccctcgtgctgcctctggtccctgaagtgtcacctctctcaggacctctcctctggcctgtggggttataagtgatggatagcagaaagggagaactgactcctgtcccaaatagctcctctgccacctgtcctgcagtgggcctgtgtgggttatgattctagatcctagacagaggctgggtcagctgtggatggggtggtgccttggtctctcttgactacctcgtccaaagagagcactgcccttagacaagagttgcttgtcctgctgtgggctgggcttccagctgcagacctccagttgcttggtgttcactttgctcctcttgccctctgtcttctggtccaggcagatcaggggctctggggaaactgctggaactcgaggtgaggatcagccttttccagcatcctgtgagagaccagagagagagtttggatttcatgtggggaaccctcaaggcctgtctggagaagtgacacaggatttactggggtgggctggtccaggtagctctcctgaacctcctccttccccaagctgagaagctgagagctggaggacaatatccagggacatggctctggaaaataacttttttttttttaagagacagggtcttgctctgttgtccaggctggagggcagtgacataatcatagctcactgtacccttgaactcctgggctcaagtgatcctcctgcctcagcctccttagtagctgggactaccagtgcataccaccatgcctgggtgattttttaaattttttatacagacaaggtcttgctatgttgcccaggctgatcttgaattcccgggctcaagtggtcctcctgcctcagcctcccacaggatcgggattacaggcaagagcctccacgcccggccatgaaatataattcttaatatcatacaggaaaaagtcagcgggtcaagctagcctgtggcccagccacaactagctgacaaagcttcctggccttccctttaacacagttctgctgccatagttccatctataaaatgggaatggagggaaataggggaactgggagagagaacacagccttgccaagcagcaatgttagcctgatccttcctccacctagctcgccatctcgcccttggaaaatggctcctggaggattaggcagccatctgcaaggagaggggcaacctgggacaagacacccagagggtaaggattccaggaatgaagctgccatttctggttgggaggagaagaggaaacttttaagagaaagggctccattatgagcatgggttcagggccctgcattacccaatcagaacagccgggatgagcaggaggccagctcccaggaggaaggggaaccccttcataaagttcagagtggctgggtagagtgagttgaagatgccggaggccgtcagcatggccaggctattcacacaggccacagcagaaaagagagcacctgtgaagaaataaataccatactctggagtccgaaagggccatattccaactctggcaccaccacctcacagctgtgtgaccgggagtagtcacttaacctatgtctccccttcctcaccagtaaatcctgctacatcatgtactgtgacaaggattcagtaaggtcatatgtggacagtagctggcacagaggggctactaaacaaatggctgctattaaatccacattaaaagtacatgtgatctgacagaacccagcacataaaagaaaaaaaaagtacatgtgatattgtctgatgaaagcttgatggaaatggcttttttctggtttatcctctttggaatcatctcctgtttgggattaactgctggtctgatcagttccaatattcatagcggtgtcaccactgaatagcttcttatcctttgggttcctgttcctccttctgctaaataaggataatacctatttcctagattgtgagcaacattaagttcacatggaaatcacccatcactgggcctggtcccctggaagtagctagttagtaagggctgttcttttctcctgtttctcttgacatctctgggcacagagaaagtgctgggaaaaaaagtttaggtgaatgaatgaagacacatggattctggggacaccagaacccacagtgggctctgtatggcaccagagtctctgtcatcatcagatcctcattccaggacagatggaaaaagatgaatgtttccagactggggcataaagacccagaggctggagaagctgttctttatagatataccaggagaacccacagtttacaaaatgtgcaacaacccaacagaagttgagattaaattctgtcacatctagaggggtctgtgatgtcatcaaaagcaaaccacccacatcacagatgaagaaacaggcctgtggcagggctcggactaaaacccagatcctgagaccagctgcttttaaacacagacgtaggtttgcatcctagctccaccatttactgagtaaccttgggtgagccaatgtaaccccctgggtctctgtttctttatctgtcaactgtggaaaatgaaacccatgtcacaaggttgttcacttctgggcttgtacacgctgaccccagagaaacagggaactctggcatcaccacacccatcttacagacggaaaagctgaggtctgcagagagtaaatcctctgctctggttatctagaaagaacataattgtgctctgctgactgcaaatcccaactctgcggtttgaaaatccaaggtggcatgatcctctgcccattgtgggcaatttcacagaaatgtgtttgttttggccacttacttctccagggtgagaggggggaaggcaagctgttcccccagccatggctgcccatcagcccgtttcgggcagcactggacatgaggaaccagacacaggtgggttctgacactcaccctgctctgtctctctcaccagcttggagagtttagcccggatgacaggtgtgatgactaatgacaggaaaagcaacccatatcctgtggagaaacaaacactcatcaggaaaatggggctggggagaggggcgtccaagggaaaggcagcagagctcctatccataccccacgtggggcttaggttagacccaggaagaacttccttgatggtgagggtgggaagacagtagtcaaggaggaatggagactgcccttgtctgggcttggccacctgctagctctcatgaatgaatgctaattcccattgattgctttcttgtctgaacctcttgtggtcacagcaggcatcacccacccacttggcacttagtagggatatggcagggcacagaaaacaagcatgggctttggagtcagccctgagttcaaaacctgatgccattacatattatctgtgtggcctggggtacttaccctctctgatcctgactccctgtatgaggaagataataaggccttcatcacaggatggttctgaggcataggaggctgaataatggtgcccaatggcatcagattcatagccctggaacctgtaaatactaccttatttggaaaatgagtctatgcaggtgtgcagttaagcctcctgagagagcagagttatcctggattaggttgggccctaaatgccgtcacacatatctttataagaggaaagcagacggagatttggcaccgacagaattgagaaggcacaaagaggaggagagtcaatgtgagcacagaggcagagactggtgatggccgccccaagccaaggaatgccagcagccccagaagctggaagaaatgagaaacacgttctctcctggaggcttgcaagggagcactgcctgctgactgcttccattcagcccggtggtactgactttggacttctggcctccagaactgtgagagaatatgtttctgttgtgttaagcccccaagtttgtggtatgtcattacagcaatctcagggaaccaatacatgaggtaaaaaggtaacatctatgaagagcatggcatagggacacagcaaatgggagttccttttccctttgcattcagttacttacaggcttcctgttttcttcataaccatttctctccctgtgcgactgctgactcctcagcaaaactgcaaactcctacaggacagtggatcctccaaagaaggtatacgatgaggcatccagggaccctagcagtgtcaggcccctcaaatcccactctgttgagacctccccccgacccagagcaatgacagcatctttatcatctctgcatcccccagggccatcagcaggagggaaaggttcccttctgcttaattgtcagacaagcagttgagttaagaaatctgtgattattgtattgttgactatacacagcacattttagggctctatcaaaataaatctgtccctttaaaaaaagttaactaaagccgggcacggtggctcatgcctgtaatcccaacactttgggaggctgaggcaggcggatccttgagctcaggagttagagacctggactgggcaaaatggtgaggaccccatctctataaaaaatacaaaaattagcaaggtgtggtaatgtgcaccagtggtcccagctactagagaggccaaggtgggaggatcatctgggcccgggggatgaggctgcagtgagccatgatcgtgccactgcactctagcctgggtaacaaagcgagaccctgtctctaaatacatcaatcaaataaaaattttaaaaagttaa

SEQ ID NO: 186801 - DNA, 750 bp, Homo sapiens
  Payload ID: 16781
  Gene Symbol: SAMD1
  Gene Name: sterile alpha motif domain containing 1
  ENST ID: ENST00000269724
  CDS Start-End: 364-750
cccgcccccgccccgggccaactccgcggcgcctccttaaaaagcgcgcgggagttgtaagggggggccggagcgagccggagtgagcgagagcgcaggagaggtggagaagagcgagtacttgagaaagaagaggaagaagatgatgatgaagatgaagatgaagaagatgatgtgtcagagggctctgaagtgcccgagagtgaccgtcctgcaggtgcccagcaccaccagcttaacggcgagcggggacctcagagtgccaaggagagggtcaaggagtggaccccctgcggaccgcaccagggccaggatgaagggcgggggccagccccgggcagcggcacccgccaggtgttctccatggcagccatgaacaaggaagggggaacagcttctgttgccaccgggccagactccccgtcccccgtgcctttgcccccaggcaaaccagccctacctggggccgacgggaccccctttggctgtcctcccgggcgcaaagagaagccatctgatcccgtcgagtggaccgtgatggatgtcgtcgaatattttactgaggctggattcccggagcaggcgacagctttccaagagcaggaaattgatggcaaatctttgctgctcatgcagcgcacagatgtgctcaccggcctgtccatccgcctcgggccagccctgaaaatctacgagcaccacatcaaggtgcttcagcaaggccactttgaggatgatgaccccgatggc

SEQ ID NO: 186802 - DNA, 2164 bp, Homo sapiens
  Payload ID: 16781
  Gene Symbol: SAMD1
  Gene Name: sterile alpha motif domain containing 1
  ENST ID: ENST00000533683
  CDS Start-End: 289-1587
ggtctgtgtgtgcgtgcgtgcgagtgagtgagtgtgtgcatatttttttctctcttttctttctctctcactgttttttcctctctctctctctccctctctctctcttttttttttttttttttttgcaaagaaacagcagcgccgccgccgctccgccgaggcgctgcgccccccggggggggaggcggaggaggcgggcagcggcggagggaggggagccggggaggggggcgccgcgctgggagggaggcagcgcgcacggtgcagccgggccgggcgggaggcatggcggggcccccggccctacccccgccggagacggcggcggccgccaccacggcggccgccgcctcgtcgtccgccgcttccccgcactaccaagagtggatcctggacaccatcgactcgctgcgctcgcgcaaggcgcggccggacctggagcgcatctgccggatggtgcggcggcggcacggcccggagccggagcgcacgcgcgccgagctcgagaaactgatccagcagcgcgccgtgctccgggtcagctacaaggggagcatctcgtaccgcaacgcggcgcgcgtccagccgccccggcgcggagccaccccgccggccccgccggcgccgccacagcagcagcagccgccgccgccgcagccacagccgccgccggaggggggcgcggtgcgggccggcggcgcggcgcggcccgtgagcctgcgggaagtcgtgcgctacctcgggggcagcggcggcgccggcggtcgcctaacccgcggccgcgtgcaggggctgctggaggaggaggcggcggctcgaggccgtctggagcgcacccgtctcggagcgcttgcgctgccccgcggggacaggcccggacgggcgccgccggccgccagcgcccgcccgtctcgcagcaagagaggtggagaagagcgagtacttgagaaagaagaggaagaagatgatgatgaagatgaagatgaagaagatgatgtgtcagagggctctgaagtgcccgagagtgaccgtcctgcaggtgcccagcaccaccagcttaacggcgagcggggacctcagagtgccaaggagagggtcaaggagtggaccccctgcggaccgcaccagggccaggatgaagggcgggggccagccccgggcagcggcacccgccaggtgttctccatggcagccatgaacaaggaagggggaacagcttctgttgccaccgggccagactccccgtcccccgtgcctttgcccccaggcaaaccagccctacctggggccgacgggaccccctttggctgtcctcccgggcgcaaagagaagccatctgatcccgtcgagtggaccgtgatggatgtcgtcgaatattttactgaggctggattcccggagcaggcgacagctttccaagagcaggaaattgatggcaaatctttgctgctcatgcagcgcacagatgtgctcaccggcctgtccatccgcctcgggccagccctgaaaatctacgagcaccacatcaaggtgcttcagcaaggccactttgaggatgatgaccccgatggcttcttaggctgagcgcccagcctcacccctgccccagcccattccggcccccatctcacccaagatcccccagagtccaggagctggacggggacaccctcagccctcataacagattccaaggagagggcaccctcttgtccttatctttgccccttgtgtctgtctcacacacatctgctcctcagcacgtcggtgtggggaggggattgctccttaaaccccaggtggctgaccctccccacccagtccaggacattttaggaaaaaaaaaatgaaatgtggggggcttctcatctccccaagatcctcttccgttcagccagatgtttcctgtataaatgtttggatctgcctgtttattttggtgggtggtctttcctccctcccctaccacccatgccccccttctcagtctgcccctggcctccagcccctaggggactagctgggttggggttcctcgggccttttctctcctccctcttttctttctgttgattgtcgctccagctggctgtattgctttttaatattgcaccgaaggttttttaaataaaattttaaaaaaagaaaaagggaaaaaaaa

SEQ ID NO: 186803 - DNA, 2181 bp, Homo sapiens
  Payload ID: 16782
  Gene Symbol: SAMD10
  Gene Name: sterile alpha motif domain containing 10
  Uniprot ID: Q9BYL1
  ENST ID: ENST00000369886
  CDS Start-End: 176-784
acacagggctcggcggcaggtgcctcgtcgcgcacactcgcgggccgcggggaccggctcgggcgcggggccggctggggcggggcggggcggcggcgcgcgttccccgccggccacaccggccgccctgcactcggcgaggggcgtgtgcgcgggcctggcacccgcgggccccatgttcaccgagctgaggtccaagctgagccccccgcgtggccgcgccggggccgtgcgcgcgggcttcggggagcgccgggatgtggacgccactgcccacttcagcttctgccggaccctcctggagcacacggtgtcagctgagagcatcccctgccacttgcctcggacacctggcaccagcctcacgtggcatgactcccgcagccagagggcggccagcagcaggccaatcaagctcctgcagcagcccggcacagacaccccccagggccggctgtactctgaccactatggcctgtaccatacaagcccctcgctgggtggcctgacccggcccgtggtcctgtggagtcagcaggacgtctgcaagtggctcaagaagcactgtccccacaactacctcgtctacgtggaggccttctcccagcatgccatcaccggccgggcactgctgcggctgaatgcggagaagctgcagcggatggggctggcccaggaggcccagaggcaggaggtgctgcagcaggtgctccgcctgcaggtgcgtgaggaggggcggagcctgcagctgctcagccaagcttccttcgggaaaatgtcctagctgctgctgaggcttgaacccagaccccagcactgtgatgggagtccacggctagggaggaggccaagctggccccgcagcgcctcttggaccctgcgggatgccggggcggccaggctggcccaacggacagacaggaccaggatcacacctccaggcgcctctggttggacattccaggtcgtgccctggggctgggtgggtagggggctgcttgagtgtggccccacctcctgggacctgagcccaagccctcccctggtgcagctggcagcatgtggggcagctgcctggagccagaaccggtttggatgtcccccctagactcccagggagtctgtttatttacattcccctctccacgtgatgtcggtcccccatcgcctgctgagtcacttgtctgtccacccacccagcccagttctaggtcgttccccagcacctccaggttggcccacacaggtaccataagctgcctcggctccctgtggcttgtgcccatgcacctgccagggcccagcaggccaacccatcatctagagtagtggccatcagcacccgcctaacgggcaccatgccaagcactttcatcattatttatacatcgtcaccacaccccctctattcatgagaagtaaagctgagaaaggaccagattgaccaagcgccagagacaaaatgtggcacaacgagaaccccagccctgtccaggtggctccgcgcccagggcccaggcttagcagtgctccctgccctatctttgggaaaatcttgcttttatggtcttcccccctcgccctcaagaacaagggccttgtgcgtgggccttcccattgctgctttcccaagaaggcctggattcaggggagaggccttcccagggccactccccttacaccctcccagaggcctgagcaacccctctctgggtggtttggggctggtgctgcctggcggaaggacagtgagggcggccctagccgcctccaccctcttgcgcctctgccctctcccagtccccctgtggcttctgaaaatctcagggacagatgaggctgagcccctagtcccctctgtgtgctttgagcctccagactcgaggctggtcactgcaggtcccaggtggaatttggacaactggcctggccgctcccatcctgtaagcccccaccacggggagaccctcatccctgcccctgtgtggctgcgcaagtattctgcccgcctcccaccatcagccttcgcccaaggggcccttctgcctctgcttccctcccttctcctctgtcttgccctggcccacgcacgcctgtctcgtcttccttgttttgctgcactcacttttttatactctgacaaaaaaaaaaaatcagaaataaagctggttcccaagtgct

SEQ ID NO: 186804 - DNA, 493 bp, Homo sapiens
  Payload ID: 16782
  Gene Symbol: SAMD10
  Gene Name: sterile alpha motif domain containing 10
  ENST ID: ENST00000450107
  CDS Start-End: 176-493
acacagggctcggcggcaggtgcctcgtcgcgcacactcgcgggccgcggggaccggctcgggcgcggggccggctggggcggggcggggcggcggcgcgcgttccccgccggccacaccggccgccctgcactcggcgaggggcgtgtgcgcgggcctggcacccgcgggccccatgttcaccgagctgaggtccaagctgagccccccgcgtggccgcgccggggccgtgcgcgcgggcttcggggagcgccgggatgtggacggctctgttcacttgcagataccatacagagccttcattcattcattcattgacaatgaatgtggggtgcccctctgtaaccagacctggatcaagacgcctgcctccccagactcagccactgcccacttcagcttctgccggaccctcctggagcacacggtgtcagctgagagcatcccctgccacttgcctcggacacctggcaccagcctcacgtggcatgac

SEQ ID NO: 186805 - DNA, 2551 bp, Homo sapiens
  Payload ID: 16783
  Gene Symbol: SAMD11
  Gene Name: sterile alpha motif domain containing 11
  Uniprot ID: Q96NU1
  ENST ID: ENST00000342066
  CDS Start-End: 84-2129
ccagcagatccctgcggcgttcgcgagggtgggacgggaagcgggctgggaagtcgggccgagggaaaagtctgaagacgcttatgtccaaggggatcctgcaggtgcatcctccgatctgcgactgcccgggctgccgaatatcctccccggtgaaccgggggcggctggcagacaagaggacagtcgccctgcctgccgcccggaacctgaagaaggagcgaactcccagcttctctgccagcgatggtgacagcgacgggagtggccccacctgtgggcggcggccaggcttgaagcaggaggatggtccgcacatccgtatcatgaagagaagagtccacacccactgggacgtgaacatctctttccgagaggcgtcctgcagccaggacggcaaccttcccaccctcatatccagcgtccaccgcagccgccacctcgttatgcccgagcatcagagccgctgtgaattccagagaggcagcctggagattggcctgcgacccgccggtgacctgttgggcaagaggctgggccgctccccccgtatcagcagcgactgcttttcagagaagagggcacgaagcgaatcgcctcaagaggcgctgctgctgccgcgggagctggggcccagcatggccccggaggaccattaccgccggcttgtgtcagcactgagcgaggccagcacctttgaggaccctcagcgcctctaccacctgggcctccccagccacggtgaggacccaccctggcatgatccccctcatcacctccccagccacgatctcctgagggtccggcaggaggtggcggctgcagctctgaggggccccagtggcctggaagcccacctgccctcctccacggcaggtcagcgtcggaagcagggcctggctcagcaccgggagggcgccgccccagctgccgccccgtccttctcggagagggagctgcctcagccgccccccttgctgtcgccgcagaatgcccctcacgtcgccctgggcccccatctcaggccccccttcctgggggtgccctcggctctgtgccagaccccaggctacggcttcctgccccccgcgcaggcggagatgttcgcctggcagcaggagctcctgcggaagcagaacctggcccggctggagctgcccgccgacctcctgcggcagaaggagctggagagcgcgcgcccacagctgctggcgcccgagaccgccctgcgccccaacgacggcgccgaggagctgcagcggcgcggggccctgctggtgctgaaccacggcgcggcgccactgctggccctgcccccccaggggcccccgggctccggaccccccaccccgtcccgggactctgcccggcgagccccccggaaggggggtcccggccctgcctcagcgcggcccagcgagtccaaggagatgacgggggctaggctctgggcacaagatggctcggaagacgagccccccaaagactcggacggagaggaccccgagacggcagctgttgggtgcagggggcccactccgggccaagctccagctggaggggccggcgccgaggggaaggggcttttcccagggtccacactgcccctgggcttcccttatgccgtcagcccctacttccacacaggcgcggtagggggactctccatggatggggaggaggccccagcccctgaggacgtcaccaagtggaccgtggatgacgtctgcagcttcgtggggggcctgtctggctgtggagagtacactcgggtcttcagggagcaggggatcgacggggagaccctgccactgctgacggaggagcacctgctgaccaacatggggctgaagctggggcccgccctcaagatccgggcccaggtggccaggcgcctgggccgagttttctacgtggccagcttccccgtggctctgccactgcagccaccaaccctgcgggccccggagcgagaactcggcacaggagagcagcccttgtcccccacgacggccacgtccccctatggagggggccacgcccttgccggtcaaacttcacccaagcaggagaatgggaccttggctctacttccaggggcccccgacccttcccagcctctgtgttgaggttgccgggggtaggggtggggccacacaaatctccaggagccaccactcaacacaatggccctgcctcccaccgctttatttctttcggtttcggatgcaaaacaaaaaattttaaaagaaaatgtgacttcaaaggaaaggaacaaattttcaaagacttgggggagtgaaggcagagcctggtgcagatggacgaggtctgcagacggagggcagaggtggtggaaggggccaggggcctgcaggcctccccctggaactgggactggtctcggtctgctgacgtcagggtcagctcccccgcggagctgacttcagcagcccacagctgtggggcttcagcagccacaccagcccagcccagcccagctctcgatacgtttggtctttcatgctgaaaaataaataataaagcctgt

SEQ ID NO: 186806 - DNA, 2191 bp, Homo sapiens
  Payload ID: 16783
  Gene Symbol: SAMD11
  Gene Name: sterile alpha motif domain containing 11
  ENST ID: ENST00000341065
  CDS Start-End: 1-1769
cgcacatccgtatcatgaagagaagagtccacacccactgggacgtgaacatctctttccgagaggcgtcctgcagccaggacggcaaccttcccaccctcatatccagcgtccaccgcagccgccacctcgttatgcccgagcatcagagccgctgtgaattccagagaggcagcctggagattggcctgcgacccgccggtgacctgttgggcaagaggctgggccgctccccccgtatcagcagcgactgcttttcagagaagagggcacgaagcgaatcgcctcaagaggcgctgctgctgccgcgggagctggggcccagcatggccccggaggaccattaccgccggcttgtgtcagcactgagcgaggccagcacctttgaggaccctcagcgcctctaccacctgggcctccccagccacgatctcctgagggtccggcaggaggtggcggctgcagctctgaggggccccagtggcctggaagcccacctgccctcctccacggcaggtcagcgtcggaagcagggcctggctcagcaccgggagggcgccgccccagctgccgccccgtccttctcggagagggagctgcctcagccgccccccttgctgtcgccgcagaatgcccctcacgtcgccctgggcccccatctcaggccccccttcctgggggtgccctcggctctgtgccagaccccaggctacggcttcctgccccccgcgcaggcggagatgttcgcctggcagcaggagctcctgcggaagcagaacctggcccggctggagctgcccgccgacctcctgcggcagaaggagctggagagcgcgcgcccacagctgctggcgcccgagaccgccctgcgccccaacgacggcgccgaggagctgcagcggcgcggggccctgctggtgctgaaccacggcgcggcgccactgctggccctgcccccccaggggcccccgggctccggaccccccaccccgtcccgggactctgcccggcgagccccccggaaggggggtcccggccctgcctcagcgcggcccagcgagtccaaggagatgacgggggctaggctctgggcacaagatggctcggaagacgagccccccaaagactcggacggagaggaccccgagacggcagctgttgggtgcagggggcccactccgggccaagctccagctggaggggccggcgccgaggggaaggggcttttcccagggtccacactgcccctgggcttcccttatgccgtcagcccctacttccacacaggcgcggtagggggactctccatggatggggaggaggccccagcccctgaggacgtcaccaagtggaccgtggatgacgtctgcagcttcgtggggggcctgtctggctgtggagagtacactcgggtcttcagggagcaggggatcgacggggagaccctgccactgctgacggaggagcacctgctgaccaacatggggctgaagctggggcccgccctcaagatccgggcccaggtggccaggcgcctgggccgagttttctacgtggccagcttccccgtggctctgccactgcagccaccaaccctgcgggccccggagcgagaactcggcacaggagagcagcccttgtcccccacgacggccacgtccccctatggagggggccacgcccttgccggtcaaacttcacccaagcaggagaatgggaccttggctctacttccaggggcccccgacccttcccagcctctgtgttgaggttgccgggggtaggggtggggccacacaaatctccaggagccaccactcaacacaatggccctgcctcccaccgctttatttctttcggtttcggatgcaaaacaaaaaattttaaaagaaaatgtgacttcaaaggaaaggaacaaattttcaaagacttgggggagtgaaggcagagcctggtgcagatggacgaggtctgcagacggagggcagaggtggtggaaggggccaggggcctgcaggcctccccctggaactgggactggtctcggtctgctgacgtcagggtcagctcccccgcggagctgacttcagcagcccacagctgtggggcttcagcagccacaccagcccagcccagcccagctctcgatacgtttggtctttcatgctgaaaaataaataataaagcctgt

SEQ ID NO: 186807 - DNA, 387 bp, Homo sapiens
  Payload ID: 16783
  Gene Symbol: SAMD11
  Gene Name: sterile alpha motif domain containing 11
  ENST ID: ENST00000437963
  CDS Start-End: 61-387
cagcgcttggggctcgcgggccgctccctccgctcggaagggaaaagtctgaagacgcttatgtccaaggggatcctgcaggtgcatcctccgatctgcgactgcccgggctgccgaatatcctccccggtgaaccgggggcggctggcagacaagaggacagtcgccctgcctgccgcccggaacctgaagaaggagcgaactcccagcttctctgccagcgatggtgacagcgacgggagtggccccacctgtgggcggcggccaggcttgaagcaggaggatggtccgcacatccgtatcatgaagagaagagtccacacccactgggacgtgaacatctctttccgagaggcgtcctgcagccaggacggcaaccttcccacc

SEQ ID NO: 186808 - DNA, 626 bp, Homo sapiens
  Payload ID: 16783
  Gene Symbol: SAMD11
  Gene Name: sterile alpha motif domain containing 11
  ENST ID: ENST00000420190
  CDS Start-End: 90-626
ccaacgagttccagttcgtcagcggccgcgagacggccaaggactggaagcgcagcatccgccacaaagggaaaagtctgaagacgcttatgtccaaggggatcctgcaggtgcatcctccgatctgcgactgcccgggctgccgaatatcctccccggtgaaccgggggcggctggcagacaagaggacagtcgccctgcctgccgcccggaacctgaagaaggagcgaactcccagcttctctgccagcgatggtgacagcgacgggagtggccccacctgtgggcggcggccaggcttgaagcaggaggatggtccgcacatccgtatcatgaagagaagagtccacacccactgggacgtgaacatctctttccgagaggcgtcctgcagccaggacggcaaccttcccaccctcatatccagcgtccaccgcagccgccacctcgttatgcccgagcatcagagccgctgtgaattccagagaggcagcctggagattggcctgcgacccgccggtgacctgttgggcaagaggctgggccgctccccccgtatcagcagcgactgcttttcagagaagagggcacgaagcgaatcgcctcaagaggcgctgctgctgccg

SEQ ID NO: 186809 - DNA, 1731 bp, Homo sapiens
  Payload ID: 16783
  Gene Symbol: SAMD11
  Gene Name: sterile alpha motif domain containing 11
  ENST ID: ENST00000455979
  CDS Start-End: 1-1625
aggcgctgctgctgccgcgggagctggggcccagcatggccccggaggaccattaccgccggcttgtgtcagcactgagcgaggccagcacctttgaggaccctcagcgcctctaccacctgggcctccccagccacggtgaggacccaccctggcatgatccccctcatcacctccccagccacgatctcctgagggtccggcaggaggtggcggctgcagctctgaggggccccagtggcctggaagcccacctgccctcctccacggcaggtcagcgtcggaagcagggcctggctcagcaccgggagggcgccgccccagctgccgccccgtccttctcggagagggagctgcctcagccgccccccttgctgtcgccgcagaatgcccctcacgtcgccctgggcccccatctcaggccccccttcctgggggtgccctcggctctgtgccagaccccaggctacggcttcctgccccccgcgcaggcggagatgttcgcctggcagcaggagctcctgcggaagcagaacctggcccggctggagctgcccgccgacctcctgcggcagaaggagctggagagcgcgcgcccacagctgctggcgcccgagaccgccctgcgccccaacgacggcgccgaggagctgcagcggcgcggggccctgctggtgctgaaccacggcgcggcgccactgctggccctgcccccccaggggcccccgggctccggaccccccaccccgtcccgggactctgcccggcgagccccccggaaggggggtcccggccctgcctcagcgcggcccagcgagtccaaggagatgacgggggctaggctctgggcacaagatggctcggaagacgagccccccaaagactcggacggagaggaccccgagacggcagctgttgggtgcagggggcccactccgggccaagctccagctggaggggccggcgccgaggggaaggggcttttcccagggtccacactgcccctgggcttcccttatgccgtcagcccctacttccacacaggcgcggtagggggactctccatggatggggaggaggccccagcccctgaggacgtcaccaagtggaccgtggatgacgtctgcagcttcgtggggggcctgtctggctgtggagagtacactcgggtcttcagggagcaggggatcgacggggagaccctgccactgctgacggaggagcacctgctgaccaacatggggctgaagctggggcccgccctcaagatccgggcccaggtgagacgctggggagtgaggtcagggtctccagaccacagctgggcagaaagctctgggtgggtgtgcgacagcccccaccaggccatctctctgcaggtggccaggcgcctgggccgagttttctacgtggccagcttccccgtggctctgccactgcagccaccaaccctgcgggccccggagcgagaactcggcacaggagagcagcccttgtcccccacgacggccacgtccccctatggagggggccacgcccttgccggtcaaacttcacccaagcaggagaatgggaccttggctctacttccaggggcccccgacccttcccagcctctgtgttgaggttgccgggggtaggggtggggccacacaaatctccaggagccaccactcaacacaatggccctgcctcccaccgctttatttctttcggtttcggatgcaaaac

SEQ ID NO: 186810 - DNA, 2391 bp, Homo sapiens
  Payload ID: 16783
  Gene Symbol: SAMD11
  Gene Name: sterile alpha motif domain containing 11
  ENST ID: ENST00000616016
  CDS Start-End: 81-1118
gcagatccctgcggcgttcgcgagggtgggacgggaagcgggctgggaagtcgggccgagggaaaagtctgaagacgcttatgtccaaggggatcctgcaggtgcatcctccgatctgcgactgcccgggctgccgaatatcctccccggtgaaccgggggcggctggcagacaagaggacagtcgccctgcctgccgcccggaacctgaagaaggagcgaactcccagcttctctgccagcgatggtgacagcgacgggagtggccccacctgtgggcggcggccaggcttgaagcaggaggatggtccgcacatccgtatcatgaagagaagagtccacacccactgggacgtgaacatctctttccgagaggcgtcctgcagccaggacggcaaccttcccaccctcatatccagcgtccaccgcagccgccacctcgttatgcccgagcatcagagccgctgtgaattccagagaggcagcctggagattggcctgcgacccgccggtgacctgttgggcaagaggctgggccgctccccccgtatcagcagcgactgcttttcagagaagagggcacgaagcgaatcgcctcaagaggcgctgctgctgccgcgggagctggggcccagcatggccccggaggaccattaccgccggcttgtgtcagcactgagcgaggccagcacctttgaggaccctcagcgcctctaccacctgggcctccccagccacggtgaggacccaccctggcatgatccccctcatcacctccccagccacgggagctgcctcagccgccccccttgctgtcgccgcagaatgcccctcacgtcgccctgggcccccatctcaggccccccttcctgggggtgccctcggctctgtgccagaccccaggctacggcttcctgccccccgcgcaggcggagatgttcgcctggcagcaggagctcctgcggaagcagaacctggcccggctggagctgcccgccgacctcctgcggcagaaggagctggagagcgcgcgcccacagctgctggcgcccgagaccgccctgcgccccaacgacggcgccgaggagctgcagcggcgcggggccctgctggtgctgaaccacggcgcggcgccactgctggccctgcccccccaggggcccccgggctccggaccccccaccccgtcccgggactctgcccggcgagccccccggaaggggggtcccggccctgcctcagcgcggcccagcgagtccaaggagatgacgggggctaggctctgggcacaagatggctcggaagacgagccccccaaagactcggacggagaggaccccgagacggcagctgttgggtgcagggggcccactccgggccaagctccagctggaggggccggcgccgaggggaaggggcttttcccagggtccacactgcccctgggcttcccttatgccgtcagcccctacttccacacaggcgcggtagggggactctccatggatggggaggaggccccagcccctgaggacgtcaccaagtggaccgtggatgacgtctgcagcttcgtggggggcctgtctggctgtggagagtacactcgggtcttcagggagcaggggatcgacggggagaccctgccactgctgacggaggagcacctgctgaccaacatggggctgaagctggggcccgccctcaagatccgggcccaggtggccaggcgcctgggccgagttttctacgtggccagcttccccgtggctctgccactgcagccaccaaccctgcgggccccggagcgagaactcggcacaggagagcagcccttgtcccccacgacggccacgtccccctatggagggggccacgcccttgccggtcaaacttcacccaagcaggagaatgggaccttggctctacttccaggggcccccgacccttcccagcctctgtgttgaggttgccgggggtaggggtggggccacacaaatctccaggagccaccactcaacacaatggccctgcctcccaccgctttatttctttcggtttcggatgcaaaacaaaaaattttaaaagaaaatgtgacttcaaaggaaaggaacaaattttcaaagacttgggggagtgaaggcagagcctggtgcagatggacgaggtctgcagacggagggcagaggtggtggaaggggccaggggcctgcaggcctccccctggaactgggactggtctcggtctgctgacgtcagggtcagctcccccgcggagctgacttcagcagcccacagctgtggggcttcagcagccacaccagcccagcccagcccagctctcgatacgtttggtctttcatgctgaaaaataaataataaagcctgtcccgtg

SEQ ID NO: 186811 - DNA, 2159 bp, Homo sapiens
  Payload ID: 16783
  Gene Symbol: SAMD11
  Gene Name: sterile alpha motif domain containing 11
  ENST ID: ENST00000618323
  CDS Start-End: 81-1046
gcagatccctgcggcgttcgcgagggtgggacgggaagcgggctgggaagtcgggccgagggaaaagtctgaagacgcttatgtccaaggggatcctgcaggtgcatcctccgatctgcgactgcccgggctgccgaatatcctccccggtgaaccgggggcggctggcagacaagaggacagtcgccctgcctgccgcccggaacctgaagaaggagcgaactcccagcttctctgccagcgatggtgacagcgacgggagtggccccacctgtgggcggcggccaggcttgaagcaggaggatggtccgcacatccgtatcatgaagagaagagtccacacccactgggacgtgaacatctctttccgagaggcgtcctgcagccaggacggcaaccttcccaccctcatatccagcggctgcagctctgaggggccccagtggcctggaagcccacctgccctcctccacggcaggtcagcgtcggaagcagggcctggctcagcaccgggagggcgccgccccagctgccgccccgtccttctcggagagggagctgcctcagccgccccccttgctgtcgccgcagaatgcccctcacgtcgccctgggcccccatctcaggccccccttcctgggggtgccctcggctctgtgccagaccccaggctacggcttcctgccccccgcgcaggcggagatgttcgcctggcagcaggagctcctgcggaagcagaacctggcccggctggagctgcccgccgacctcctgcggcagaaggagctggagagcgcgcgcccacagctgctggcgcccgagaccgccctgcgccccaacgacggcgccgaggagctgcagcggcgcggggccctgctggtgctgaaccacggcgcggcgccactgctggccctgcccccccaggggcccccgggctccggaccccccaccccgtcccgggactctgcccggcgagccccccggaaggggggtcccggccctgcctcagcgcggcccagcgagtccaaggagatgacgggggctaggctctgggcacaagatggctcggaagacgagccccccaaagactcggacggagaggaccccgagacggcagctgttgggtgcagggggcccactccgggccaagctccagctggaggggccggcgccgaggggaaggggcttttcccagggtccacactgcccctgggcttcccttatgccgtcagcccctacttccacacaggcgcggtagggggactctccatggatggggaggaggccccagcccctgaggacgtcaccaagtggaccgtggatgacgtctgcagcttcgtggggggcctgtctggctgtggagagtacactcgggtcttcagggagcaggggatcgacggggagaccctgccactgctgacggaggagcacctgctgaccaacatggggctgaagctggggcccgccctcaagatccgggcccaggtggccaggcgcctgggccgagttttctacgtggccagcttccccgtggctctgccactgcagccaccaaccctgcgggccccggagcgagaactcggcacaggagagcagcccttgtcccccacgacggccacgtccccctatggagggggccacgcccttgccggtcaaacttcacccaagcaggagaatgggaccttggctctacttccaggggcccccgacccttcccagcctctgtgttgaggttgccgggggtaggggtggggccacacaaatctccaggagccaccactcaacacaatggccctgcctcccaccgctttatttctttcggtttcggatgcaaaacaaaaaattttaaaagaaaatgtgacttcaaaggaaaggaacaaattttcaaagacttgggggagtgaaggcagagcctggtgcagatggacgaggtctgcagacggagggcagaggtggtggaaggggccaggggcctgcaggcctccccctggaactgggactggtctcggtctgctgacgtcagggtcagctcccccgcggagctgacttcagcagcccacagctgtggggcttcagcagccacaccagcccagcccagcccagctctcgatacgtttggtctttcatgctgaaaaataaataataaagcctgtcccgtg

SEQ ID NO: 186812 - DNA, 2179 bp, Homo sapiens
  Payload ID: 16783
  Gene Symbol: SAMD11
  Gene Name: sterile alpha motif domain containing 11
  ENST ID: ENST00000618181
  CDS Start-End: 81-1751
gcagatccctgcggcgttcgcgagggtgggacgggaagcgggctgggaagtcgggccgagggaaaagtctgaagacgcttatgtccaaggggatcctgcaggtgcatcctccgatctgcgactgcccgggctgccgaatatcctccccggtgaaccgggggcggctggcagacaagaggacagtcgccctgcctgccgcccggaacctgaagaaggagcgaactcccagcttctctgccagcgatggtgacagcgacgggagtggccccacctgtgggcggcggccaggcttgaagcaggaggatggtccgcacatccgtatcatgaagagaagccaggacggcaaccttcccaccctcatatccagcgtccaccgcagccgccacctcgttatgcccgagcatcagagccgctgtgaattccagagaggcagcctggagattggcctgcgacccgccggtgacctgttgggcaagaggctgggccgctccccccgtatcagcagcgactgcttttcagagaagagggcacgaagcgaatcgcctcaagcagaggcgctgctgctgccgcgggagctggggcccagcatggccccggaggaccattaccgccggcttgtgtcagcactgagcgaggccagcacctttgaggaccctcagcgcctctaccacctgggcctccccagccacggctacggcttcctgccccccgcgcaggcggagatgttcgcctggcagcaggagctcctgcggaagcagaacctggcccggctggagctgcccgccgacctcctgcggcagaaggagctggagagcgcgcgcccacagctgctggcgcccgagaccgccctgcgccccaacgacggcgccgaggagctgcagcggcgcggggccctgctggtgctgaaccacggcgcggcgccactgctggccctgcccccccaggggcccccgggctccggaccccccaccccgtcccgggactctgcccggcgagccccccggaaggggggtcccggccctgcctcagcgcggcccagcgagtccaaggagatgacgggggctaggctctgggcacaagatggctcggaagacgagccccccaaagactcggacggagaggaccccgagacggcagctgttgggtgcagggggcccactccgggccaagctccagctggaggggccggcgccgaggggaaggggcttttcccagggtccacactgcccctgggcttcccttatgccgtcagcccctacttccacacaggcgcggtagggggactctccatggatggggaggaggccccagcccctgaggacgtcaccaagtggaccgtggatgacgtctgcagcttcgtggggggcctgtctggctgtggagagtacactcgggtcttcagggagcaggggatcgacggggagaccctgccactgctgacggaggagcacctgctgaccaacatggggctgaagctggggcccgccctcaagatccgggcccaggtggccaggcgcctgggccgagttttctacgtggccagcttccccgtggctctgccactgcagccaccaaccctgcgggccccggagcgagaactcggcacaggagagcagcccttgtcccccacgacggccacgtccccctatggagggggccacgcccttgccggtcaaacttcacccaagcaggagaatgggaccttggctctacttccaggggcccccgacccttcccagcctctgtgttgaggttgccgggggtaggggtggggccacacaaatctccaggagccaccactcaacacaatggccctgcctcccaccgctttatttctttcggtttcggatgcaaaacaaaaaattttaaaagaaaatgtgacttcaaaggaaaggaacaaattttcaaagacttgggggagtgaaggcagagcctggtgcagatggacgaggtctgcagacggagggcagaggtggtggaaggggccaggggcctgcaggcctccccctggaactgggactggtctcggtctgctgacgtcagggtcagctcccccgcggagctgacttcagcagcccacagctgtggggcttcagcagccacaccagcccagcccagcccagctctcgatacgtttggtctttcatgctgaaaaataaataataaagcctgtcccgtg

SEQ ID NO: 186813 - DNA, 2314 bp, Homo sapiens
  Payload ID: 16783
  Gene Symbol: SAMD11
  Gene Name: sterile alpha motif domain containing 11
  ENST ID: ENST00000617307
  CDS Start-End: 81-1886
gcagatccctgcggcgttcgcgagggtgggacgggaagcgggctgggaagtcgggccgagggaaaagtctgaagacgcttatgtccaaggggatcctgcaggtgcatcctccgatctgcgactgcccgggctgccgaatatcctccccggtgaaccgggggcggctggcagacaagaggacagtcgccctgcctgccgcccggaacctgaagaaggagcgaactcccagcttctctgccagcgatggtgacagcgacgggagtggccccacctgtgggcggcggccaggcttgaagcaggaggatggtccgcacatccgtatcatgaagagaagagtccacacccactgggacgtgaacatctctttccgagaggcgtcctgcagccaggacggcaaccttcccaccctcatatccagcgtccaccgcagccgccacctcgttatgcccgagcatcagagccgctgtgaattccagagaggcagcctggagattggcctgcgacccgccggtgacctgttgggcaagaggctgggccgctccccccgtatcagcagcgactgcttttcagagaagagggcacgaagcgaatcgcctcaagaggcgctgctgctgccgcgggagctggggcccagcatggccccggaggaccattaccgccggcttgtgtcagcactgagcgaggccagcacctttgaggaccctcagcgcctctaccacctgggcctccccagccacgatctcctgagggtccggcaggaggtggcggctgcagctctgaggggccccagtggcctggaagcccacctgccctcctccacggcaggctacggcttcctgccccccgcgcaggcggagatgttcgcctggcagcaggagctcctgcggaagcagaacctggcccggctggagctgcccgccgacctcctgcggcagaaggagctggagagcgcgcgcccacagctgctggcgcccgagaccgccctgcgccccaacgacggcgccgaggagctgcagcggcgcggggccctgctggtgctgaaccacggcgcggcgccactgctggccctgcccccccaggggcccccgggctccggaccccccaccccgtcccgggactctgcccggcgagccccccggaaggggggtcccggccctgcctcagcgcggcccagcgagtccaaggagatgacgggggctaggctctgggcacaagatggctcggaagacgagccccccaaagactcggacggagaggaccccgagacggcagctgttgggtgcagggggcccactccgggccaagctccagctggaggggccggcgccgaggggaaggggcttttcccagggtccacactgcccctgggcttcccttatgccgtcagcccctacttccacacaggcgcggtagggggactctccatggatggggaggaggccccagcccctgaggacgtcaccaagtggaccgtggatgacgtctgcagcttcgtggggggcctgtctggctgtggagagtacactcgggtcttcagggagcaggggatcgacggggagaccctgccactgctgacggaggagcacctgctgaccaacatggggctgaagctggggcccgccctcaagatccgggcccaggtggccaggcgcctgggccgagttttctacgtggccagcttccccgtggctctgccactgcagccaccaaccctgcgggccccggagcgagaactcggcacaggagagcagcccttgtcccccacgacggccacgtccccctatggagggggccacgcccttgccggtcaaacttcacccaagcaggagaatgggaccttggctctacttccaggggcccccgacccttcccagcctctgtgttgaggttgccgggggtaggggtggggccacacaaatctccaggagccaccactcaacacaatggccctgcctcccaccgctttatttctttcggtttcggatgcaaaacaaaaaattttaaaagaaaatgtgacttcaaaggaaaggaacaaattttcaaagacttgggggagtgaaggcagagcctggtgcagatggacgaggtctgcagacggagggcagaggtggtggaaggggccaggggcctgcaggcctccccctggaactgggactggtctcggtctgctgacgtcagggtcagctcccccgcggagctgacttcagcagcccacagctgtggggcttcagcagccacaccagcccagcccagcccagctctcgatacgtttggtctttcatgctgaaaaataaataataaagcctgtcccgtg

SEQ ID NO: 186814 - DNA, 2557 bp, Homo sapiens
  Payload ID: 16783
  Gene Symbol: SAMD11
  Gene Name: sterile alpha motif domain containing 11
  ENST ID: ENST00000622503
  CDS Start-End: 81-2129
gcagatccctgcggcgttcgcgagggtgggacgggaagcgggctgggaagtcgggccgagggaaaagtctgaagacgcttatgtccaaggggatcctgcaggtgcatcctccgatctgcgactgcccgggctgccgaatatcctccccggtgaaccgggggcggctggcagacaagaggacagtcgccctgcctgccgcccggaacctgaagaaggagcgaactcccagcttctctgccagcgatggtgacagcgacgggagtggccccacctgtgggcggcggccaggcttgaagcaggaggatggtccgcacatccgtatcatgaagagaagagtccacacccactgggacgtgaacatctctttccgagaggcgtcctgcagccaggacggcaaccttcccaccctcatatccagcgtccaccgcagccgccacctcgttatgcccgagcatcagagccgctgtgaattccagagaggcagcctggagattggcctgcgacccgccggtgacctgttgggcaagaggctgggccgctccccccgtatcagcagcgactgcttttcagagaagagggcacgaagcgaatcgcctcaagcagaggcgctgctgctgccgcgggagctggggcccagcatggccccggaggaccattaccgccggcttgtgtcagcactgagcgaggccagcacctttgaggaccctcagcgcctctaccacctgggcctccccagccacggtgaggacccaccctggcatgatccccctcatcacctccccagccacgatctcctgagggtccggcaggaggtggcggctgcagctctgaggggccccagtggcctggaagcccacctgccctcctccacggcaggtcagcgtcggaagcagggcctggctcagcaccgggagggcgccgccccagctgccgccccgtccttctcggagagggagctgcctcagccgccccccttgctgtcgccgcagaatgcccctcacgtcgccctgggcccccatctcaggccccccttcctgggggtgccctcggctctgtgccagaccccaggctacggcttcctgccccccgcgcaggcggagatgttcgcctggcagcaggagctcctgcggaagcagaacctggcccggctggagctgcccgccgacctcctgcggcagaaggagctggagagcgcgcgcccacagctgctggcgcccgagaccgccctgcgccccaacgacggcgccgaggagctgcagcggcgcggggccctgctggtgctgaaccacggcgcggcgccactgctggccctgcccccccaggggcccccgggctccggaccccccaccccgtcccgggactctgcccggcgagccccccggaaggggggtcccggccctgcctcagcgcggcccagcgagtccaaggagatgacgggggctaggctctgggcacaagatggctcggaagacgagccccccaaagactcggacggagaggaccccgagacggcagctgttgggtgcagggggcccactccgggccaagctccagctggaggggccggcgccgaggggaaggggcttttcccagggtccacactgcccctgggcttcccttatgccgtcagcccctacttccacacaggcgcggtagggggactctccatggatggggaggaggccccagcccctgaggacgtcaccaagtggaccgtggatgacgtctgcagcttcgtggggggcctgtctggctgtggagagtacactcgggtcttcagggagcaggggatcgacggggagaccctgccactgctgacggaggagcacctgctgaccaacatggggctgaagctggggcccgccctcaagatccgggcccaggtggccaggcgcctgggccgagttttctacgtggccagcttccccgtggctctgccactgcagccaccaaccctgcgggccccggagcgagaactcggcacaggagagcagcccttgtcccccacgacggccacgtccccctatggagggggccacgcccttgccggtcaaacttcacccaagcaggagaatgggaccttggctctacttccaggggcccccgacccttcccagcctctgtgttgaggttgccgggggtaggggtggggccacacaaatctccaggagccaccactcaacacaatggccctgcctcccaccgctttatttctttcggtttcggatgcaaaacaaaaaattttaaaagaaaatgtgacttcaaaggaaaggaacaaattttcaaagacttgggggagtgaaggcagagcctggtgcagatggacgaggtctgcagacggagggcagaggtggtggaaggggccaggggcctgcaggcctccccctggaactgggactggtctcggtctgctgacgtcagggtcagctcccccgcggagctgacttcagcagcccacagctgtggggcttcagcagccacaccagcccagcccagcccagctctcgatacgtttggtctttcatgctgaaaaataaataataaagcctgtcccgtg

SEQ ID NO: 186815 - DNA, 2368 bp, Homo sapiens
  Payload ID: 16783
  Gene Symbol: SAMD11
  Gene Name: sterile alpha motif domain containing 11
  ENST ID: ENST00000618779
  CDS Start-End: 81-1940
gcagatccctgcggcgttcgcgagggtgggacgggaagcgggctgggaagtcgggccgagggaaaagtctgaagacgcttatgtccaaggggatcctgcaggtgcatcctccgatctgcgactgcccgggctgccgaatatcctccccggtgaaccgggggcggctggcagacaagaggacagtcgccctgcctgccgcccggaacctgaagaaggagcgaactcccagcttctctgccagcgatggtgacagcgacgggagtggccccacctgtgggcggcggccaggcttgaagcaggaggatggtccgcacatccgtatcatgaagagaagagtccacacccactgggacgtgaacatctctttccgagaggcgtcctgcagccaggacggcaaccttcccaccctcatatccagcgtccaccgcagccgccacctcgttatgcccgagcatcagagccgctgtgaattccagagaggcagcctggagattggcctgcgacccgccggtgacctgttgggcaagaggctgggccgctccccccgtatcagcagcgactgcttttcagagaagagggcacgaagcgaatcgcctcaagatctcctgagggtccggcaggaggtggcggctgcagctctgaggggccccagtggcctggaagcccacctgccctcctccacggcaggtcagcgtcggaagcagggcctggctcagcaccgggagggcgccgccccagctgccgccccgtccttctcggagagggagctgcctcagccgccccccttgctgtcgccgcagaatgcccctcacgtcgccctgggcccccatctcaggccccccttcctgggggtgccctcggctctgtgccagaccccaggctacggcttcctgccccccgcgcaggcggagatgttcgcctggcagcaggagctcctgcggaagcagaacctggcccggctggagctgcccgccgacctcctgcggcagaaggagctggagagcgcgcgcccacagctgctggcgcccgagaccgccctgcgccccaacgacggcgccgaggagctgcagcggcgcggggccctgctggtgctgaaccacggcgcggcgccactgctggccctgcccccccaggggcccccgggctccggaccccccaccccgtcccgggactctgcccggcgagccccccggaaggggggtcccggccctgcctcagcgcggcccagcgagtccaaggagatgacgggggctaggctctgggcacaagatggctcggaagacgagccccccaaagactcggacggagaggaccccgagacggcagctgttgggtgcagggggcccactccgggccaagctccagctggaggggccggcgccgaggggaaggggcttttcccagggtccacactgcccctgggcttcccttatgccgtcagcccctacttccacacaggcgcggtagggggactctccatggatggggaggaggccccagcccctgaggacgtcaccaagtggaccgtggatgacgtctgcagcttcgtggggggcctgtctggctgtggagagtacactcgggtcttcagggagcaggggatcgacggggagaccctgccactgctgacggaggagcacctgctgaccaacatggggctgaagctggggcccgccctcaagatccgggcccaggtggccaggcgcctgggccgagttttctacgtggccagcttccccgtggctctgccactgcagccaccaaccctgcgggccccggagcgagaactcggcacaggagagcagcccttgtcccccacgacggccacgtccccctatggagggggccacgcccttgccggtcaaacttcacccaagcaggagaatgggaccttggctctacttccaggggcccccgacccttcccagcctctgtgttgaggttgccgggggtaggggtggggccacacaaatctccaggagccaccactcaacacaatggccctgcctcccaccgctttatttctttcggtttcggatgcaaaacaaaaaattttaaaagaaaatgtgacttcaaaggaaaggaacaaattttcaaagacttgggggagtgaaggcagagcctggtgcagatggacgaggtctgcagacggagggcagaggtggtggaaggggccaggggcctgcaggcctccccctggaactgggactggtctcggtctgctgacgtcagggtcagctcccccgcggagctgacttcagcagcccacagctgtggggcttcagcagccacaccagcccagcccagcccagctctcgatacgtttggtctttcatgctgaaaaataaataataaagcctgtcccgtg

SEQ ID NO: 186816 - DNA, 2230 bp, Homo sapiens
  Payload ID: 16783
  Gene Symbol: SAMD11
  Gene Name: sterile alpha motif domain containing 11
  ENST ID: ENST00000616125
  CDS Start-End: 81-1802
gcagatccctgcggcgttcgcgagggtgggacgggaagcgggctgggaagtcgggccgagggaaaagtctgaagacgcttatgtccaaggggatcctgcaggtgcatcctccgatctgcgactgcccgggctgccgaatatcctccccggtgaaccgggggcggctggcagacaagaggacagtcgccctgcctgccgcccggaacctgaagaaggagcgaactcccagcttctctgccagcgatggtgacagcgacgggagtggccccacctgtgggcggcggccaggcttgaagcaggaggatggtccgcacatccgtatcatgaagagaagagtccacacccactgggacgtgaacatctctttccgagaggcgtcctgcagccaggacggcaaccttcccaccctcatatccagcgtccaccgcagccgccacctcgttatgcccgagcatcagagccgctgtgaattccagagaggcagcctggagattggcctgcgacccgccggtgacctgttgggcaagaggctgggccgctccccccgtatcagcagcgactgcttttcagagaagagggcacgaagcgaatcgcctcaagcagaggcgctgctgctgccgcgggagctggggcccagcatggccccggaggaccattaccgccggcttgtgtcagcactgagcgaggccagcacctttgaggaccctcagcgcctctaccacctgggcctccccagccacggctacggcttcctgccccccgcgcaggcggagatgttcgcctggcagcaggagctcctgcggaagcagaacctggcccggctggagctgcccgccgacctcctgcggcagaaggagctggagagcgcgcgcccacagctgctggcgcccgagaccgccctgcgccccaacgacggcgccgaggagctgcagcggcgcggggccctgctggtgctgaaccacggcgcggcgccactgctggccctgcccccccaggggcccccgggctccggaccccccaccccgtcccgggactctgcccggcgagccccccggaaggggggtcccggccctgcctcagcgcggcccagcgagtccaaggagatgacgggggctaggctctgggcacaagatggctcggaagacgagccccccaaagactcggacggagaggaccccgagacggcagctgttgggtgcagggggcccactccgggccaagctccagctggaggggccggcgccgaggggaaggggcttttcccagggtccacactgcccctgggcttcccttatgccgtcagcccctacttccacacaggcgcggtagggggactctccatggatggggaggaggccccagcccctgaggacgtcaccaagtggaccgtggatgacgtctgcagcttcgtggggggcctgtctggctgtggagagtacactcgggtcttcagggagcaggggatcgacggggagaccctgccactgctgacggaggagcacctgctgaccaacatggggctgaagctggggcccgccctcaagatccgggcccaggtggccaggcgcctgggccgagttttctacgtggccagcttccccgtggctctgccactgcagccaccaaccctgcgggccccggagcgagaactcggcacaggagagcagcccttgtcccccacgacggccacgtccccctatggagggggccacgcccttgccggtcaaacttcacccaagcaggagaatgggaccttggctctacttccaggggcccccgacccttcccagcctctgtgttgaggttgccgggggtaggggtggggccacacaaatctccaggagccaccactcaacacaatggccctgcctcccaccgctttatttctttcggtttcggatgcaaaacaaaaaattttaaaagaaaatgtgacttcaaaggaaaggaacaaattttcaaagacttgggggagtgaaggcagagcctggtgcagatggacgaggtctgcagacggagggcagaggtggtggaaggggccaggggcctgcaggcctccccctggaactgggactggtctcggtctgctgacgtcagggtcagctcccccgcggagctgacttcagcagcccacagctgtggggcttcagcagccacaccagcccagcccagcccagctctcgatacgtttggtctttcatgctgaaaaataaataataaagcctgtcccgtg

SEQ ID NO: 186817 - DNA, 1874 bp, Homo sapiens
  Payload ID: 16783
  Gene Symbol: SAMD11
  Gene Name: sterile alpha motif domain containing 11
  ENST ID: ENST00000620200
  CDS Start-End: 81-761
gcagatccctgcggcgttcgcgagggtgggacgggaagcgggctgggaagtcgggccgagggaaaagtctgaagacgcttatgtccaaggggatcctgcaggtgcatcctccgatctgcgactgcccgggctgccgaatatcctccccggtgaaccgggggcggctggcagacaagaggacagtcgccctgcctgccgcccggaacctgaagaaggagcgaactcccagcttctctgccagcgatggtgacagcgacgggagtggccccacctgtgggcggcggccaggcttgaagcaggaggatggtccgcacatccgtatcatgaagagaagagtccacacccactgggacgtgaacatctctttccgagaggcgtcctgcaggctacggcttcctgccccccgcgcaggcggagatgttcgcctggcagcaggagctcctgcggaagcagaacctggcccggctggagctgcccgccgacctcctgcggcagaaggagctggagagcgcgcgcccacagctgctggcgcccgagaccgccctgcgccccaacgacggcgccgaggagctgcagcggcgcggggccctgctggtgctgaaccacggcgcggcgccactgctggccctgcccccccaggggcccccgggctccggaccccccaccccgtcccgggactctgcccggcgagccccccggaaggggggtcccggccctgcctcagcgcggcccagcgagtccaaggagatgacgggggctaggctctgggcacaagatggctcggaagacgagccccccaaagactcggacggagaggaccccgagacggcagctgttgggtgcagggggcccactccgggccaagctccagctggaggggccggcgccgaggggaaggggcttttcccagggtccacactgcccctgggcttcccttatgccgtcagcccctacttccacacaggcgcggtagggggactctccatggatggggaggaggccccagcccctgaggacgtcaccaagtggaccgtggatgacgtctgcagcttcgtggggggcctgtctggctgtggagagtacactcgggtcttcagggagcaggggatcgacggggagaccctgccactgctgacggaggagcacctgctgaccaacatggggctgaagctggggcccgccctcaagatccgggcccaggtggccaggcgcctgggccgagttttctacgtggccagcttccccgtggctctgccactgcagccaccaaccctgcgggccccggagcgagaactcggcacaggagagcagcccttgtcccccacgacggccacgtccccctatggagggggccacgcccttgccggtcaaacttcacccaagcaggagaatgggaccttggctctacttccaggggcccccgacccttcccagcctctgtgttgaggttgccgggggtaggggtggggccacacaaatctccaggagccaccactcaacacaatggccctgcctcccaccgctttatttctttcggtttcggatgcaaaacaaaaaattttaaaagaaaatgtgacttcaaaggaaaggaacaaattttcaaagacttgggggagtgaaggcagagcctggtgcagatggacgaggtctgcagacggagggcagaggtggtggaaggggccaggggcctgcaggcctccccctggaactgggactggtctcggtctgctgacgtcagggtcagctcccccgcggagctgacttcagcagcccacagctgtggggcttcagcagccacaccagcccagcccagcccagctctcgatacgtttggtctttcatgctgaaaaataaataataaagcctgtcccgtg

SEQ ID NO: 186818 - DNA, 2172 bp, Homo sapiens
  Payload ID: 16784
  Gene Symbol: SAMD12
  Gene Name: sterile alpha motif domain containing 12
  Uniprot ID: Q8N8I0
  ENST ID: ENST00000314727
  CDS Start-End: 138-743
gcgtgaccgcggcaggttggtcctggagcagataagcgcagaatatttaggcgaaagcgagaggaaggggggagcgcggggcaggaggagtacctcggccaagaaaattatgcatgcgttagggaagctctgagagaatggctgtggaagctctccactgtggtttgaatccacggggtattgatcaccctgcccatgctgaaggtattaaactgcaaattgaaggtgaaggtgtggaatctcaatccattaaaaataaaaatttccagaaggtgcctgaccagaaaggaactcccaagcgactgcaggcagaagctgagacggctaagtcagctacggtgaagctatctaaaccggtggctctatggacccagcaggatgtctgcaagtggttgaagaaacattgtccgaatcagtatcagatctacagtgagtcattcaaacagcatgacataactgggcgagccctgctgagacttactgacaaaaagctcgagcgaatggggattgcccaggagaacctccggcagcacatcttacaacaggtgctccagctgaaggtgcgagaagaagtcagaaatctacagttactcacacaaggtaccctattgcttcctgatgggtggatggatggggagattagaagaaagaccaccttactattaggacagacaggagtcagggagaatttgttattgtttcttcacagaatttccatcatagaaaatagtatacagatttaagattacttccctttgaaaacttttttcatagctcactagggagaaggatgcacaaataagtaatggatgagcaaacagaattacctgagctaacttcaaggtggtcacgtacagttgtatggattgtgtactgcacaaccccagagaataccagtcacatcaatcagggtacgattgcactcactagagttgtataatgtgcagcctgcacaactgtacagtccagctgtagctatcttcacctgcgccaattgtgagggcgctttagcatttgagtgattcaatagttacgatgaccagtgatataagtggagtttttgttgtatttttgttttgcttttcaccggttagtgggagaaaaacattttagatatgtattactatacatgaatgtattatacacacacactttagagattgtaagaaccccatttagcttcttgaaagtggaataatttttataatagactatagtgaatctaaaactacactgttaagagtatataattcttaacaggaattataaataacttcaatatgatgagagcacttaagatctcaataactgtggaagtgacaaaataaagctagaattcgaagaaagccttaagttacactatatgtaactgatatgtctacatgagatttggatgctatcaaccttcattggctataaactttatttgttttattttagcgtccattgtacatcgttttaaatgaaaggatgataaaatatgtgtttttgagagccttgagtatttgtcattctgcagaatattgtaattgcatgcataccgatattggagaaatctgggtcagccaagtttcatgttattgcatttagattaacctagtaatagtccatttgcctagaggaaataatgtgctccctgaaagatgactattctagaaggataaatatagatttcaagtgatcgtaaaatagtattgtttgtctcatatgcattatttgcattttgtcctcagagatttccaatggtgaatttactggtatactaagtgatttaaatttgaatgtgaaatactgataggcttttaagcttcttttaagaagtagatagaaatacgaagattatgataagaaagtctgtcacagtgctatttggaaaacggaaaatttacaagcaacctagaggtccagcaatgtgaaaagaatcaagtaattctgcttaaattcataagattcagtataatgcccagttattaaaattacatctttaaagaatacatgacaacatgggaaattacgtaagtcatacaaggtgggaggaaaggtcatgtgtaaaattgtatgcataatataagcccaattttgtaaaaaccatatattcttatatgtacagaaaaaaaggactgcaagtaaatatgccaaccattttaataaaggatctctctggattgtggg

SEQ ID NO: 186819 - DNA, 8866 bp, Homo sapiens
  Payload ID: 16784
  Gene Symbol: SAMD12
  Gene Name: sterile alpha motif domain containing 12
  ENST ID: ENST00000409003
  CDS Start-End: 130-615
gcggcaggttggtcctggagcagataagcgcagaatatttaggcgaaagcgagaggaaggggggagcgcggggcaggaggagtacctcggccaagaaaattatgcatgcgttagggaagctctgagagaatggctgtggaagctctccactgtggtttgaatccacggggtattgatcaccctgcccatgctgaaggtattaaactgcaaattgaaggtgaaggtgtggaatctcaatccattaaaaataaaaatttccagaaggtgcctgaccagaaaggaactcccaagcgactgcaggcagaagctgagacggctaagtcagctacggtgaagctatctaaaccggtggctctatggacccagcaggatgtctgcaagtggttgaagaaacattgtccgaatcagtatcagatctacagtgagtcattcaaacagcatgacataactgggcgagccctgctgagacttactgacaaaaagctcgagcgaatggggattgcccaggagaacctccggcagcacatcttacaacaggtgctccagctgaaggtgcgagaagaagtcagaaatctacagttactcacacaagcatcatctgagggttctccataaacacggttagccttccaagctgctgtcctgccagttgatatgaacatggcctgttcctcacagaaagactaacccatggcactgccagaagatatccttggatcgtggacagattaactggattaactgaaaaaagcacccattcagtcaatattatgggttttggaaaaatcttgctttgctgtggatttaaaatgaggtgcataatataatgccaactcattccaagtggtcattggcagaccattagctggaaaattgcttccagttttcatcactgtgcataactcaagttccctttggggagctgtctgtgcccttcactagaagtcctgttttagcatggcaactactggattattttattatgtgtgcagatggcatgatgttttagaaaaaaaaaattacagcaattctgcaatctcagtggaagtgttcacaatattatgccctggtaggaatgtaaacacgtctcgattatgttagttatgatgtctaaaggtatactgtccaactcttaagcactttatatgagaacactacaccaagatgaatcagcacattcagcacatgtgagaaatcaagtattttctttttatttttataaatcttagtggtttttttttttccggctcagactgtccaagacaaactccactactcgcatatccccagttgtttgtggtaggttgatgtaaatatggccacaatactgttagacttcacctccagatactttattgaacaactggtttacttctagcaccaaagggaagaagaagggggtccagtgatggtgatatcttagcttgcttctttgttcacaggcactattgaccacatgaacatacaggtactcaaatacaggaggcttctatttggctcctccaagggaggagttcctccaagggaaaaaaggggatggtattcttttaatcaaagaccatggtggatggatggtaagggcaacagaatgcaattcttttgtgtggtctgacgttaacacttcggaaaaaattctaagtcaagttgaaatcgccattctctcaagagagaaacatcaagagagaaacatcaagtgaccccactatgtgcctagagaaggaaaagggtcaagtcctatactaggttccttacttagggtagaacctactagtcccttgttaatcctttctgggattatacctgtgactaatttttttttttttaactatgtcttacgacaaagcacagtcctgggaaaccagtcaacttaattattgcttgtctttgagcattagagacatgttcatattgacttgctacataacactgtagcatgttttttcctgaaaatatcaagttggttgaatggaaagctcagcaaagtatgttctgtgtgcccactgtcccagcctgggactgacgggcatcagaggctttgctttaaaatatgggtaaccagttctggaagacttccaacgcaagcaagcttggtgttttagggtgtctccagatacataagcattgtctgcctccgctcagggtctcaggaaatacacagcccattggaaaccacccacgcctgagatttggaaacctgacggaaagggaggaaggtccaaatgagtcagcagcaggatgactcaccacaagcctggcaggctgcagagccagagaagggggcttccaacaaggaactcagagaagttgcagtcaccaccaagatctggcccttcggcaggtcagcaccaggactgccaggccctctgcagaccgtaattctcttcacatctataattaggaggccaaactccagctgccaacacccttggacacaatattccagtctccactgcccatctcatgtggttcagttctaatagcaggtcttcttcttcctttcattccttcctttattcagcaagcatttgttgagcatctactatgtgccaagcattgtgcttgggcaacaacagtccacaaagcagactccccacctgcccttatgaaactgtatctcctcctccccaacattatcaccaccccaccatttccacaatgaaaactgaattcagacagcattctccattctgccagagtaacctaggaagaagaacatggcagcagacggatcctcagggaggaggcagcagagtgacagatggtaaactgcatcaggccacatatttgcacctttcagatacagccaactcttccagggcctagactgagctggttggagctccccaaagcagcattcagttgcttttccttgatatccaccctggctacctatattccctttctttatataggcacaaccattcaccactacgctggattatctaacactccaattctataactcatccaggggacacacagttgagtctgatgaagcctaagaactgccaggtgctgagatattgtaactgggaattaagatttagccaaggacattgtgagactactgctgactctcttggaaaactggacatgctttgtagtgcaaatgttcactaaatgatggtggttcattgttacttactttggcctttgcaaaatattctgaacaattcaataagtagagtttcctagtttgtttgtttttttaagtcaaaggaacgctgtgaaattattgaaagatgatgggtgaagagggacctaggagaaggcaaaatgaagaccattaaagagccccattgaagactgtatctctaaaaatgccttaatgcctggcacatattccatatttgcatatgaactactattcttttccaaactgtcaacttctgtttgaaatcattgtgggggatagtttggaaatatggtggcataaaatccaagcagtcaagagctaaaccagcaaaaaagaggaatgacttcattcacaggctttggcttctttattatgtggtggtcctctgtgatctcccatggttaacttcaactgtgctgtactttcttcccaagatgcatgtacggaatgttacctcctagaaatccagaaatagttgtggtgagttttgtttgataggaagcaagaggtggggaagtaaaggatacatatttttatgtctaaggactgtaaactgttgatgcttgacttttccttttacctacacctgtgctacacctttattaaaaggctgacacccagacttgtgcaggaaaggcactcttgggaatgaacagaaatgaataattatgagactttccatggtgccaaggggattcgcttatttccactccagaactgaatatgcagagcattgccagtcctgctagtgtgaaaagcaaattacttcaatagtttgagacgtacctaggggaagagagatcctatcaactttctttgcgggtagtggcgtaccttcaaatccttgctcaggctctgtgaggtgtgcacccgcagatttcacttctacctccggaatcctggcaaacaagccaggaatctctccagagtcacttcgcagttgctcagaaagaggctaacggtccttagtcctgaggaaattctgccatttttaacattcaaggagaaaaggcgtatcagctgtacgtgagaatatcaactaaggataaaaacctctaatggatcccccttgttacttgcaaatgctttctttgtctgcaaatgtcacataattgattttgcataggaacaacaaaagtctcaaggaattgaagtttttaataccccccttagcactttactttcaccaaaacctcctctttctagtacatgagcagttttgttctttgtgatgttttcctctacattctttagaataattttgttacttgacaactagacttgtcaatcgtcttagactcttttgaaaaatctaatctttgaaaatgacacaaattcctttattgctttaaggctgttttcattcacccctcccacagccccctccactgcacttttttgttttttgcggggatttttttctttcatctctcttcttttaacatgatgctgtgggtagttttcaagaattctataaagaactcaacaaaaagtgtatttgttacctttttccccagtcctaatatttcttcttaagcttgatcttggtgaaaatttgttgcccaaaaagcagtgaggtagggattaataacgctgaccagtcatctggaagattaattaatcccagtgcagccctgagatcaggaaggaggacaggccaggagatgtttctactccaggcaccactaaggactctatttcaaaggcagatcctgctccttagtctttttagatctgaatctaatcctgaatccagaaaattatcctatgaattctggtttatcaacgcacatgattcctggcaccattgcatagcttcaaggtaaaagagagccttgtttccattattttgctatggtggcttttgggaagacagagagcattcttttgaaagcgggaaacttaaggaaaagttggccaagtacacaggaaagttctaccacaccttaatataaagaacaaaatagatgcttctcatttggggaaagtagctaaaaggacagtaacagtactgatggccttctgtccatcaccttagctccacagggaaaattctgggtgagagcaagcactgtttctaaaatctaaattttttcaggtgaaatttaccagcaacaaatgtaaaagggaactgccatcaggcatagggctagttttatacttcctgcctaacggcaaaatgactgagacatgacttccatggaacagcagaaaatggatgccaaagatatcataaaactgaagttcaatttgccacgtaaggctatttaaaaaccctgatgcactccaagcattcttccttcagagctttcctcctacaattatatcaagcacaagaaggcaccaacagcatatacttaatgtaatgtaaaagtaaacatatgacttgtgttgaattaccattggctggttgacataataagtgtcatagatatttagacattatttctgatcatacaaaattattttcataatttcatattcttttcaattttcataaattcttttcaattttcataaattggagccaatggtttgggaggttttttgtttgtttgtttgtttggttggttggttatttgttgcgttgttgttttccaaacctcagatattttgagaagccttagaaaggctcttaagcccaggcctttttgcctcatgtgcagagtattaataacagccctactgatgtgaacctcaaggaaggaggctattaaattaatccatcactggagatactaatacctcaaacaattaaaacactgaagactctgctggttgccttccacattgtttataacctttttaaattcagtcatttggatcaagagaaataaatggttggtttcatatggcttttgccacattagcacagacacatctaccaaatgtagaagtccagactgagtggatgcatgagagcaaacagatctgtaatatgattgcatttaatcaccgccaccgcccaaattctgtaaaaatatattcaaatatgtaatgctaaaaaaaatgcaaaacaggagactcttactagatcatgctttcacttagggtaggataactgatcttgaagataacttcatagaaaaatttgctggctgaaatgccccaggcacctcagggttggtcctgtcctattccacaaactgatcatggtcttctcccatcttctcagaggagttagccttgcctctaaaatagcaaaaatgccatgaaattatctttctaacctctatagagacttcttatccaagtataattccaaaaatatgatttgagtttgagcatgcctgtggtccttgattctatgatccctaaatcagttctacttttctcactctctctctctctctctctctctctctctctctctctctatatatatatatatatatatatatatatatatatatatatatatatatatatataatctccagtattttttttcaaccacaatttagtgcatttagcgtgttaatgttgggaactgcctgctggctctatgtctacttttgacaatgcttatgtccagataccatacagtgcatttgagagaggaccaaggttatgttttcccacataccagctgctgcagaggtttcgaagtgcctgacccagttctttttcacatcaaaaaggccttcggttgcagatggaaaccttaaagatgaatgtagagtggggtaggaaattcatgtttgaatgctgaaacccttgtcttttttagttttattcaattcccacctcagatcaccagaaagggaggcctctttggtgggtgttggccctcactgggggtaaaaggggttctatttgcttaaactcatgctcgtaggcaattttagggctctctggggctctgaatggtttctccaccaccacctttcttccaccaatagaaagatgttgtccttacaaggccatgtctgagaagaccatggtttaactagtaaaagaagctcacattgcagagagctgaataataccaggctcttgactttgtactgtgtgtcacagtcatgattgggacagaaggaaccagtctgctgaaaagtcaagccagcacaaatatttggaaactaattccactgaaactcttgtatcattaaatcatactattgtagtttcagttaatgtaattatttaatatcaggcactaaattaaatagctttgcacaaaattttagaaaagatcaatcttgtaacaaaatttaatattaacagtaaaaagcacctgagaaaagaaaatatcgatctgttgtggtttatatacttgagttattcttagaactttgtggagattgacactgctctgataaaaaggaagaaaatgttttgaattcaagaatgctagactaatagaaatagcccagtctctctgggccactgctcttcagtatggggtgctctctgtccctccttagcagatggggttgtttggaggctaaaatgagctaagggaagaagctatactgtgcctccaatatcccttatgtgtaattagagtgccgatctgggctgcaggctttattcaatgattcctttcccttacttgaggctttctctgtagagctgttatttctgagcctccattctgggatttacaaaggaaacagaatgatgaagaagtaacaatcagcattttacacacacgcacacacacacacacacacacactttttctaatatatgaggctagtctgcagagtccacagcccaggtgtccatttatttccacttcttcacctcccaaagatttagagctccatgatctaccaaggtgaagactgccaatcccaggttggagaagacccgtcagagtgtggaggtgccaaactgagaggcacaggaagcagacagccacatcaaacttttttgatgaactactgcaaattggtgtttgttctaggaaagaaagaggaagaaaaattacacaatgtgaattgaacataagagcagtgctctttacagagtatgagaagggaggatgggggagaatctgattaaaaaaatgattcattccttcacagacactaacaaacatggctaaaaagcacatgtcagaacacagaagcctaggtagatggttgacatttttataacttccttaagtgagtagttaaaccagcagtcttaattctgttggtcttccaagagtgtttaattacataagtattacctgtattcatttcccacaactgttgggtttttctttctttttttttttttttttttttttcctctgtgcatcctagaaaaactcccaggactagacttaggaggaggcaatcaagttatgtggtaaaacaagagtgccttttctgttggatatccactttagtttcctggcttccagggcataagatgtttagaaactttttttctctaaacataagaattattgtgtaccacaattttgaaccaccgatttccatatcttcagcagctatcaacttgccaattccctttgggtctcctttgtatattcttatgtttccttctgtttccagttgtcctcaaaaagagttgaggggggcatgactcttataaaatggataaaaatgaaactgtacagatgtttgcctcccttgtatctgtgagcatgatctctatcaggctggaaaatctgctttatcattttgtatatttgactattttgtattcagcattacttgactccttatgtgcatggcaatgtattaaaatgtgggatttctattaccgtgt

SEQ ID NO: 186820 - DNA, 520 bp, Homo sapiens
  Payload ID: 16784
  Gene Symbol: SAMD12
  Gene Name: sterile alpha motif domain containing 12
  ENST ID: ENST00000445741
  CDS Start-End: 78-284
gaggaaggggggagcgcggggcaggaggagtacctcggccaagaaaattatgcatgcgttagggaagctctgagagaatggctgtggaagctctccactgtggtttgaatccacggggtattgatcaccctgcccatgctgaaggtattaaactgcaaattgaaggtgaaggtgtggaatctcaatccattaaaaataaaaatttccagaaggtgcctgaccagaaaggaactcccaagcgactgcaggcagaagctgagacggctaagggcgagccctgctgagacttactgacaaaaagctcgagcgaatggggattgcccaggagaacctccggcagcacatcttacaacaggtgctccagctgaaggtgcgagaagaagtcagaaatctacagttactcacacaaggatattcaggaatatggagatatccctgactcttccaaaagaatgaccaagatcatgcctaattacctccatgtcctgggaaagccccgctgtaatggagatggcatctt

SEQ ID NO: 186821 - DNA, 1982 bp, Homo sapiens
  Payload ID: 16784
  Gene Symbol: SAMD12
  Gene Name: sterile alpha motif domain containing 12
  ENST ID: ENST00000453675
  CDS Start-End: 1-445
agctctccactgtggtttgaatccacggggtattgatcaccctgcccatgctgaaggtattaaactgcaaattgaaggtgaaggtgtggaatctcaatccattaaaaataaaaatttccagaaggtgcctgaccagaaaggaactcccaagcgactgcaggcagaagctgagacggctaagtcagctacggtgaagctatctaaaccggtggctctatggacccagcaggatgtctgcaagtggttgaagaaacattgtccgaatcagtatcagatctacaggcgagccctgctgagacttactgacaaaaagctcgagcgaatggggattgcccaggagaacctccggcagcacatcttacaacaggtgctccagctgaaggtgcgagaagaagtcagaaatctacagttactcacacaagcatcatctgagggttctccataaacacggttagccttccaagctgctgtcctgccagttgatatgaacatggcctgttcctcacagaaagactaacccatggcactgccagaagatatccttggatcgtggacagattaactggattaactgaaaaaagcacccattcagtcaatattatgggttttggaaaaatcttgctttgctgtggatttaaaatgaggtgcataatataatgccaactcattccaagtggtcattggcagaccattagctggaaaattgcttccagttttcatcactgtgcataactcaagttccctttggggagctgtctgtgcccttcactagaagtcctgttttagcatggcaactactggattattttattatgtgtgcagatggcatgatgttttagaaaaaaaaaattacagcaattctgcaatctcagtggaagtgttcacaatattatgccctggtaggaatgtaaacacgtctcgattatgttagttatgatgtctaaaggtatactgtccaactcttaagcactttatatgagaacactacaccaagatgaatcagcacattcagcacatgtgagaaatcaagtattttctttttatttttataaatcttagtggtttttttttttccggctcagactgtccaagacaaactccactactcgcatatccccagttgtttgtggtaggttgatgtaaatatggccacaatactgttagacttcacctccagatactttattgaacaactggtttacttctagcaccaaagggaagaagaagggggtccagtgatggtgatatcttagcttgcttctttgttcacaggcactattgaccacatgaacatacaggtactcaaatacaggaggcttctatttggctcctccaagggaggagttcctccaagggaaaaaaggggatggtattcttttaatcaaagaccatggtggatggatggtaagggcaacagaatgcaattcttttgtgtggtctgacgttaacacttcggaaaaaattctaagtcaagttgaaatcgccattctctcaagagagaaacatcaagagagaaacatcaagtgaccccactatgtgcctagagaaggaaaagggtcaagtcctatactaggttccttacttagggtagaacctactagtcccttgttaatcctttctgggattatacctgtgactaatttttttttttttaactatgtcttacgacaaagcacagtcctgggaaaccagtcaacttaattattgcttgtctttgagcattagagacatgttcatattgacttgctacataacactgtagcatgttttttcctgaaaatatcaagttggttgaatggaaagctcagcaaagtatgttctgtgtgcccactgtcccagcctgggactgacgggcatcagaggctttgctttaaaatatgggtaaccagttctggaagacttccaacgcaagcaagcttggtgttttagggtgtctccagatacataagcattgtctgcctccgctcagggtctcaggaaat

SEQ ID NO: 186822 - DNA, 592 bp, Homo sapiens
  Payload ID: 16784
  Gene Symbol: SAMD12
  Gene Name: sterile alpha motif domain containing 12
  ENST ID: ENST00000526328
  CDS Start-End: 130-592
gcggcaggttggtcctggagcagataagcgcagaatatttaggcgaaagcgagaggaaggggggagcgcggggcaggaggagtacctcggccaagaaaattatgcatgcgttagggaagctctgagagaatggctgtggaagctctccactgtggtttgaatccacggggtattgatcaccctgcccatgctgaaggtattaaactgcaaattgaaggtgaaggtgtggaatctcaatccattaaaaataaaaatttccagaaggtgcctgaccagaaaggaactcccaagcgactgcaggcagaagctgagacggctaagtcagctacggtgaagctatctaaaccggtggctctatggacccagcaggatgtctgcaagtggttgaagaaacattgtccgaatcagtatcagatctacagtgagtcattcaaacagcatgacataactgggcgagccctgctgagacttactgacaaaaagctcgagcgaatggggattgcccaggagaacctccggcagcacatcttacaacaggtgctccagctgaaggtgcgagaagaagtcagaaatctacagttactcacacaag

SEQ ID NO: 186823 - DNA, 507 bp, Homo sapiens
  Payload ID: 16784
  Gene Symbol: SAMD12
  Gene Name: sterile alpha motif domain containing 12
  ENST ID: ENST00000526765
  CDS Start-End: 1-507
acgccctgcgcgcgccgagccgggagccggctgcctcgctttgcgtgaccgcggcagctctccactgtggtttgaatccacggggtattgatcaccctgcccatgctgaaggtattaaactgcaaattgaaggtgaaggtgtggaatctcaatccattaaaaataaaaatttccagaaggtgcctgaccagaaaggaactcccaagcgactgcaggcagaagctgagacggctaagtcagctacggtgaagctatctaaaccggtggctctatggacccagcaggatgtctgcaagtggttgaagaaacattgtccgaatcagtatcagatctacagtgagtcattcaaacagcatgacataactgggcgagccctgctgagacttactgacaaaaagctcgagcgaatggggattgcccaggagaacctccggcagcacatcttacaacaggtgctccagctgaaggtgcgagaagaagtcagaaatctacagttactcacacaag

SEQ ID NO: 186824 - DNA, 625 bp, Homo sapiens
  Payload ID: 16784
  Gene Symbol: SAMD12
  Gene Name: sterile alpha motif domain containing 12
  ENST ID: ENST00000524796
  CDS Start-End: 1-462
ggtttgaatccacggggtattgatcaccctgcccatgctgaaggtattaaactgcaaattgaaggtgaaggtgtggaatctcaatccattaaaaataaaaatttccagaaggtgcctgaccagaaaggaactcccaagcgactgcaggcagaagctgagacggctaagtcagctacggtgaagctatctaaaccggtggctctatggacccagcaggatgtctgcaagtggttgaagaaacattgtccgaatcagtatcagatctacagtgagtcattcaaacagcatgacataactgggcgagccctgctgagacttactgacaaaaagctcgagcgaatggggattgcccaggagaacctccggcagcacatcttacaacaggtgctccagctgaaggtgcgagaagaagtcagaaatctacagttactcacacaagcatcatctgagggttctccataaacacggttagccttccaagctgctgtcctgccagttgatatgaacatggcctgttcctcacagaaagactaacccatggcactgccagaagatatccttggatcgtggacagattaactggattaactgaaaaaagcacccattcagtcaatattatgggttt

SEQ ID NO: 186825 - DNA, 1403 bp, Homo sapiens
  Payload ID: 16785
  Gene Symbol: SAMD13
  Gene Name: sterile alpha motif domain containing 13
  Uniprot ID: Q5VXD3
  ENST ID: ENST00000370668
  CDS Start-End: 73-381
ctcacagacgggtttttgaggctttcgttgagaatgtgagttgctgaagtaaaggaaccctgcagccttcccatgctatctgttgacatggaaaacaaggaaaatggctctgtcggtgtaaaaaattccatggaaaatgggagaccacctgatcctgcagactgggccgtgatggatgtcgtcaattatttccgaaccgtgggatttgaggagcaagctagtgcttttcaggaacaggaaattgatggaaaatccctgctattgatgacaagaaatgatgtgttgacaggacttcagttaaaattggggcctgctctgaaaatctacgaatatcatgtaaaacctctgcagacaaagcatttaaagaacaactcttcatagtacagtcaaattggggtcttcgacctcaaaaaatacataatgacataatttagtttcatgtaatgaaactttgtaaacagaatacatacatgtgtatatgtaaagaatttcaatcaaatgaaacgttatcctattggatagactaggcaattcatcagctcacctgaaatcagccaggaggagcaaggacaagatgcgcacagggtggttttcctcatggattttgtcaaatagatgatctttgacacgattagacactcctccccacaaaggctttgaaatcataaggattttcctcatctctttatagctttcccaaaatcttttaaaaaagaatttaattaaatgacagtcttttggttacagacttaggatgagtaaaaacaagaaaatttggggagggggagaaagaagaaagggattgctgtctcccttgaattcctctgttccttagagcttgtgttacttggacggaattgccaacacccttttttatagagggttctccacttgaccttattaaggttttattgggatatgctgcagtgtttgaaatgaacatgcatcatggccccttcaggagcagaatcatagctctgaaaagagaagctccgttgtgtactgaggatatccatccatattcagctagctttcaaatggggtaacgatattttctgcatagattttcttttaaattggttctttgtttctgaagaaagaattttttttaacttcatggttttatttataataatttgtttctgaagaaatttgccgagagttacaggtcaaaaagccttgttactagtacagaatatttttatatatattccttcatgatggtgtaattttttttaattgtcctatgctttgttcggttcctgggttaagtacttgtttttaagagcttggaaaaagtgggcttgctacatctctgttcaaagagacatttgttcaatctctgtgtgtcaacgccttgttgaattggtgctttgtggttgcaataaagcattgcttcagtt

SEQ ID NO: 186826 - DNA, 856 bp, Homo sapiens
  Payload ID: 16785
  Gene Symbol: SAMD13
  Gene Name: sterile alpha motif domain containing 13
  Uniprot ID: Q5VXD3
  ENST ID: ENST00000370669
  CDS Start-End: 328-636
tactttgtgaaagaaaacattggggtttctttggctgttcttgataagcctataaaaaatgatattttttagttgcttataggtaggttttctttttactcttccacagaaaagaaaataatagtaataataataagacaatgtagtgtggtgttgcagagtatcattgtgagtgttttgttttgttttctgagatgcttagaaaatggtgaatgtgtaacagtttccaactgaagtgaaatcatattctgttagcatggagcagcagcactatcttcctgtctactctctaacgttgctgaagtaaaggaaccctgcagccttcccatgctatctgttgacatggaaaacaaggaaaatggctctgtcggtgtaaaaaattccatggaaaatgggagaccacctgatcctgcagactgggccgtgatggatgtcgtcaattatttccgaaccgtgggatttgaggagcaagctagtgcttttcaggaacaggaaattgatggaaaatccctgctattgatgacaagaaatgatgtgttgacaggacttcagttaaaattggggcctgctctgaaaatctacgaatatcatgtaaaacctctgcagacaaagcatttaaagaacaactcttcatagtacagtcaaattggggtcttcgacctcaaaaaatacataatgacataatttagtttcatgtaatgaaactttgtaaacagaatacatacatgtgtatatgtaaagaatttcaatcaaatgaaacgttatcctattggatagactaggcaattcatcagctcacctgaaatcagccaggaggagcaaggacaagatgcgcacagggtggttttcctcatgg

SEQ ID NO: 186827 - DNA, 565 bp, Homo sapiens
  Payload ID: 16785
  Gene Symbol: SAMD13
  Gene Name: sterile alpha motif domain containing 13
  Uniprot ID: Q5VXD3
  ENST ID: ENST00000370670
  CDS Start-End: 101-409
ctttaggtttaatcacatctctccaatcgccgagggaactggagatttaaacaaacatacgtgaactgttgctgaagtaaaggaaccctgcagccttcccatgctatctgttgacatggaaaacaaggaaaatggctctgtcggtgtaaaaaattccatggaaaatgggagaccacctgatcctgcagactgggccgtgatggatgtcgtcaattatttccgaaccgtgggatttgaggagcaagctagtgcttttcaggaacaggaaattgatggaaaatccctgctattgatgacaagaaatgatgtgttgacaggacttcagttaaaattggggcctgctctgaaaatctacgaatatcatgtaaaacctctgcagacaaagcatttaaagaacaactcttcatagtacagtcaaattggggtcttcgacctcaaaaaatacataatgacataatttagtttcatgtaatgaaactttgtaaacagaatacatacatgtgtatatgtaaagaatttcaatcaaatgaaacgttatcctattggatagactaggcaattcatc

SEQ ID NO: 186828 - DNA, 724 bp, Homo sapiens
  Payload ID: 16785
  Gene Symbol: SAMD13
  Gene Name: sterile alpha motif domain containing 13
  Uniprot ID: Q5VXD3
  ENST ID: ENST00000370671
  CDS Start-End: 60-428
cacactcacatactttatgctacatactacacacacaactttttatcagcagaggattgatggcaaacagtttgttggagggagtgtttgctgaagtaaaggaaccctgcagccttcccatgctatctgttgacatggaaaacaaggaaaatggctctgtcggtgtaaaaaattccatggaaaatgggagaccacctgatcctgcagactgggccgtgatggatgtcgtcaattatttccgaaccgtgggatttgaggagcaagctagtgcttttcaggaacaggaaattgatggaaaatccctgctattgatgacaagaaatgatgtgttgacaggacttcagttaaaattggggcctgctctgaaaatctacgaatatcatgtaaaacctctgcagacaaagcatttaaagaacaactcttcatagtacagtcaaattggggtcttcgacctcaaaaaatacataatgacataatttagtttcatgtaatgaaactttgtaaacagaatacatacatgtgtatatgtaaagaatttcaatcaaatgaaacgttatcctattggatagactaggcaattcatcagctcacctgaaatcagccaggaggagcaaggacaagatgcgcacagggtggttttcctcatggattttgtcaaatagatgatctttgacacgattagacactcctccccacaaaggctttgaaatcataaggattttcc

SEQ ID NO: 186829 - DNA, 1567 bp, Homo sapiens
  Payload ID: 16785
  Gene Symbol: SAMD13
  Gene Name: sterile alpha motif domain containing 13
  Uniprot ID: Q5VXD3
  ENST ID: ENST00000370673
  CDS Start-End: 193-543
ccttgtcctgcccagatcttgtcccttctagtactggccttccccattcctgggggcccccgcccctccgacccccgccgaccggcgctggactacaactcccggcgtgccgcgcgcgtccggccggctgcaccggggctttgcgcgtggcggccgccgagctccgcgcggggcaaacctcccggcgcggccatgcggggagttgctgaagtaaaggaaccctgcagccttcccatgctatctgttgacatggaaaacaaggaaaatggctctgtcggtgtaaaaaattccatggaaaatgggagaccacctgatcctgcagactgggccgtgatggatgtcgtcaattatttccgaaccgtgggatttgaggagcaagctagtgcttttcaggaacaggaaattgatggaaaatccctgctattgatgacaagaaatgatgtgttgacaggacttcagttaaaattggggcctgctctgaaaatctacgaatatcatgtaaaacctctgcagacaaagcatttaaagaacaactcttcatagtacagtcaaattggggtcttcgacctcaaaaaatacataatgacataatttagtttcatgtaatgaaactttgtaaacagaatacatacatgtgtatatgtaaagaatttcaatcaaatgaaacgttatcctattggatagactaggcaattcatcagctcacctgaaatcagccaggaggagcaaggacaagatgcgcacagggtggttttcctcatggattttgtcaaatagatgatctttgacacgattagacactcctccccacaaaggctttgaaatcataaggattttcctcatctctttatagctttcccaaaatcttttaaaaaagaatttaattaaatgacagtcttttggttacagacttaggatgagtaaaaacaagaaaatttggggagggggagaaagaagaaagggattgctgtctcccttgaattcctctgttccttagagcttgtgttacttggacggaattgccaacacccttttttatagagggttctccacttgaccttattaaggttttattgggatatgctgcagtgtttgaaatgaacatgcatcatggccccttcaggagcagaatcatagctctgaaaagagaagctccgttgtgtactgaggatatccatccatattcagctagctttcaaatggggtaacgatattttctgcatagattttcttttaaattggttctttgtttctgaagaaagaattttttttaacttcatggttttatttataataatttgtttctgaagaaatttgccgagagttacaggtcaaaaagccttgttactagtacagaatatttttatatatattccttcatgatggtgtaattttttttaattgtcctatgctttgttcggttcctgggttaagtacttgtttttaagagcttggaaaaagtgggcttgctacatctctgttcaaagagacatttgttcaatctctgtgtgtcaacgccttgttgaattggtgctttgtggttgcaataaagcattgcttcagttta

SEQ ID NO: 186830 - DNA, 785 bp, Homo sapiens
  Payload ID: 16785
  Gene Symbol: SAMD13
  Gene Name: sterile alpha motif domain containing 13
  Uniprot ID: Q5VXD3
  ENST ID: ENST00000394834
  CDS Start-End: 229-537
gaaggcagttggtgcagcttgtgtgtgattcctaacgtcatgttggctgagagccagcctggttttatttcactgtgtcaaattgtacctccttattgaattcctttgccagcctactttgtgaaagaaaacattggggtttctttggctgttcttgataagcctataaaaaatgatattttttagttgcttatagttgctgaagtaaaggaaccctgcagccttcccatgctatctgttgacatggaaaacaaggaaaatggctctgtcggtgtaaaaaattccatggaaaatgggagaccacctgatcctgcagactgggccgtgatggatgtcgtcaattatttccgaaccgtgggatttgaggagcaagctagtgcttttcaggaacaggaaattgatggaaaatccctgctattgatgacaagaaatgatgtgttgacaggacttcagttaaaattggggcctgctctgaaaatctacgaatatcatgtaaaacctctgcagacaaagcatttaaagaacaactcttcatagtacagtcaaattggggtcttcgacctcaaaaaatacataatgacataatttagtttcatgtaatgaaactttgtaaacagaatacatacatgtgtatatgtaaagaatttcaatcaaatgaaacgttatcctattggatagactaggcaattcatcagctcacctgaaatcagccaggaggagcaaggacaagatgcgcacagggtggttttcctcatggattttgtcaaatagatgatctttgacac

SEQ ID NO: 186831 - DNA, 362 bp, Homo sapiens
  Payload ID: 16785
  Gene Symbol: SAMD13
  Gene Name: sterile alpha motif domain containing 13
  ENST ID: ENST00000454967
  CDS Start-End: 1-153
gtgatggatgtcgtcaattatttccgaaccgtgggatttgaggagcaagctagtgcttttcaggaacaggataaagttactgacagagataaatacctagaatgcacaccaatcgagagctggagtggtcaaatcaaagggctgctgctatgataaggcctacttctgcctgcctaccctcagaaacaggatctcactatgttgcccaggctggagcatagtggttattcacaggcgtgatcccactactgatcagtacaggagtttcatctctttttgataaagaagactgaggatcccacacaggtgcacactgttttgtgctatagatgtacaactaataaaacaaatccttgtcaata

SEQ ID NO: 186832 - DNA, 2874 bp, Homo sapiens
  Payload ID: 16786
  Gene Symbol: SAMD14
  Gene Name: sterile alpha motif domain containing 14
  ENST ID: ENST00000285206
  CDS Start-End: 1-1290
agccggtttcccagcgggattccggtggaggagtcaggaggagtcctgagcaaaggaacttggaggaatgagggagaggacctggacttggctgtgccagagacggccagactggacagcagtttacacaaggcccgggcccaactgttggccaagggccggagacaccggccatcccgctccaggcttcgggacagtgccagctccgcggaggatggtgaaggctcggatgggcccggaggcaaggtgaccgatggctgcgggagccccctgcaccggctgcgctcgcctttgcactcaggcccggggtccccggccgggggctctttctgcctggatcctccggggttgcggcgcagcctggacgaggacgagccgccgccctcgccgctcacacgctaccggcccctgcacaacgctgcgtcgcacgagggcctggccgccgcctcctgctctccgccgcgctccgcgccctcctccgacagctcccccagcttcgtgcgccgccacccgcgcgcagagccgcacagcgaagatgacagccgtgacgccagtcctcctgagcccgccagccccaccatcggcctcgataagaagactcgccgaaagttcctggacctgggggtcaccctgcgccgagcatccacgggcaagagccggaaggagaaaggcagcaaccgactgtccatgggcagcagggagtcagtggaggggtccggcaggtcagggggctccccgttcctgcctttttcctggttcacggacagcggcaagggctcagcatcctcgggtagcaccacctcccccacctgctcccctaaacacgagggcttcagccctaagaagtcagcttcccaggaatccactctgagtgatgactccacgccccccagcagcagccccaagatccccagtgggccctggcaggaggccaaatgttcttacccctaccacacgctgtctcagtcttcagatgagttcctggatgaacccctcccccctgtccaccactggaccagccagcaggtgggccagtggctgcagagcctcaacctggaacagtatgctgctgagtttgctgcacggcaggtagacgggccgcagctgctgcagctggacggaagcaaactaaagagcctggggctcagcaactctcatgaccgggcactggtgaagcgcaagttgaaggagatggcagcagctgccgagaaggagcgcaaggcccaggagaaggctgcgcggcagcgggagaagctccggcgccgagagcaggaggccaagaagagctaggggagggtgcacaggcgctggcacccggcaggggcagccactggctccgcgggcacaggcctcaccagggaggctggacctgggcgctgcacttgggctagcctggtcccacgctctcaggggggacatgctctctcttaccctgtcacttggtctagacccagagaccccagaaagggagaccccagggagagggcctagtaataaatcctattttgaggacttgtttggcacagagttcctgggggaggagcagatgaaggggagagggcagagaggccagggctgaggcaagtctgggaggctgggtcaggctgtcccattgccctcaggccatcgtggggctggggtggaggggagctaggaggcctgcctgcctgcttgcctgccagaggccctgaggccgggccccagggctcagagctgggctgggcatttcagcaggagcccatgtgggagcggctcctctccactcttccagggggctgtgtggtgggagagctctgtcctgctcccccaagaggccagtgggcgctgcagcaagtcgcactcagggtagactcccagccaaactcctcaacaggagcgcagagaaagcagcctggggcgagtgcagtctttgccaggactcaagaggggaggatgaacatccccttctccctctcccctcctctgtcctgtgggtcccagggggcgagatgacaccacacaggtctgcctctcagggcccattcaagacctggtctttgacccattctccaagccaggactcccttcacttcctgctgcttcctcagagggcacctaagtcctctttgggagctgagcaaacaggaactgatagggacagaggacaccacttccaccagccaaggcctaggagctgctgacctggtcagccctcaccccagccaggcagagaggcaaaacctgggggtccccggcagctacgagattggaaaggttcatcagccctcccccatctgccccaggcattgtcagggaatcagtgggctcagaactggcaggcggtgcaagctctgcttccctgggccacactgagggctggggccagctccctggatgggggtggagtttaccagcagcctggggacagcatgtgtcctttttaggaaatgtccttggaggaagtgttcatgtgtggcgctggtcagcagctagtcccgcttccaggacactggtcagagttaccgatgaggcctgggggctcccgcttggaaacccctccagctcctcccatctgcccagacagagcggcagatggcaccaatgcatgctggctccctcattcctgcccaggggctgtggcttacggccagcaccctgtacctgggactcagcccttatcccccctctgctatctgtgctgggagaggggcttcggagggaaacagatatgaggacactggcaccatctgggcctggtggcagggccatgggaggttggaaggcacccacatccttaaagccatcagtagctatagtgggtgcccacctgcatgtgaaggggaggcagttctcaatttatttcaataaatccttatgatgtgccagtgaccagaa

SEQ ID NO: 186833 - DNA, 4425 bp, Homo sapiens
  Payload ID: 16786
  Gene Symbol: SAMD14
  Gene Name: sterile alpha motif domain containing 14
  Uniprot ID: Q8IZD0
  ENST ID: ENST00000330175
  CDS Start-End: 319-1572
cgcacacgcacacacacacggagcatcctcccgtcaggtctcctggtccagccccgcccgcgcctcctgcttccagcgaacctgttccctctccccacatcccccgccctccatctcccccggctctgggacccttcccgccgacctcacccccacccccgggatggagcggctcgagcccgcccggagccccccgcggccggggtgacggtccccccacccctctcctgcccggcccccgcctcgagcaccatgggcctgaggggttcccggggcgccagacgctgaagatgaccgatgccggagctctcttgagtcatggcttcttcaaagctccgagaacccgtggatgaagtttttgacctggacttggctgtgccagagacggccagactggacagcagtttacacaaggcccgggcccaactgttggccaagggccggagacaccggccatcccgctccaggcttcgggacagtgccagctccgcggaggatggtgaaggctcggatgggcccggaggcaaggtgaccgatggctgcgggagccccctgcaccggctgcgctcgcctttgcactcaggcccggggtccccggccgggggctctttctgcctggatcctccggggttgcggcgcagcctggacgaggacgagccgccgccctcgccgctcacacgctaccggcccctgcacaacgctgcgtcgcacgagggcctggccgccgcctcctgctctccgccgcgctccgcgccctcctccgacagctcccccagcttcgtgcgccgccacccgcgcgcagagccgcacagcgaagatgacagccgtgacgccagtcctcctgagcccgccagccccaccatcggcctcgataagaagactcgccgaaagttcctggacctgggggtcaccctgcgccgagcatccacgggcaagagccggaaggagaaaggcagcaaccgactgtccatgggcagcagggagtcagtggaggggtccggcaggtcagggggctccccgttcctgcctttttcctggttcacggacagcggcaagggctcagcatcctcgggtagcaccacctcccccacctgctcccctaaacacgagggcttcagccctaagaagtcagcttcccaggaatccactctgagtgatgactccacgccccccagcagcagccccaagatccccagtgggccctggcaggaggccaaatgttcttacccctaccacacgctgtctcagtcttcagatgagttcctggatgaacccctcccccctgtccaccactggaccagccagcaggtgggccagtggctgcagagcctcaacctggaacagtatgctgctgagtttgctgcacggcaggtagacgggccgcagctgctgcagctggacggaagcaaactaaagagcctggggctcagcaactctcatgaccgggcactggtgaagcgcaagttgaaggagatggcagcagctgccgagaaggagcgcaaggcccaggagaaggctgcgcggcagcgggagaagctccggcgccgagagcaggaggccaagaagagctaggggagggtgcacaggcgctggcacccggcaggggcagccactggctccgcgggcacaggcctcaccagggaggctggacctgggcgctgcacttgggctagcctggtcccacgctctcaggggggacatgctctctcttaccctgtcacttggtctagacccagagaccccagaaagggagaccccagggagagggcctagtaataaatcctattttgaggacttgtttggcacagagttcctgggggaggagcagatgaaggggagagggcagagaggccagggctgaggcaagtctgggaggctgggtcaggctgtcccattgccctcaggccatcgtggggctggggtggaggggagctaggaggcctgcctgcctgcttgcctgccagaggccctgaggccgggccccagggctcagagctgggctgggcatttcagcaggagcccatgtgggagcggctcctctccactcttccagggggctgtgtggtgggagagctctgtcctgctcccccaagaggccagtgggcgctgcagcaagtcgcactcagggtagactcccagccaaactcctcaacaggagcgcagagaaagcagcctggggcgagtgcagtctttgccaggactcaagaggggaggatgaacatccccttctccctctcccctcctctgtcctgtgggtcccagggggcgagatgacaccacacaggtctgcctctcagggcccattcaagacctggtctttgacccattctccaagccaggactcccttcacttcctgctgcttcctcagagggcacctaagtcctctttgggagctgagcaaacaggaactgatagggacagaggacaccacttccaccagccaaggcctaggagctgctgacctggtcagccctcaccccagccaggcagagaggcaaaacctgggggtccccggcagctacgagattggaaaggttcatcagccctcccccatctgccccaggcattgtcagggaatcagtgggctcagaactggcaggcggtgcaagctctgcttccctgggccacactgagggctggggccagctccctggatgggggtggagtttaccagcagcctggggacagcatgtgtcctttttaggaaatgtccttggaggaagtgttcatgtgtggcgctggtcagcagctagtcccgcttccaggacactggtcagagttaccgatgaggcctgggggctcccgcttggaaacccctccagctcctcccatctgcccagacagagcggcagatggcaccaatgcatgctggctccctcattcctgcccaggggctgtggcttacggccagcaccctgtacctgggactcagcccttatcccccctctgctatctgtgctgggagaggggcttcggagggaaacagatatgaggacactggcaccatctgggcctggtggcagggccatgggaggttggaaggcacccacatccttaaagccatcagtagctatagtgggtgcccacctgcatgtgaaggggaggcagttctcaatttatttcaataaatccttatgatgtgccagtgaccagaatttctgtctgctccagttgttgggttggccggactctgctgggccctgagtatggtgggacaacaggtctgtcaccaggtgctgggccatccggcgttctgaacagatggctttgcccagtgttttactcacagtcctgagctgggccggacgtccccggtgcgtcatgtggtggtcacagggcaccgcagtgtgcgtgtgtacgtgcgcacgtgtgggtcccctcccccagggatgcagccaggccagtctcattcagtctcctctttactgtgggtgtgggtgtcactgtcactgccacagccactgggagggacacacagctttaacccctgtgtgcttaggggaagggtgggggcattcagggttataaaactaactatatacacagaaggtcctagggagaaagccaccctgagcacacatgtctgggcacagtgggggctgggggctggagctcaggcaggatggactaggcttgtggaggagcgggtgggcatgagcatgtgaggacatgctgggagggctcaggaggtggcacagacattgccaaggccactgcagggcctcgagcagcttggctggatggcaagctctcggtctaacaaggttcttccactttagagttgggccctgtgagagccaccccctccgccaccgaccttcaagccctgagcggagggagaggctgcaggaccagcctcattccccactcacgggtgtaactcctttccccactcagtccccaggtctggagggcacccaccctcttcctaacacttcagcaggccaaggccagggtgcctttgtgggctgggggaataaggcaacgggacatccacttggaaggcctgtgctgtggagggtgctgagggggacccagtacccctggcagaaaagtgacagccctggtctcagagaggaggactgccatgggaaaatgtctctgggacaccccatcagggtggagacatccctaaccctcaggcatcgcccacagagatagggaggccaccgaggggtctccacagagatggactggcacttagggaccatcacagacctatcaccgcagtgacttccatagagacagaacctggtcatcagggagaacccaccccctgctcccccaggaggatggtgaggggcaccacggtggggggacccagaggcggcagtccgtcctctcaggtgcagatgcacggcggcccttagctgacgcggtacgtggacgtgttcttgggctccgtgctgggcacacaccagtcg

SEQ ID NO: 186834 - DNA, 560 bp, Homo sapiens
  Payload ID: 16786
  Gene Symbol: SAMD14
  Gene Name: sterile alpha motif domain containing 14
  ENST ID: ENST00000511964
  CDS Start-End: 521-560
gcttccagcgaacctgttccctctccccacatcccccgccctccatctcccccggctctgggacccttcccgccgacctcacccccacccccgggatggagcggctcgagcccgcccggagccccccgcggccggggtgacggtccccccacccctctcctgcccggcccccgcctcgagcaccatgggcctgaggggttcccggggcgccagacgctgaagatgaccgatgccggagatttgattggacagttgatgattgaaagcttttaggggatgctaatgatgcgaaggcccaagacagtgaaggggagaagttcagtgacccacgtgaaggcacacagcaaatcagtggaccaggataccaggaccacagggctcagcctgtgtctgtgccttggttttgcgtctgcccccaccctcctactatactgcctgccccggcgcccaccatctgggttatgattccagtggcttctcttccaggggacagaagaagggttctaagctctcttgagtcatggcttcttcaaagctccgagaacccgtggatgaagttt

SEQ ID NO: 186835 - DNA, 1938 bp, Homo sapiens
  Payload ID: 16786
  Gene Symbol: SAMD14
  Gene Name: sterile alpha motif domain containing 14
  Uniprot ID: Q8IZD0
  ENST ID: ENST00000503131
  CDS Start-End: 379-1716
ggcgctcgctcttcgctcttctctctctctctctctctgtcacacacacacacacgcacacgcacacgcacacacacacggagcatcctcccgtcaggtctcctggtccagccccgcccgcgcctcctgcttccagcgaacctgttccctctccccacatcccccgccctccatctcccccggctctgggacccttcccgccgacctcacccccacccccgggatggagcggctcgagcccgcccggagccccccgcggccggggtgacggtccccccacccctctcctgcccggcccccgcctcgagcaccatgggcctgaggggttcccggggcgccagacgctgaagatgaccgatgccggagctctcttgagtcatggcttcttcaaagctccgagaacccgtggatgaagtttttgacctggacttggctgtgccagagacggccagactggacagcagtttacacaaggcccgggcccaactgttggccaagggccggagacaccggccatcccgctccaggcttcgggacagtgccagctccgcggaggatggtgaaggctcggatgggcccggaggcaaggtgaccgatggctgcgggagccccctgcaccggctgcgctcgcctttgcactcaggcccggggtccccggccgggggctctttctgcctggatcctccggggttgcggcgcagcctggacgaggacgagccgccgccctcgccgctcacacgctaccggcccctgcacaacgctgcgtcgcacgagggcctggccgccgcctcctgctctccgccgcgctccgcgccctcctccgacagctcccccagcttcgtgcgccgccacccgcgcgcagagccgcacagcgaagatgacagccgtgacgccagtcctcctgagcccgccagccccaccatcggcctcgataagaagactcgccgaaagttcctggacctgggggtcaccctgcgccgagcatccacgggcaagagccggaaggagaaaggcagcaaccgactgtccatgggcagcagggagtcagtggaggggtccggcaggtcagggggctccccgttcctgcctttttcctggttcacggacagcggcaagggctcagcatcctcgggtagcaccacctcccccacctgctcccctaaacacgagggcttcagccctaagaagtcagcttcccaggcccagctcctggctcatgcacaggaggcactgagcaactcctggtgcctagtccaggacttcggctccacccagatagggatggaatccactctgagtgatgactccacgccccccagcagcagccccaagatccccagtgggccctggcaggaggccaaatgttcttacccctaccacacgctgtctcagtcttcagatgagttcctggatgaacccctcccccctgtccaccactggaccagccagcaggtgggccagtggctgcagagcctcaacctggaacagtatgctgctgagtttgctgcacggcaggtagacgggccgcagctgctgcagctggacggaagcaaactaaagagcctggggctcagcaactctcatgaccgggcactggtgaagcgcaagttgaaggagatggcagcagctgccgagaaggagcgcaaggcccaggagaaggctgcgcggcagcgggagaagctccggcgccgagagcaggaggccaagaagagctaggggagggtgcacaggcgctggcacccggcaggggcagccactggctccgcgggcacaggcctcaccagggaggctggacctgggcgctgcacttgggctagcctggtcccacgctctcaggggggacatgctctctcttaccctgtcacttggtctagacccagagaccccagaaagggagaccccagggagagggcctagtaataaatcctattttgagga

SEQ ID NO: 186836 - DNA, 2564 bp, Homo sapiens
  Payload ID: 16787
  Gene Symbol: SAMD15
  Gene Name: sterile alpha motif domain containing 15
  Uniprot ID: Q9P1V8
  ENST ID: ENST00000216471
  CDS Start-End: 287-2311
acagccgagcgcagcctgcaggccggaagaagcggcgcggcggccgcttgaaaagctagctgacccaggggcggccacaggagctctggcccgctgaggctggcgatgaggccgcagggagggttactgcgtgcttgtgacagacgatttttaaagtcagggcttgaaagaacaaacaaaacctggggaagagtcaggaagacactgccggaaatcgtggtatccatagagacgctatcggaagttggggttgctaggaagccgcggcgcgtctgctaagctgcaaatggctgaagtcccggaggattatgattccggcccagatgaagatggagagctggagcctgagaggcctgaactgcctggacttcataaattgtatgaaaatgccgaaccagacaccatggcaaaggcagactcgaagctaccagcagagatttaccaagagccacagccagagaccgaggaagaggacttcaaagagggggagccagacagtgctaagaacgtgcagctgaaacctggcgggacgtcccaggaaggaattgccaaggagtccaagagagacgtaccaagcgaaactgaaccagggatacaccaagaggtaaagtcggaaacatccagagagatgggagagtttttcaaagatttggaggcccctatggatgaaacgcataaagagtcagacctagagccaccagaggaggctaaaccaaatgttacagaggatgtgttcctagagtcagctatggaaacagatccagatccagtgccaccaacggaaaccatgtctgaggtttcgggggccacagtcagagagagaaatttagaattactagaggaggagactgaaccgggggttccagaggaatcacttagagtgcaacatgaagagacaggtctagagcctccagagcagaccaaacaagattttccaagtgagaaactaggagaatcacttgaagagacagatcttcagccaccaaagatgaccaaaccagagactccagaggagacacaaagagagtcaactgagaagaaaaggacagagccacccgagcaggctagactggaatttctggagaaggaaccaagaaagtctagtgaggaggcaggtctagagcctccagaagagactcaaccagaggttccagaggagatgcaaagaaaggcaactgaggagaaagggacagaactacctgagcggactaaaccagactttccagaccacaagccaagaaagtctactgatgagaacgttcctgagccactagaagagatcaaattagagtttcctgaggaagaatcaagaaaaacaaatgaggaaacaattctagaacaatcagaaatgatgaaaccagaaagtccagaagagataagaaagtcaaatgagaaaaaaaatccacagccaccagaggagactggtccagtgctaccacaggagatcaacccacaagttgaagagaaaacacaaacaaagccaactgagaaaattctagagttaccagatgaaaccaaaccaagggagacacatgtagaattttccaaggaagacaggccagaaccaataaagtctaagtattctgtaggaaacgatgagctagagcaccgtgagcctaaaagaggaaagttgtcactaagtgacaaatttagaaaagaatattacgcattaggatctctcagagaaagtgaagaatcaattggtacacattatgagtttttgcaaccactccaaaaattgcttaatgtcagtgaagaatgctcatactcagatccctcagagtctcagacagaattaagtgagttcgttcatgaaaaggaagttgtagatttgtcccaagagttgaaggaacgggtctctgaagatgacgaaacccagccagaaaaagggactgagttacaatttgagcatcttaattgggatccagaggaagttgcagagtggattagccagctaggcttccctcaatacaaggagtgttttatcacaaacttcatcagtggccgaaaactcattcacgtcaactgctcaaacctccctcagatggggataacaaactttgaggacatgaaggcaatttctcggcatacgcaggagctcctggaaattgaagagccattattcaaacgctccatcagccttccctatagggatattatcggcttatatttagagcaaaaaggtcatactgggataaaatctgattccttgactttatctgaatttgtcaaagcagcaggattacaggattatgctccagaaataactgcccctgaagagaatgaggaattaccttgcactgaaccataggggaaatccacttcacagagcttgaaagatcaaactaaattacttgagggaagaggtatggtcttttttggttttctttttctccttttttttttttttatttttttgagacagagtcttgctctgtcgcccaggctggagtgcaatggcacagtctcagctcactgcaaccttgcgattctcctgtctcagcctcccgagtagctgggattacaggcatccgccatcatgcccagctaatttttgtattttt

SEQ ID NO: 186837 - DNA, 412 bp, Homo sapiens
  Payload ID: 16787
  Gene Symbol: SAMD15
  Gene Name: sterile alpha motif domain containing 15
  ENST ID: ENST00000533095
  CDS Start-End: 122-388
ggcagatctcagaaaggaagcggggcaggaatcaaggcatttcgaaacaggagagtgttttatcacaaacttcatcagtggccgaaaactcattcacgtcaactgctcaaacctccctcagatggggataacaaactttgaggacatgaaggcaatttctcggcatacgcaggagctcctggaaattgaagagccattattcaaacgctccatcagccttccctatagggatattatcggcttatatttagagcaaaaaggtcatactgggataaaatctgattccttgactttatctgaatttgtcaaagcagcaggattacaggattatgctccagaaataactgcccctgaagagaatgaggaattaccttgcactgaaccataggggaaatccacttcacagagcttg

SEQ ID NO: 186838 - DNA, 993 bp, Homo sapiens
  Payload ID: 16788
  Gene Symbol: SAMD3
  Gene Name: sterile alpha motif domain containing 3
  Uniprot ID: Q8N6K7
  ENST ID: ENST00000324172
  CDS Start-End: 18-683
atttacaggagacagcaatggaaacctggtcagttgagcaggtctgcagttggttggtggagaaaaatttaggagagctagttcatagatttcaagaggaagaagtaagtggggccgctcttcttgcacttaatgatcggatggttcagcaactggtaaagaaaattgggcaccaggctgttctgatggatttaattaaaaaatacaagcagaacactcaaggactgaagtccccagaaaaccccaaaaaggcagccctggtcatgcaaacagaagcagctcgagattacagggatgaagagtcctccagtccagccaggcatggggagcagatgccatctttctatccagctgaaaaccttgataatggactaattgaccaaagagtattgaaacagagaagaaatgtgaaacaaattctagcaagaagcaaagcattacagtggacgaagtcctatgttttaccagagtttccctatgatgtcaaatgcatgttagcagagcagaagtgcccggatcacagcatgaggataaggatcattgagtttctccaggccgacatgactaagtatctggaaggctcactgtaccccagcacccagcagtacaatgacgtggttaatgccctgctgcaggcccaccctttcctggatgaggatggctgtggcttcgctggagtatagtggcgcgatctcagctcactgcaacctccgcctcctgggttcaagcaattctctggggcagcagttctaagctctggttgcacattaggattcctagagattcagattgaattaatttgaggatgggattattctaatgtacaaccacggctgagaaccactgccgctgacgtttcaacacaaagtttgctgtttgaacctgcctgtctcctggatttcaaagaccactgtcttcattgcacaacaatgtgaatataatcaacactattgaactgtacctaagaatagttaataaaaaactgagtgttta

SEQ ID NO: 186839 - DNA, 2377 bp, Homo sapiens
  Payload ID: 16788
  Gene Symbol: SAMD3
  Gene Name: sterile alpha motif domain containing 3
  Uniprot ID: Q8N6K7
  ENST ID: ENST00000368134
  CDS Start-End: 610-2172
aaaagacgcggccaaggcccgctccgtccacgcttcccgccggcccggcaaggggttccggagaacggcttgggggggcgagaaccatgggcgggggaaatggaagacagagggaactgaagcacgggggtcttcgatgagcagtgcggatgttcgactccaaacatcaaagccaacgagaggttcaggttactcctccttgaccccaaacatccagtgagtggagactggcctgttcacagagtaaaatatgtcgtctctaattcggcaaagacggtgatgactgtatatatgcaggccaattccgctctccaagagattctaactcagtcacagtttgaaccactactgaaccactgctgttaggaagctacaacccaaaagaaaagccccacagatgctgagagctggtgatcctcaggataaaacaaaggaaccagaaccacatccactgatcggatttgcctggggaggaggggtgctctctcctttgatcttctcttctggaagagatggaccaaaagcctctccagcaataatccgaaatgattcttgaagactatctttccagcttgtcacatatgcaaggtgtatttacaggagacagcaatggaaacctggtcagttgagcaggtctgcagttggttggtggagaaaaatttaggagagctagttcatagatttcaagaggaagaagtaagtggggccgctcttcttgcacttaatgatcggatggttcagcaactggtaaagaaaattgggcaccaggctgttctgatggatttaattaaaaaatacaagcagaacactcaaggactgaagtccccagaaaaccccaaaaaggcagccctggtcatgcaaacagaagcagctcgagattacagggatgaagagtcctccagtccagccaggcatggggagcagatgccatctttctatccagctgaaaaccttgataatggactaattgaccaaagagtattgaaacagagaagaaatgtgaaacaaattctagcaagaagcaaagcattacagtggacgaagtcctatgttttaccagagtttccctatgatgtcaaatgcatgttagcagagcagaagtgcccggatcacagcatgaggataaggatcattgagtttctccaggccgacatgactaagtatctggaaggctcactgtaccccagcacccagcagtacaatgacgtggttaatgccctgctgcaggcccaccctttcctggatgaggatggctgtggcttctttttatggaaacgagccctcaaagatcgctttaaatatgttcgaagacccatagaagatgatgagcaagtgattagaaataagtgtaaatttggacaccgaagaggccagacaaggaaatctcttgctgatataagatttgatgaaattaaacttgtccagataaaagaagaagctgtttgttttgattctgagctagatgaacatattaagtggttccagcaagaatacgtgaaaacagaaaaggactggagagaaattgacaagagaatgagccaaactttggaaataagaagaaagatgattggcagccgaacacctctgaaggacattcttaaactgtttcctttcttgaagtgcccttatcagatgttcagagaattccaacttcttacaagaacagatatttataagaaaacaaggcacattttggaatcctattcagaaaatatactgacttctttttcagtggtggacaatccaatcaatattgtattgcaagaaaaaatgaaacattacacagatgaagacatgttgaaatacatgaagatgacagccacatgtttactcctcccagatgtttttggggatgatcccagcctttttgtcatcatgaatgaacaggtgcaagtgtccacacctgtgttggaagttaaaaaccctttcaacatggaggtctgcgaattttctttatatttagaaagggagaggctcacaaaggtggacgactgtgttacagccttggctgcgctagtagctgcctttcatgtatttaggattgagtgtccaagaagactgtcccaaactttcaacttcctagaaacgctgattttcgatatgcacagtccttattttccttctttgaaagaaaaggaaaacgaagtaggatttcagcacccactcacttaatagcatgccaaatattgtactggaatttacctctgggaaaactgaagcttcataagaaattgttttgatttagggttgtggtagaggtaggtatgagaaaatcatcttgtatttatagatgctaatgaatttcaatgctttctatctttacacttagatattaagttctttgtgaaattctgtaataaaattctacttcattaaa

SEQ ID NO: 186840 - DNA, 2028 bp, Homo sapiens
  Payload ID: 16788
  Gene Symbol: SAMD3
  Gene Name: sterile alpha motif domain containing 3
  Uniprot ID: Q8N6K7
  ENST ID: ENST00000437477
  CDS Start-End: 327-1889
ataaaacaaaggaaccagaaccacatccactgatcggatttgcctggggaggaggggtgctctctcctttgatcttctcttctggaagagatggaccaaaagcctctccagcaataatccgtccacttacatgcagattttcttctgcctctgccacccctgagacagcaagaccaactctcctcttcctcctcctcctcctcagcctactcactgcaagacgacgagtatgaagatctttatgatgatccacttccatgaaatgattcttgaagactatctttccagcttgtcacatatgcaaggtgtatttacaggagacagcaatggaaacctggtcagttgagcaggtctgcagttggttggtggagaaaaatttaggagagctagttcatagatttcaagaggaagaagtaagtggggccgctcttcttgcacttaatgatcggatggttcagcaactggtaaagaaaattgggcaccaggctgttctgatggatttaattaaaaaatacaagcagaacactcaaggactgaagtccccagaaaaccccaaaaaggcagccctggtcatgcaaacagaagcagctcgagattacagggatgaagagtcctccagtccagccaggcatggggagcagatgccatctttctatccagctgaaaaccttgataatggactaattgaccaaagagtattgaaacagagaagaaatgtgaaacaaattctagcaagaagcaaagcattacagtggacgaagtcctatgttttaccagagtttccctatgatgtcaaatgcatgttagcagagcagaagtgcccggatcacagcatgaggataaggatcattgagtttctccaggccgacatgactaagtatctggaaggctcactgtaccccagcacccagcagtacaatgacgtggttaatgccctgctgcaggcccaccctttcctggatgaggatggctgtggcttctttttatggaaacgagccctcaaagatcgctttaaatatgttcgaagacccatagaagatgatgagcaagtgattagaaataagtgtaaatttggacaccgaagaggccagacaaggaaatctcttgctgatataagatttgatgaaattaaacttgtccagataaaagaagaagctgtttgttttgattctgagctagatgaacatattaagtggttccagcaagaatacgtgaaaacagaaaaggactggagagaaattgacaagagaatgagccaaactttggaaataagaagaaagatgattggcagccgaacacctctgaaggacattcttaaactgtttcctttcttgaagtgcccttatcagatgttcagagaattccaacttcttacaagaacagatatttataagaaaacaaggcacattttggaatcctattcagaaaatatactgacttctttttcagtggtggacaatccaatcaatattgtattgcaagaaaaaatgaaacattacacagatgaagacatgttgaaatacatgaagatgacagccacatgtttactcctcccagatgtttttggggatgatcccagcctttttgtcatcatgaatgaacaggtgcaagtgtccacacctgtgttggaagttaaaaaccctttcaacatggaggtctgcgaattttctttatatttagaaagggagaggctcacaaaggtggacgactgtgttacagccttggctgcgctagtagctgcctttcatgtatttaggattgagtgtccaagaagactgtcccaaactttcaacttcctagaaacgctgattttcgatatgcacagtccttattttccttctttgaaagaaaaggaaaacgaagtaggatttcagcacccactcacttaatagcatgccaaatattgtactggaatttacctctgggaaaactgaagcttcataagaaattgttttgatttagggttgtggtagaggtaggtatgagaaaatcatcttgtatttatagatgctaatgaatttcaatgct

SEQ ID NO: 186841 - DNA, 1877 bp, Homo sapiens
  Payload ID: 16788
  Gene Symbol: SAMD3
  Gene Name: sterile alpha motif domain containing 3
  Uniprot ID: Q8N6K7
  ENST ID: ENST00000457563
  CDS Start-End: 41-1675
aaatgtgggtcctacttcctcttcttgctaacggaaaacaatgagaagcagcaagttacaatctccttctcctagccaggagaagcaaggggtgtatttacaggagacagcaatggaaacctggtcagttgagcaggtctgcagttggttggtggagaaaaatttaggagagctagttcatagatttcaagaggaagaagtaagtggggccgctcttcttgcacttaatgatcggatggttcagcaactggtaaagaaaattgggcaccaggctgttctgatggatttaattaaaaaatacaagcagaacactcaaggactgaagtccccagaaaaccccaaaaaggcagccctggtcatgcaaacagaagcagctcgagattacagggatgaagagtcctccagtccagccaggcatggggagcagatgccatctttctatccagctgaaaaccttgataatggactaattgaccaaagagtattgaaacagagaagaaatgtgaaacaaattctagcaagaagcaaagcattacagtggacgaagtcctatgttttaccagagtttccctatgatgtcaaatgcatgttagcagagcagaagtgcccggatcacagcatgaggataaggatcattgagtttctccaggccgacatgactaagtatctggaaggctcactgtaccccagcacccagcagtacaatgacgtggttaatgccctgctgcaggcccaccctttcctggatgaggatggctgtggcttctttttatggaaacgagccctcaaagatcgctttaaatatgttcgaagacccatagaagatgatgagcaagtgattagaaataagtgtaaatttggacaccgaagaggccagacaaggaaatctcttgctgatataagatttgatgaaattaaacttgtccagataaaagaagaagctgtttgttttgattctgagctagatgaacatattaagtggttccagcaagaatacgtgaaaacagaaaaggactggagagaaattgacaagagaatgagccaaactttggaaataagaagaaagatgattggcagccgaacacctctgaaggacattcttaaactgtttcctttcttgaagtgcccttatcagatgttcagagaattccaacttcttacaagaacagatatttataagaaaacaaggcacattttggaatcctattcagaaaatatactgacttctttttcagtggtggacaatccaatcaatattgtattgcaagaaaaaatgaaacattacacagatgaagacatgttgaaatacatgaagatgacagccacatgtttactcctcccagatgtttttggggatgatcccagcctttttgtcatcatgaatgaacaggtgcaagtgtccacacctgtgttggaagttaaaaaccctttcaacatggaggtctgcgaattttctttatatttagaaagggagaggctcacaaaggtggacgactgtgttacagccttggctgcgctagtagctgcctttcatgtatttaggattgagtgtccaagaagactgtcccaaactttcaacttcctagaaacgctgattttcgatatgcacagtccttattttccttctttgaaagaaaaggaaaacgaagtaggatttcagcacccactcacttaatagcatgccaaatattgtactggaatttacctctgggaaaactgaagcttcataagaaattgttttgatttagggttgtggtagaggtaggtatgagaaaatcatcttgtatttatagatgctaatgaatttcaatgctttctatctttacacttagatattaagttctttgtgaaattctgtaataaaattctacttcatt

SEQ ID NO: 186842 - DNA, 2093 bp, Homo sapiens
  Payload ID: 16788
  Gene Symbol: SAMD3
  Gene Name: sterile alpha motif domain containing 3
  Uniprot ID: Q8N6K7
  ENST ID: ENST00000439090
  CDS Start-End: 329-1891
cccagtcttgctgtctttcaatggggcagccactgctcagttgctgccattcagaaatatgaacccagtatcaccagaacttttgatttttcaagagaaaccaagattccagatttgtaggtgatatcttccatttttcagataaaacaaaggaaccagaaccacatccactgatcggatttgcctggggaggaggggtgctctctcctttgatcttctcttctggaagagatggaccaaaagcctctccagcaataatccgaaatgattcttgaagactatctttccagcttgtcacatatgcaaggtgtatttacaggagacagcaatggaaacctggtcagttgagcaggtctgcagttggttggtggagaaaaatttaggagagctagttcatagatttcaagaggaagaagtaagtggggccgctcttcttgcacttaatgatcggatggttcagcaactggtaaagaaaattgggcaccaggctgttctgatggatttaattaaaaaatacaagcagaacactcaaggactgaagtccccagaaaaccccaaaaaggcagccctggtcatgcaaacagaagcagctcgagattacagggatgaagagtcctccagtccagccaggcatggggagcagatgccatctttctatccagctgaaaaccttgataatggactaattgaccaaagagtattgaaacagagaagaaatgtgaaacaaattctagcaagaagcaaagcattacagtggacgaagtcctatgttttaccagagtttccctatgatgtcaaatgcatgttagcagagcagaagtgcccggatcacagcatgaggataaggatcattgagtttctccaggccgacatgactaagtatctggaaggctcactgtaccccagcacccagcagtacaatgacgtggttaatgccctgctgcaggcccaccctttcctggatgaggatggctgtggcttctttttatggaaacgagccctcaaagatcgctttaaatatgttcgaagacccatagaagatgatgagcaagtgattagaaataagtgtaaatttggacaccgaagaggccagacaaggaaatctcttgctgatataagatttgatgaaattaaacttgtccagataaaagaagaagctgtttgttttgattctgagctagatgaacatattaagtggttccagcaagaatacgtgaaaacagaaaaggactggagagaaattgacaagagaatgagccaaactttggaaataagaagaaagatgattggcagccgaacacctctgaaggacattcttaaactgtttcctttcttgaagtgcccttatcagatgttcagagaattccaacttcttacaagaacagatatttataagaaaacaaggcacattttggaatcctattcagaaaatatactgacttctttttcagtggtggacaatccaatcaatattgtattgcaagaaaaaatgaaacattacacagatgaagacatgttgaaatacatgaagatgacagccacatgtttactcctcccagatgtttttggggatgatcccagcctttttgtcatcatgaatgaacaggtgcaagtgtccacacctgtgttggaagttaaaaaccctttcaacatggaggtctgcgaattttctttatatttagaaagggagaggctcacaaaggtggacgactgtgttacagccttggctgcgctagtagctgcctttcatgtatttaggattgagtgtccaagaagactgtcccaaactttcaacttcctagaaacgctgattttcgatatgcacagtccttattttccttctttgaaagaaaaggaaaacgaagtaggatttcagcacccactcacttaatagcatgccaaatattgtactggaatttacctctgggaaaactgaagcttcataagaaattgttttgatttagggttgtggtagaggtaggtatgagaaaatcatcttgtatttatagatgctaatgaatttcaatgctttctatctttacacttagatattaagttctttgtgaaattctgtaataaaattctacttcatt

SEQ ID NO: 186843 - DNA, 545 bp, Homo sapiens
  Payload ID: 16788
  Gene Symbol: SAMD3
  Gene Name: sterile alpha motif domain containing 3
  ENST ID: ENST00000529723
  CDS Start-End: 49-545
agaaacattcagattctccagagaaatgtgtatttacaggagacagcaatggaaacctggtcagttgagcaggtctgcagttggttggtggagaaaaatttaggagagctagttcatagatttcaagaagtaagtggggccgctcttcttgcacttaatgatcggatggttcagcaactggtaaagaaaattgggcaccaggctgttctgatggatttaattaaaaaatacaagcagaacactcaaggactgaagtccccagaaaaccccaaaaaggcagccctggtcatgcaaacagaagcagctcgagattacagggatgaagagtcctccagtccagccaggcatggggagcagatgccatctttctatccagctgaaaaccttgataatggactaattgaccaaagagtattgaaacagagaaatgtgaaacaaattctagcaagaagcaaagcattacagtggacgaagtcctatgttttaccagagtttccctatgatgtcaaatgcatgttagcagagcagaagtgcccggatcacag

SEQ ID NO: 186844 - DNA, 592 bp, Homo sapiens
  Payload ID: 16788
  Gene Symbol: SAMD3
  Gene Name: sterile alpha motif domain containing 3
  ENST ID: ENST00000531544
  CDS Start-End: 73-592
aagaatagtattggaaggaaggacagaaacattcagattctccagagaaatgtgtatttacaggagacagcaatggaaacctggtcagttgagcaggtctgcagttggttggtggagaaaaatttaggagagctagttcatagatttcaagaggaagaagtaagtggggccgctcttcttgcacttaatgatcggatggttcagcaactggtaaagaaaattgggcaccaggctgttctgatggatttaattaaaaaatacaagcagaacactcaaggactgaagtccccagaaaaccccaaaaaggcagccctggtcatgcaaacagaagcagctcgagattacagggatgaagagtcctccagtccagccaggcatggggagcagatgccatctttctatccagctgaaaaccttgataatggactaattgaccaaagagtattgaaacagagaagaaatgtgaaacaaattctagcaagaagcaaagcattacagtggacgaagtcctatgttttaccagagtttccctatgatgtcaaatgcatgttagcagagcagaagtgcccggatcacagcatgaggataagga

SEQ ID NO: 186845 - DNA, 322 bp, Homo sapiens
  Payload ID: 16788
  Gene Symbol: SAMD3
  Gene Name: sterile alpha motif domain containing 3
  ENST ID: ENST00000463253
  CDS Start-End: 1-233
tgtttcctttcttgaagtgcccttatcagatgttcagagaattccaacttcttacaagaacagatatttataagaaaacaaggcacattttggaatcctattcagaaaatatactgacttctttttcagtggtggacaatccaatcaatattgtattgcaagaaaaaatgaaacattacacagatgaagacatgttgaaatgtgcaagtgtccacacctgtgttggaagttaaaaaccctttcaacatggaggtctgcgaattttctttatatttagaaagggagaggctcacaaaggtggacgactgtgttacagccttgg

SEQ ID NO: 186846 - DNA, 3690 bp, Homo sapiens
  Payload ID: 16788
  Gene Symbol: SAMD3
  Gene Name: sterile alpha motif domain containing 3
  ENST ID: ENST00000532763
  CDS Start-End: 131-958
ctttgtgaagaaacctgggtgttaatggtacaggattgggtaccattgtatgtccctggctgtctgttagtaaagcttagagatgcctgtggaaaaaaagtaggagaaggtgtatttacaggagacagcaatggaaacctggtcagttgagcaggtctgcagttggttggtggagaaaaatttaggagagctagttcatagatttcaagaggaagaagtaagtggggccgctcttcttgcacttaatgatcggatggttcagcaactggtaaagaaaattgggcaccaggctgttctgatggatttaattaaaaaatacaagcagaacactcaaggactgaagtccccagaaaaccccaaaaaggcagccctggtcatgcaaacagaagcagctcgagaggatgaagagtcctccagtccagccaggcatggggagcagatgccatctttctatccagctgaaaaccttgataatggactaattgaccaaagagtattgaaacagagaagaaatgtgaaacaaattctagcaagaagcaaagcattacagtggacgaagtcctatgttttaccagagtttccctatgatgtcaaatgcatgttagcagagcagaagtgcccggatcacagcatgaggataaggatcattgagtttctccaggccgacatgactaagtatctggaaggctcactgtaccccagcacccagcagtacaatgacgtggttaatgccctgctgcaggcccaccctttcctggatgaggatggctgtggcttctttttatggaaacgagccctcaaagatcgctttaaatatgttcgaagacccatagaagatgatgagcaagtgattagaaataagtgtaaatttggacaccgaagaggccagacaaggaaatctcttgctgatataagatttgatgaaattaaacttgtccagataaaactgtcagcttaaactaaaagttggctagaactatgctctgctattacaaccaactctgtgagagcttaggttactgtggtgttggagtagagagaccacactctatgttgccaaaactggtgtggtaaaggaagcatagcatacgctctttatacaatttgtttggctttaactcaagttaatgttctggttaatttacgctgattcctctaaagtcacacatctcaaaggtgagtcctacacttcccttcagtgtatttcttggcctgaagtgatctctttcgtgcttcatgtctactttctttgattcctccttgagcacggccctccattaactttgtctgctgagacagacatcttgaagtcaacagtcagcagctgtttccagctgctgttctgtaagattcagacatttcttactcactagttgcctcatttcaacgtgcactgttaaagaaatcagcctgttagagaagtgaggaaataccctaaaagaaacctgcacacctgagcatctctgtgcttggaaaagtcacttcccctttgagggtctcaatttgcccatcagtaaagtgtgaggcatggactaggtggtttctaagttctttccagctttaataatatataaatcattaacagtatatctaacaatatataaatctaacaatatgtaaatcattaaaatggtgagaattttaaattctgatgtagctttttaataattaggaaaatcacttcagtctagaatacaacccaccaacactgtgttaatcccatcagtctgatcaggtggaagttatctagaaactttattttcatgattgggtaagagttttggaggaagtagtacattataaatacagtaatatctaaatgtcaatatcagcaattatataacttctactatatttcagtagatgaaagaaagccatttagataattaaaacattttttctgtactttaaaaaattaaaatgttttcttacttaagaaattgtcattctatgcatttgagacatacagaagaaaaactacatacgtaacatatatgtagtttatgagacaaaataaacactgttaactcagcatttaactttagaactagaacactgcctgcaccattgtgtgtgcctgagttttcctcccctctcctgtcacctgcctttccaacaccacaggcctctagaactaatcactattctgaattttatgtttatcattcacctgttttaaaaataaatgacattgtcacatatgcatgaattcttaagggatatattgcttagttttgcttgtttttttttcaagcacatattttatttgaataaatcctctgtagtccatttttatgttcaacagtttaaaacatatacaaacaaagcttgaaagtaaatgaagatctgacatatctgaagcttaaagatttttatttttcttttcaccaccttccacattttacatttgaaactccttggcttcgttgacaatccattatcctggttctcctgctcctataattttctccctttctatatatctaaatctagataatttaaaagaaatatcaaatctctatctctgcattcacaagtttcctagctattcttccaacctcaattaaaagatttcatcgcctttaagtcccagctttaaaccctggccgtctatggttttccacaatcttcagatttgctctgctaaacattcccgtaacatgctctgcccttcctgtctctccacccagaactgtcctttcttctttcaaattctattatcccttaaaatctgatcagttcctcatcttccacgaattttccttcactaccccagcctaaaacaaattctagttttgcttgtttttaaggtttacaaaatgatatgaaaactatatgttggctttgataagttcctttttttcaatcaatgtaatgtcactggaattcatccaggttgttcagttgagtgtagtttattcgttttcctgttggtttaatctattgtgacaggcaaccagtttatttggctcttctcttcttaacggatatttgatttgtttccagtgttggctgttatgaactatgctgctgtgattattcttgtatgtgtgtcttgaagcatatgtgaagatttttttcaaggatttatacttaggagtggatttgctggctcactggctcacagggtgtgcagatattcaactctgtaagacagtgccaaattattttcctggatgattaagctccctgagcagcactcgttaatcatctgatttcttttccactcaccccacccccatgcaatgccaccaccccacttccaatctattgggaatacaatggtactgtgtttggcttccattttagttatgtatgagggtgatcatcttttcatatgtttatgaaatattcatgtttcctcctctgtaaagtgtctgttcatgtcttttgcttatttttctatgaggctgcctttttttcaatttacttgtaaaaatcctttgtatattctgtattctactcctttactaattatatttgttcccaatatcttctcacagtttgtgccttgccttttaaatttctttctggtgtcttttgacaaggaaagacaaggttgcaattttaatgtagttagagttatcaatcatttgtcttatgatcagtgcttctgaggcaggagaatagggtctgaaggcaggaagcctaaggccaatttgcaccaacttcctcgaactgaatcaaaag

SEQ ID NO: 186847 - DNA, 679 bp, Homo sapiens
  Payload ID: 16788
  Gene Symbol: SAMD3
  Gene Name: sterile alpha motif domain containing 3
  ENST ID: ENST00000532309
  CDS Start-End: 49-679
agaaacattcagattctccagagaaatgtgtatttacaggagacagcaatggaaacctggtcagttgagcaggtctgcagttggttggtggagaaaaatttaggagagctagttcatagatttcaagaggaagaagtaagtggggccgctcttcttgcacttaatgatcggatggttcagcaactggtaaagaaaattgggcaccaggctgttctgatggatttaattaaaaaatacaagcagaacactcaaggactgaagtccccagaaaaccccaaaaaggcagccctggtcatgcaaacagaagcagctcgagattacagggatgaagagtcctccagtccagccaggcatggggagcagatgccatctttctatccagctgaaaaccttgataatggactaattgaccaaagagtattgaaacagagaaatgtgaaacaaattctagcaagaagcaaagcattacagtggacgaagtcctatgttttaccagagtttccctatgatgtcaaatgcatgttagcagagcagaagtgcccggatcacagcatgaggataaggatcattgagtttctccaggccgacatgactaagtatctggaaggctcactgtaccccagcacccagcagtacaatgacgtggttaatgccctgctgcaggcccaccctttcctgg

SEQ ID NO: 186848 - DNA, 929 bp, Homo sapiens
  Payload ID: 16788
  Gene Symbol: SAMD3
  Gene Name: sterile alpha motif domain containing 3
  ENST ID: ENST00000524930
  CDS Start-End: 18-131
atttacaggagacagcaatggaaacctggtcagttgagcaggtctgcagttggttggtggagaaaaatttaggagagctagttcatagatttcaaggaagaagtaagtggggccgctcttcttgcacttaatgatcggatggttcagcaactggtaaagaaaattgggcaccaggctgttctgatggatttaattaaaaaatacaagcagaacactcaaggactgaagtccccagaaaaccccaaaaaggcagccctggtcatgcaaacagaagcagctcgagattacagggatgaagagtcctccagtccagccaggcatggggagcagatgccatctttctatccagctgaaaaccttgataatggactaattgaccaaagagtattgaaacagagaagaaatgtgaaacaaattctagcaagaagcaaagcattacagtggacgaagtcctatgttttaccagagtttccctatgatgtcaaatgcatgttagcagagcagaagtgcccggatcacagcatgaggataaggatcattgagtttctccaggccgacatgactaagtatctggaaggctcactgtaccccagcacccagcagtacaatgacgtggttaatgccctgctgcaggcccaccctttcctggatgaggatggctgtggcttcacccagtggagctgttgtctggctttgaggtctgggcctccagccttacctggccctgtcagatctctgctttctgtcctgataaaaacagaccctcaggatgctctggggcagcagttcttttttttttttttcctttttttttttttgagacggagtctcgctctctcactcaggctggagtatagtggcgcgatctcagctcactgcaacctccgcctcctgggttcaagcaattctctggggcagcagttctaagc

SEQ ID NO: 186849 - DNA, 6565 bp, Homo sapiens
  Payload ID: 16789
  Gene Symbol: SAMD4A
  Gene Name: sterile alpha motif domain containing 4A
  Uniprot ID: Q9UPU9
  ENST ID: ENST00000251091
  CDS Start-End: 306-2198
attcttcattcagttgtgtgccttgtgggggatttttaaaaagtcgtttttttttttaaagaaacatttccgtgctactgtctgtcatcgtctctggggaaatcagccagaaccaccggaacgtaactgaaaccagacaagagaggcaggagcccaggcagtacctgcagcgtccgggcaccagagccaccttggaacaggaacgcgtctccggccgcggggctgcggctccgccaaactttggggcgggcggggcgggctggggcgcccagggggctctgtagaccgagggcggccccctaaccatgatgtttcgcgaccaggtcggggtgctggcgggctggtttaagggctggaacgagtgcgagcagactgttgcgctgctgtcgctgctcaagcgcgtgagccagacccaggcccgcttcctccagctctgcctggagcactcgctggccgactgcgccgagctgcacgtcctcgaacgcgaggccaacagccccggaatcattaaccaatggcaacaggaatccaaggataaagtgatttccctcctgttaactcatctgcctttgctgaagccaggaaacctcgacgcgaaagtagaatatatgaaactgctgcccaaaatcctggctcactctattgaacacaaccagcacattgaggagagcaggcagctgctgtcctatgctttgatacatccagccacttcgttagaagaccgtagtgctttagccatgtggctgaatcacttggaggaccgcacgtcgaccagctttggtggccagaaccgaggccgctcagactctgtggattatggacagacacactactatcaccaaagacagaactctgatgacaagctcaatgggtggcagaactctcgggattctgggatttgcatcaatgcctccaactggcaggacaaaagcatggggtgtgagaatggccatgtgcccctctactcctcctcatctgtccccaccacaatcaatacgattggaaccagcacaagtacaaatgttccagcctggctgaaaagcctccgcctgcacaaatatgccgcgcttttctcccagatgacctatgaggagatgatggccctcaccgagtgccagctggaggcgcagaatgttaccaaaggtgcaagacacaaaattgtcatcagtattcagaagctcaaagaaagacaaaatctcctgaagtctttggaaagggacatcatcgaggggggcagcctgcgcatcccgctccaggaactgcaccagatgatcctgactccgatcaaggcctacagctccccgagcaccacccccgaggctcgccgccgggagccccaggccccgcgtcagccctcactgatgggccccgagagccagagccccgactgcaaagatggggccgcagccactggcgccacggccaccccctcggccggggccagcggggggctccagccgcaccagctgagcagctgcgatggggagctggccgtcgcccccctgccagagggggacctccccgggcagttcacacgcgtcatggggaaagtgtgcacacagctcttggtctccagacctgatgaggaaaatataagttcctatttacagctcatagacaagtgtctaattcatgaggcatttacagagacacagaaaaaaagattgttgtcatggaaacagcaggtgcagaagctctttcggtctttccctcggaaaacccttctagacatatcaggatatcgacagcaaagaaatcgaggctttgggcaatccaactccctcccgacggctggctctgtgggcggtggcatgggcagacggaacccgcgccagtaccagatcccctctcggaacgtcccttccgcccgcctgggcctcttgggcaccagtggattcgtcagctccaaccagcgcaacaccacagctacccccaccatcatgaaacaaggaagacagaacctgtggtttgccaaccccgggggcagcaatagcatgccaagccgcacccacagctcagtccagaggacccgctcgctgcccgtgcacacttccccacagaacatgctgatgttccagcagccagaattccagcttcccgtgaccgaacctgacatcaacaacaggctggagtcgttgtgcctcagtatgaccgaacacgccctgggagacggggttgaccggacctccaccatctagaagctgaagacgagagtgaccgcgctggccgtgaaatcgactgctgcgggtccagtgtccgccatcttcagggttgcacagaatcctccaagatactttgcagccttttttccccctggtccctctcccgttttgattttgtgagagcgtaggtcatcctcgtaaacatatcagtagacctggggttggttattttgtcatttgtttctgtcatgggatggtttggtgtgtggggtggggaggggtctctagggaattatgagactgggaggggggtggagggaatgcaggtagctctctggatggaacggggacaggggaaagagtactgccatgaaagagataggagacacataagaggacagcagaagccctggccctggggaggcttctcggaaggcctggcttcacaggcaggccacagaaggatatcgcgggcacgtgcacccaaagcaagatagtggcttcccttttatatccaatctaatcctgattggatgtccctgaggcccctgctggaaacagccataggagagggcccatggcagtaggggaaagaaggaagaaattccctgcaacaaaacttcagctaaactttgatttgtgtattgtttacataataattttaaagggtacataatgtgtaaagagtttggatagaacctctcttcatactatggttttcgtaaaggatctgttgttgttacggattcattttttccctctatttttataagagcagcagagttgtcttctcaaaacggctgccaagctctgcttcttgggaagatggatgcagtcatgtaggcctgagctgtccgtctttcaccgttaggtgggaggagcgtatgggtggacttgaaggacatggacgtggctggaatgagcacagcattgggtgagcgcacaaggatgaggacatcatgtgatcagttatgggtttgctcgcagggcacccagagattctcaaagaatcctgcagcctctttctgtgctggatttgcttgtcacggagaggcctccctccctttccaccccacccatggggcattatcctgtcactcccagccttgctccacacacacacaggtgggtacaagttccactggaggagaaaaggcaaggatggactttttccccttgtgagaggtttgatacccagaaaatgagctcaaaacctttacattagggttgcttgtaggaactggagcctggaggctgcatctacttcacctgtcactgctgagggagaggaggggagaaaggcccagcaacagcgtacagaggggtcagtcagcaagtccagagagcacatgcagggagatgtttggcccacaccgcacagccccgccatctccagtgggcgatgaaagatgtaggaaaggttgatttcaagatggaaatgacagcgctatccgcacagtatgaattagggatttgctgtgttagttgatttatccatccacacagaggggaggaaaaagacactcgttacttggtgggagattgagaaactgtggtacctaccacaaagtaatagctctgtttatgaagggcaagaaaggctacatttcagaatttgacacagtggagggtattagaggaaatcaaagaggagttgtgtggaaaatcaggttgtgtaaatgaaggtatgaatgctcagccagaggcaagatcagggagatggtacaaggcctgtttgttacatggatgagtcgggtgcctggttgtgtgtgtgtgtgtgtgtgtgtgtgtgtgtgtgtgaagtcagagttgaaattcagaagatcagactatggaaatcactgcccttttttttttaaaagctaatgaactacatacagacctaaaaggccttaatgaaatccgaacaattttcttttactttcaagatcaaaaacatgcacccaacccagccttggatgccaccaccaggtttttgaagcccttttgagtctaagaaggtgagaacaatgtaaccatagaaagcctttcgtgagcagagaaggcttgaatccacaatttcattcgctgaattaaaaaaaaaaggttcagacctctccttgggtgactaagttctaaagatgcaaatccatgtgcagaaagagatggcattttttagttgattatttttaaccaagtgccattaacattcatcccccacatcccttttctaaacaagcttagtgttacttggggaatgtgttgggatggacgatcacatgtaaggcaggaagaataggtcaaaggttgaaggccaaaggtaagaccagagggtttgcgaatgtgggtttgtaggatactgagaaagtgaataaagaggagaaaaaaccatggtattacacatcttgctgagaaaggaaagcattcggatctgctgcaaaaacacatatatccataaagactcatgttattcagaaaacagattgtgaacacaatcacattcgcatgaatcctttaaaaggaagaagaccttaaagtatctgcaaatctgaatttctatttattccttcactgaatatagaaacaatggttatctgattattagagatattattttggatatgttacttattaacttgctatggctggtaaccatgataaagtctgttattaataacaacataattctttttttaaagaagaaaagcttatttttcattgacagtgtatagatttatctacttagttgtgttttgctattagtgttttaattttttttttaagttgagtgtttgataaattttaagaccctgtccccaccttgttttgagtcctgtgttgactacaggtatatagctcaatttaaaaatcctaaagcaaaagaattttatttataaaagaatcaaacagttgcatgcatgaggctgtgaagtcagatatttagtaataaaagcagcagtgcctttttttgtatttacccattgacccccaccaaatgcaactgttttatattaagaaaatagtaacaattttaaaatctcagagtaaaatctatttcactacatgcttttccccccttgttctgatttaagcagtgtgtacttggcatctctacattgtcctagggacagtggtgttctacaatattatcatgtatgatgttttattggtgctttttattcatagtggcttcttaccagaaacagtaggaagaaacacatgaactgtgtacaagacatgaaacattgctgctgatatgttgttttttcacatgcttttgagttttcactttttaaacgagagccagcaagcaaaatagatgtggctgggtctgcctgtccgggcggctctttgcaccgagctctcaaatcctgtgtattgagggttcctttttggtactcaggattggagctacagctgggcccccctctctcccattcgtttgaagagacactgagggaaacaagggtttcttttgaggtgtccttggctgccttttacgggatgggagccttctccggatcttttgttcttctgcacctcttgtagctactgccggtgcaaggttgtagatgttattccccaggagcctgggcttgggggctgagctgggctgaatgcaaaagcatgcaaccagaaggcgggcaaggggaggaaaagcaggcctggcctcattggtcccctggagatgtctgtagcagtcagctccagcttgggcctggggaagcagcctgaccaaggcgctcaggtgtgcctgttacaagaagaacctgcagaaggataatttgcacatggagctgtgataacactaatgttgattttttttttttttacaagtcatcagagatgtttgcaaagtgagttttatttttttgtaattcctttatctttacttaaaggtgaatgtgtattcctctgggaggaataggaagaaaacaggaatgttaataatgtcgaacagaaaacttcctcccttattaatatataatcctcatgtatttatgcctaatgtaagctgacttttaaaaagctttcttttgttgcatgccctgtgcaggcatctgtattgtacatgcatgcctttcgtcctgttttcctgtataaagttagtgaacaaagaaatatttttgcctagttcatgttgccaagcaatgcatattttttaaatttgtcatatatggaaagagcatgtttgttacatgtaaaagctttactgatatacagatatactaatgtttgaagatgctgttctttgcaagtgtacagttttcaaatgttgttaccagtgaaacacccttgtggtttaaacttgctacaatgtatttattattcatttcctcccatgtaactaagaatcatggctatatttcatatcaacgttatattgaaagtgaagggaaatgattaatacaaggttttgtaac

SEQ ID NO: 186850 - DNA, 6833 bp, Homo sapiens
  Payload ID: 16789
  Gene Symbol: SAMD4A
  Gene Name: sterile alpha motif domain containing 4A
  Uniprot ID: Q9UPU9
  ENST ID: ENST00000392067
  CDS Start-End: 306-2462
attcttcattcagttgtgtgccttgtgggggatttttaaaaagtcgtttttttttttaaagaaacatttccgtgctactgtctgtcatcgtctctggggaaatcagccagaaccaccggaacgtaactgaaaccagacaagagaggcaggagcccaggcagtacctgcagcgtccgggcaccagagccaccttggaacaggaacgcgtctccggccgcggggctgcggctccgccaaactttggggcgggcggggcgggctggggcgcccagggggctctgtagaccgagggcggccccctaaccatgatgtttcgcgaccaggtcggggtgctggcgggctggtttaagggctggaacgagtgcgagcagactgttgcgctgctgtcgctgctcaagcgcgtgagccagacccaggcccgcttcctccagctctgcctggagcactcgctggccgactgcgccgagctgcacgtcctcgaacgcgaggccaacagccccggaatcattaaccaatggcaacaggaatccaaggataaagtgatttccctcctgttaactcatctgcctttgctgaagccaggaaacctcgacgcgaaagtagaatatatgaaactgctgcccaaaatcctggctcactctattgaacacaaccagcacattgaggagagcaggcagctgctgtcctatgctttgatacatccagccacttcgttagaagaccgtagtgctttagccatgtggctgaatcacttggaggaccgcacgtcgaccagctttggtggccagaaccgaggccgctcagactctgtggattatggacagacacactactatcaccaaagacagaactctgatgacaagctcaatgggtggcagaactctcgggattctgggatttgcatcaatgcctccaactggcaggacaaaagcatggggtgtgagaatggccatgtgcccctctactcctcctcatctgtccccaccacaatcaatacgattggaaccagcacaagtacaattctctcaggccaggcacaccacagccctttgaaacgatctgtgtcccttaccccacccatgaatgtgccaaaccagcctctaggacatggatggatgtctcatgaggacttacgagctagaggaccccagtgcctcccatccgatcatgcccccctgtctccacaaagcagtgtagcctcttcaggaagtggtgggagtgaacacttagaagatcagaccactgctcgtaacacattccaagaagaaggtagtgggatgaaagatgttccagcctggctgaaaagcctccgcctgcacaaatatgccgcgcttttctcccagatgacctatgaggagatgatggccctcaccgagtgccagctggaggcgcagaatgttaccaaaggtgcaagacacaaaattgtcatcagtattcagaagctcaaagaaagacaaaatctcctgaagtctttggaaagggacatcatcgaggggggcagcctgcgcatcccgctccaggaactgcaccagatgatcctgactccgatcaaggcctacagctccccgagcaccacccccgaggctcgccgccgggagccccaggccccgcgtcagccctcactgatgggccccgagagccagagccccgactgcaaagatggggccgcagccactggcgccacggccaccccctcggccggggccagcggggggctccagccgcaccagctgagcagctgcgatggggagctggccgtcgcccccctgccagagggggacctccccgggcagttcacacgcgtcatggggaaagtgtgcacacagctcttggtctccagacctgatgaggaaaatataagttcctatttacagctcatagacaagtgtctaattcatgaggcatttacagagacacagaaaaaaagattgttgtcatggaaacagcaggtgcagaagctctttcggtctttccctcggaaaacccttctagacatatcaggatatcgacagcaaagaaatcgaggctttgggcaatccaactccctcccgacggctggctctgtgggcggtggcatgggcagacggaacccgcgccagtaccagatcccctctcggaacgtcccttccgcccgcctgggcctcttgggcaccagtggattcgtcagctccaaccagcgcaacaccacagctacccccaccatcatgaaacaaggaagacagaacctgtggtttgccaaccccgggggcagcaatagcatgccaagccgcacccacagctcagtccagaggacccgctcgctgcccgtgcacacttccccacagaacatgctgatgttccagcagccagaattccagcttcccgtgaccgaacctgacatcaacaacaggctggagtcgttgtgcctcagtatgaccgaacacgccctgggagacggggttgaccggacctccaccatctagaagctgaagacgagagtgaccgcgctggccgtgaaatcgactgctgcgggtccagtgtccgccatcttcagggttgcacagaatcctccaagatactttgcagccttttttccccctggtccctctcccgttttgattttgtgagagcgtaggtcatcctcgtaaacatatcagtagacctggggttggttattttgtcatttgtttctgtcatgggatggtttggtgtgtggggtggggaggggtctctagggaattatgagactgggaggggggtggagggaatgcaggtagctctctggatggaacggggacaggggaaagagtactgccatgaaagagataggagacacataagaggacagcagaagccctggccctggggaggcttctcggaaggcctggcttcacaggcaggccacagaaggatatcgcgggcacgtgcacccaaagcaagatagtggcttcccttttatatccaatctaatcctgattggatgtccctgaggcccctgctggaaacagccataggagagggcccatggcagtaggggaaagaaggaagaaattccctgcaacaaaacttcagctaaactttgatttgtgtattgtttacataataattttaaagggtacataatgtgtaaagagtttggatagaacctctcttcatactatggttttcgtaaaggatctgttgttgttacggattcattttttccctctatttttataagagcagcagagttgtcttctcaaaacggctgccaagctctgcttcttgggaagatggatgcagtcatgtaggcctgagctgtccgtctttcaccgttaggtgggaggagcgtatgggtggacttgaaggacatggacgtggctggaatgagcacagcattgggtgagcgcacaaggatgaggacatcatgtgatcagttatgggtttgctcgcagggcacccagagattctcaaagaatcctgcagcctctttctgtgctggatttgcttgtcacggagaggcctccctccctttccaccccacccatggggcattatcctgtcactcccagccttgctccacacacacacaggtgggtacaagttccactggaggagaaaaggcaaggatggactttttccccttgtgagaggtttgatacccagaaaatgagctcaaaacctttacattagggttgcttgtaggaactggagcctggaggctgcatctacttcacctgtcactgctgagggagaggaggggagaaaggcccagcaacagcgtacagaggggtcagtcagcaagtccagagagcacatgcagggagatgtttggcccacaccgcacagccccgccatctccagtgggcgatgaaagatgtaggaaaggttgatttcaagatggaaatgacagcgctatccgcacagtatgaattagggatttgctgtgttagttgatttatccatccacacagaggggaggaaaaagacactcgttacttggtgggagattgagaaactgtggtacctaccacaaagtaatagctctgtttatgaagggcaagaaaggctacatttcagaatttgacacagtggagggtattagaggaaatcaaagaggagttgtgtggaaaatcaggttgtgtaaatgaaggtatgaatgctcagccagaggcaagatcagggagatggtacaaggcctgtttgttacatggatgagtcgggtgcctggttgtgtgtgtgtgtgtgtgtgtgtgtgtgtgtgtgtgaagtcagagttgaaattcagaagatcagactatggaaatcactgcccttttttttttaaaagctaatgaactacatacagacctaaaaggccttaatgaaatccgaacaattttcttttactttcaagatcaaaaacatgcacccaacccagccttggatgccaccaccaggtttttgaagcccttttgagtctaagaaggtgagaacaatgtaaccatagaaagcctttcgtgagcagagaaggcttgaatccacaatttcattcgctgaattaaaaaaaaaaggttcagacctctccttgggtgactaagttctaaagatgcaaatccatgtgcagaaagagatggcattttttagttgattatttttaaccaagtgccattaacattcatcccccacatcccttttctaaacaagcttagtgttacttggggaatgtgttgggatggacgatcacatgtaaggcaggaagaataggtcaaaggttgaaggccaaaggtaagaccagagggtttgcgaatgtgggtttgtaggatactgagaaagtgaataaagaggagaaaaaaccatggtattacacatcttgctgagaaaggaaagcattcggatctgctgcaaaaacacatatatccataaagactcatgttattcagaaaacagattgtgaacacaatcacattcgcatgaatcctttaaaaggaagaagaccttaaagtatctgcaaatctgaatttctatttattccttcactgaatatagaaacaatggttatctgattattagagatattattttggatatgttacttattaacttgctatggctggtaaccatgataaagtctgttattaataacaacataattctttttttaaagaagaaaagcttatttttcattgacagtgtatagatttatctacttagttgtgttttgctattagtgttttaattttttttttaagttgagtgtttgataaattttaagaccctgtccccaccttgttttgagtcctgtgttgactacaggtatatagctcaatttaaaaatcctaaagcaaaagaattttatttataaaagaatcaaacagttgcatgcatgaggctgtgaagtcagatatttagtaataaaagcagcagtgcctttttttgtatttacccattgacccccaccaaatgcaactgttttatattaagaaaatagtaacaattttaaaatctcagagtaaaatctatttcactacatgcttttccccccttgttctgatttaagcagtgtgtacttggcatctctacattgtcctagggacagtggtgttctacaatattatcatgtatgatgttttattggtgctttttattcatagtggcttcttaccagaaacagtaggaagaaacacatgaactgtgtacaagacatgaaacattgctgctgatatgttgttttttcacatgcttttgagttttcactttttaaacgagagccagcaagcaaaatagatgtggctgggtctgcctgtccgggcggctctttgcaccgagctctcaaatcctgtgtattgagggttcctttttggtactcaggattggagctacagctgggcccccctctctcccattcgtttgaagagacactgagggaaacaagggtttcttttgaggtgtccttggctgccttttacgggatgggagccttctccggatcttttgttcttctgcacctcttgtagctactgccggtgcaaggttgtagatgttattccccaggagcctgggcttgggggctgagctgggctgaatgcaaaagcatgcaaccagaaggcgggcaaggggaggaaaagcaggcctggcctcattggtcccctggagatgtctgtagcagtcagctccagcttgggcctggggaagcagcctgaccaaggcgctcaggtgtgcctgttacaagaagaacctgcagaaggataatttgcacatggagctgtgataacactaatgttgattttttttttttttacaagtcatcagagatgtttgcaaagtgagttttatttttttgtaattcctttatctttacttaaaggtgaatgtgtattcctctgggaggaataggaagaaaacaggaatgttaataatgtcgaacagaaaacttcctcccttattaatatataatcctcatgtatttatgcctaatgtaagctgacttttaaaaagctttcttttgttgcatgccctgtgcaggcatctgtattgtacatgcatgcctttcgtcctgttttcctgtataaagttagtgaacaaagaaatatttttgcctagttcatgttgccaagcaatgcatattttttaaatttgtcatatatggaaagagcatgtttgttacatgtaaaagctttactgatatacagatatactaatgtttgaagatgctgttctttgcaagtgtacagttttcaaatgttgttaccagtgaaacacccttgtggtttaaacttgctacaatgtatttattattcatttcctcccatgtaactaagaatcatggctatatttcatatcaacgttatattgaaagtgaagggaaatgattaatacaaggttttgtaacactg

SEQ ID NO: 186851 - DNA, 1337 bp, Homo sapiens
  Payload ID: 16789
  Gene Symbol: SAMD4A
  Gene Name: sterile alpha motif domain containing 4A
  ENST ID: ENST00000555192
  CDS Start-End: 117-1154
agttactgaacccttatcaagcagctgcctgggactcaatttgccccatccattggagattaaccgacatcatcgaggggggcagcctgcgcatcccgctccaggaactgcaccagatgatcctgactccgatcaaggcctacagctccccgagcaccacccccgaggctcgccgccgggagccccaggccccgcgtcagccctcactgatgggccccgagagccagagccccgactgcaaagatggggccgcagccactggcgccacggccaccccctcggccggggccagcggggggctccagccgcaccagctgagcagctgcgatggggagctggccgtcgcccccctgccagagggggacctccccgggcagttcacacgcgtcatggggaaagtgtgcacacagctcttggtctccagacctgatgaggaaaatataagttcctatttacagctcatagacaagtgtctaattcatgaggcatttacagagacacagaaaaaaagattgttgtcatggaaacagcaggtgcagaagctctttcggtctttccctcggaaaacccttctagacatatcaggatatcgacagcaaagaaatcgaggctttgggcaatccaactccctcccgacggctggctctgtgggcggtggcatgggcagacggaacccgcgccagtaccagatcccctctcggaacgtcccttccgcccgcctgggcctcttgggcaccagtggattcgtcagctccaaccagcgcaacaccacagctacccccaccatcatgaaacaaggaagacagaacctgtggtttgccaaccccgggggcagcaatagcatgccaagccgcacccacagctcagtccagaggacccgctcgctgcccgtgcacacttccccacagaacatgctgatgttccagcagccaggttcccaagttcacagtggactgtgtttaacagaccttagaggttggttgagcctgagtggagccccttccatgccagcgctgacagtccccaagtcctcccagggagaattccagcttcccgtgaccgaacctgacatcaacaacaggctggagtcgttgtgcctcagtatgaccgaacacgccctgggagacggggttgaccggacctccaccatctagaagctgaagacgagagtgaccgcgctggccgtgaaatcgactgctgcgggtccagtgtccgccatcttcagggttgcacagaatcctccaagatactttgcagccttttttccccctggtccctctcccgttttgattttgtgagagcgtaggtcatcctcgtaaacatatcagtagacctgg

SEQ ID NO: 186852 - DNA, 3003 bp, Homo sapiens
  Payload ID: 16789
  Gene Symbol: SAMD4A
  Gene Name: sterile alpha motif domain containing 4A
  Uniprot ID: Q9UPU9
  ENST ID: ENST00000554335
  CDS Start-End: 664-2820
ttagctcccacccccacccccgcgccccttcgcagccgcattgcaagttttctgcgcggggaagatctgttgctggtgctggcgttcttaagcacggcgcccgaggccaccccaggcgggccgtgaggggagcaccagccgttggcagcggcagcaacaggaagccgcggggtctcctcccgcacctgggaagcaggcttctcgctgttacccggtggggaatagcccatctcccacatcggtggtgatcgccgctcgggaatgcgggcgtgaagggtccgagttgccgcccagcggggaggagaccccaggacgccggaaatcaccatcccaaagctgcaagaaggggggagaaagcattcttcattcagttgtgtgccttgtgggggatttttaaaaagtcgtttttttttttaaagaaacatttccgtgctactgtctgtcatcgtctctggggaaatcagccagaaccaccggaacgtaactgaaaccagacaagagaggcaggagcccaggcagtacctgcagcgtccgggcaccagagccaccttggaacaggaacgcgtctccggccgcggggctgcggctccgccaaactttggggcgggcggggcgggctggggcgcccagggggctctgtagaccgagggcggccccctaaccatgatgtttcgcgaccaggtcggggtgctggcgggctggtttaagggctggaacgagtgcgagcagactgttgcgctgctgtcgctgctcaagcgcgtgagccagacccaggcccgcttcctccagctctgcctggagcactcgctggccgactgcgccgagctgcacgtcctcgaacgcgaggccaacagccccggaatcattaaccaatggcaacaggaatccaaggataaagtgatttccctcctgttaactcatctgcctttgctgaagccaggaaacctcgacgcgaaagtagaatatatgaaactgctgcccaaaatcctggctcactctattgaacacaaccagcacattgaggagagcaggcagctgctgtcctatgctttgatacatccagccacttcgttagaagaccgtagtgctttagccatgtggctgaatcacttggaggaccgcacgtcgaccagctttggtggccagaaccgaggccgctcagactctgtggattatggacagacacactactatcaccaaagacagaactctgatgacaagctcaatgggtggcagaactctcgggattctgggatttgcatcaatgcctccaactggcaggacaaaagcatggggtgtgagaatggccatgtgcccctctactcctcctcatctgtccccaccacaatcaatacgattggaaccagcacaagtacaattctctcaggccaggcacaccacagccctttgaaacgatctgtgtcccttaccccacccatgaatgtgccaaaccagcctctaggacatggatggatgtctcatgaggacttacgagctagaggaccccagtgcctcccatccgatcatgcccccctgtctccacaaagcagtgtagcctcttcaggaagtggtgggagtgaacacttagaagatcagaccactgctcgtaacacattccaagaagaaggtagtgggatgaaagatgttccagcctggctgaaaagcctccgcctgcacaaatatgccgcgcttttctcccagatgacctatgaggagatgatggccctcaccgagtgccagctggaggcgcagaatgttaccaaaggtgcaagacacaaaattgtcatcagtattcagaagctcaaagaaagacaaaatctcctgaagtctttggaaagggacatcatcgaggggggcagcctgcgcatcccgctccaggaactgcaccagatgatcctgactccgatcaaggcctacagctccccgagcaccacccccgaggctcgccgccgggagccccaggccccgcgtcagccctcactgatgggccccgagagccagagccccgactgcaaagatggggccgcagccactggcgccacggccaccccctcggccggggccagcggggggctccagccgcaccagctgagcagctgcgatggggagctggccgtcgcccccctgccagagggggacctccccgggcagttcacacgcgtcatggggaaagtgtgcacacagctcttggtctccagacctgatgaggaaaatataagttcctatttacagctcatagacaagtgtctaattcatgaggcatttacagagacacagaaaaaaagattgttgtcatggaaacagcaggtgcagaagctctttcggtctttccctcggaaaacccttctagacatatcaggatatcgacagcaaagaaatcgaggctttgggcaatccaactccctcccgacggctggctctgtgggcggtggcatgggcagacggaacccgcgccagtaccagatcccctctcggaacgtcccttccgcccgcctgggcctcttgggcaccagtggattcgtcagctccaaccagcgcaacaccacagctacccccaccatcatgaaacaaggaagacagaacctgtggtttgccaaccccgggggcagcaatagcatgccaagccgcacccacagctcagtccagaggacccgctcgctgcccgtgcacacttccccacagaacatgctgatgttccagcagccagaattccagcttcccgtgaccgaacctgacatcaacaacaggctggagtcgttgtgcctcagtatgaccgaacacgccctgggagacggggttgaccggacctccaccatctagaagctgaagacgagagtgaccgcgctggccgtgaaatcgactgctgcgggtccagtgtccgccatcttcagggttgcacagaatcctccaagatactttgcagccttttttccccctggtccctctcccgttttgattttgtgagagcgtaggtcatcctcgtaaacatatcagtagacctgg

SEQ ID NO: 186853 - DNA, 6677 bp, Homo sapiens
  Payload ID: 16789
  Gene Symbol: SAMD4A
  Gene Name: sterile alpha motif domain containing 4A
  ENST ID: ENST00000631086
  CDS Start-End: 1269-2306
attcttcattcagttgtgtgccttgtgggggatttttaaaaagtcgtttttttttttaaagaaacatttccgtgctactgtctgtcatcgtctctggggaaatcagccagaaccaccggaacgtaactgaaaccagacaagagaggcaggagcccaggcagtacctgcagcgtccgggcaccagagccaccttggaacaggaacgcgtctccggccgcggggctgcggctccgccaaactttggggcgggcggggcgggctggggcgcccagggggctctgtagaccgagggcggccccctaaccatgatgtttcgcgaccaggtcggggtgctggcgggctggtttaagggctggaacgagtgcgagcagactgttgcgctgctgtcgctgctcaagcgcgtgagccagacccaggcccgcttcctccagctctgcctggagcactcgctggccgactgcgccgagctgcacgtcctcgaacgcgaggccaacagccccggaatcattaaccaatggcaacaggaatccaaggataaagtgatttccctcctgttaactcatctgcctttgctgaagccaggaaacctcgacgcgaaagtagaatatatgaaactgctgcccaaaatcctggctcactctattgaacacaaccagcacattgaggagagcaggcagctgctgtcctatgctttgatacatccagccacttcgttagaagaccgtagtgctttagccatgtggctgaatcacttggaggaccgcacgtcgaccagctttggtggccagaaccgaggccgctcagactctgtggattatggacagacacactactatcaccaaagacagaactctgatgacaagctcaatgggtggcagaactctcgggattctgggatttgcatcaatgcctccaactggcaggacaaaagcatggggtgtgagaatggccatgtgcccctctactcctcctcatctgtccccaccacaatcaatacgattggaaccagcacaagtacaaatgttccagcctggctgaaaagcctccgcctgcacaaatatgccgcgcttttctcccagatgacctatgaggagatgatggccctcaccgagtgccagctggaggcgcagaatgttaccaaaggtgcaagacacaaaattgtcatcagtattcagaagctcaaagaaagacaaaatctcctgaagtctttggaaagggacatcatcgaggggggcagcctgcgcatcccgctccaggaactgcaccagatgatcctgactccgatcaaggcctacagctccccgagcaccacccccgaggctcgccgccgggagccccaggccccgcgtcagccctcactgatgggccccgagagccagagccccgactgcaaagatggggccgcagccactggcgccacggccaccccctcggccggggccagcggggggctccagccgcaccagctgagcagctgcgatggggagctggccgtcgcccccctgccagagggggacctccccgggcagttcacacgcgtcatggggaaagtgtgcacacagctcttggtctccagacctgatgaggaaaatataagttcctatttacagctcatagacaagtgtctaattcatgaggcatttacagagacacagaaaaaaagattgttgtcatggaaacagcaggtgcagaagctctttcggtctttccctcggaaaacccttctagacatatcaggatatcgacagcaaagaaatcgaggctttgggcaatccaactccctcccgacggctggctctgtgggcggtggcatgggcagacggaacccgcgccagtaccagatcccctctcggaacgtcccttccgcccgcctgggcctcttgggcaccagtggattcgtcagctccaaccagcgcaacaccacagctacccccaccatcatgaaacaaggaagacagaacctgtggtttgccaaccccgggggcagcaatagcatgccaagccgcacccacagctcagtccagaggacccgctcgctgcccgtgcacacttccccacagaacatgctgatgttccagcagccaggttcccaagttcacagtggactgtgtttaacagaccttagaggttggttgagcctgagtggagccccttccatgccagcgctgacagtccccaagtcctcccagggagaattccagcttcccgtgaccgaacctgacatcaacaacaggctggagtcgttgtgcctcagtatgaccgaacacgccctgggagacggggttgaccggacctccaccatctagaagctgaagacgagagtgaccgcgctggccgtgaaatcgactgctgcgggtccagtgtccgccatcttcagggttgcacagaatcctccaagatactttgcagccttttttccccctggtccctctcccgttttgattttgtgagagcgtaggtcatcctcgtaaacatatcagtagacctggggttggttattttgtcatttgtttctgtcatgggatggtttggtgtgtggggtggggaggggtctctagggaattatgagactgggaggggggtggagggaatgcaggtagctctctggatggaacggggacaggggaaagagtactgccatgaaagagataggagacacataagaggacagcagaagccctggccctggggaggcttctcggaaggcctggcttcacaggcaggccacagaaggatatcgcgggcacgtgcacccaaagcaagatagtggcttcccttttatatccaatctaatcctgattggatgtccctgaggcccctgctggaaacagccataggagagggcccatggcagtaggggaaagaaggaagaaattccctgcaacaaaacttcagctaaactttgatttgtgtattgtttacataataattttaaagggtacataatgtgtaaagagtttggatagaacctctcttcatactatggttttcgtaaaggatctgttgttgttacggattcattttttccctctatttttataagagcagcagagttgtcttctcaaaacggctgccaagctctgcttcttgggaagatggatgcagtcatgtaggcctgagctgtccgtctttcaccgttaggtgggaggagcgtatgggtggacttgaaggacatggacgtggctggaatgagcacagcattgggtgagcgcacaaggatgaggacatcatgtgatcagttatgggtttgctcgcagggcacccagagattctcaaagaatcctgcagcctctttctgtgctggatttgcttgtcacggagaggcctccctccctttccaccccacccatggggcattatcctgtcactcccagccttgctccacacacacacaggtgggtacaagttccactggaggagaaaaggcaaggatggactttttccccttgtgagaggtttgatacccagaaaatgagctcaaaacctttacattagggttgcttgtaggaactggagcctggaggctgcatctacttcacctgtcactgctgagggagaggaggggagaaaggcccagcaacagcgtacagaggggtcagtcagcaagtccagagagcacatgcagggagatgtttggcccacaccgcacagccccgccatctccagtgggcgatgaaagatgtaggaaaggttgatttcaagatggaaatgacagcgctatccgcacagtatgaattagggatttgctgtgttagttgatttatccatccacacagaggggaggaaaaagacactcgttacttggtgggagattgagaaactgtggtacctaccacaaagtaatagctctgtttatgaagggcaagaaaggctacatttcagaatttgacacagtggagggtattagaggaaatcaaagaggagttgtgtggaaaatcaggttgtgtaaatgaaggtatgaatgctcagccagaggcaagatcagggagatggtacaaggcctgtttgttacatggatgagtcgggtgcctggttgtgtgtgtgtgtgtgtgtgtgtgtgtgtgtgtgtgaagtcagagttgaaattcagaagatcagactatggaaatcactgcccttttttttttaaaagctaatgaactacatacagacctaaaaggccttaatgaaatccgaacaattttcttttactttcaagatcaaaaacatgcacccaacccagccttggatgccaccaccaggtttttgaagcccttttgagtctaagaaggtgagaacaatgtaaccatagaaagcctttcgtgagcagagaaggcttgaatccacaatttcattcgctgaattaaaaaaaaaaggttcagacctctccttgggtgactaagttctaaagatgcaaatccatgtgcagaaagagatggcattttttagttgattatttttaaccaagtgccattaacattcatcccccacatcccttttctaaacaagcttagtgttacttggggaatgtgttgggatggacgatcacatgtaaggcaggaagaataggtcaaaggttgaaggccaaaggtaagaccagagggtttgcgaatgtgggtttgtaggatactgagaaagtgaataaagaggagaaaaaaccatggtattacacatcttgctgagaaaggaaagcattcggatctgctgcaaaaacacatatatccataaagactcatgttattcagaaaacagattgtgaacacaatcacattcgcatgaatcctttaaaaggaagaagaccttaaagtatctgcaaatctgaatttctatttattccttcactgaatatagaaacaatggttatctgattattagagatattattttggatatgttacttattaacttgctatggctggtaaccatgataaagtctgttattaataacaacataattctttttttaaagaagaaaagcttatttttcattgacagtgtatagatttatctacttagttgtgttttgctattagtgttttaattttttttttaagttgagtgtttgataaattttaagaccctgtccccaccttgttttgagtcctgtgttgactacaggtatatagctcaatttaaaaatcctaaagcaaaagaattttatttataaaagaatcaaacagttgcatgcatgaggctgtgaagtcagatatttagtaataaaagcagcagtgcctttttttgtatttacccattgacccccaccaaatgcaactgttttatattaagaaaatagtaacaattttaaaatctcagagtaaaatctatttcactacatgcttttccccccttgttctgatttaagcagtgtgtacttggcatctctacattgtcctagggacagtggtgttctacaatattatcatgtatgatgttttattggtgctttttattcatagtggcttcttaccagaaacagtaggaagaaacacatgaactgtgtacaagacatgaaacattgctgctgatatgttgttttttcacatgcttttgagttttcactttttaaacgagagccagcaagcaaaatagatgtggctgggtctgcctgtccgggcggctctttgcaccgagctctcaaatcctgtgtattgagggttcctttttggtactcaggattggagctacagctgggcccccctctctcccattcgtttgaagagacactgagggaaacaagggtttcttttgaggtgtccttggctgccttttacgggatgggagccttctccggatcttttgttcttctgcacctcttgtagctactgccggtgcaaggttgtagatgttattccccaggagcctgggcttgggggctgagctgggctgaatgcaaaagcatgcaaccagaaggcgggcaaggggaggaaaagcaggcctggcctcattggtcccctggagatgtctgtagcagtcagctccagcttgggcctggggaagcagcctgaccaaggcgctcaggtgtgcctgttacaagaagaacctgcagaaggataatttgcacatggagctgtgataacactaatgttgattttttttttttttacaagtcatcagagatgtttgcaaagtgagttttatttttttgtaattcctttatctttacttaaaggtgaatgtgtattcctctgggaggaataggaagaaaacaggaatgttaataatgtcgaacagaaaacttcctcccttattaatatataatcctcatgtatttatgcctaatgtaagctgacttttaaaaagctttcttttgttgcatgccctgtgcaggcatctgtattgtacatgcatgcctttcgtcctgttttcctgtataaagttagtgaacaaagaaatatttttgcctagttcatgttgccaagcaatgcatattttttaaatttgtcatatatggaaagagcatgtttgttacatgtaaaagctttactgatatacagatatactaatgtttgaagatgctgttctttgcaagtgtacagttttcaaatgttgttaccagtgaaacacccttgtggtttaaacttgctacaatgtatttattattcatttcctcccatgtaactaagaatcatggctatatttcatatcaacgttatattgaaagtgaagggaaatgattaatacaaggttttgtaacactg

SEQ ID NO: 186854 - DNA, 4519 bp, Homo sapiens
  Payload ID: 16790
  Gene Symbol: SAMD4B
  Gene Name: sterile alpha motif domain containing 4B
  Uniprot ID: Q5PRF9
  ENST ID: ENST00000314471
  CDS Start-End: 1036-3120
ggtcggtgcgggaggagggaggggagcttgcgggcccgagagggggcgacggcggcggcggtggcctgaggaggcccgagcggcggcggtggcggcgaaggccgaggcgtctaggtgtttttggaagagctgcagcctttgaagaaacatctcttgatgatgatatcatagactccttcctactgggcagatgaggcagaatggggcacagtagttccagcaaaaatccagagaggactatccttggccaggctttaccccatgtccacttctggagccaagaaagacagttccttctccaaggggaacccagggtgttgatactagaagatggaaatggatacagtaagatgctgccacagtgagatgcctcacccaggtctccctctgtcacttcagccaagcacatgggatagaaagtagcaggcggcctctggccctttaatggaagagggccatccagtcctctccagttaacatctagaccgaacacaaagcatccttctctcatccagaagacataggaaccctaccttcagggatgatttttttttaacagtgaaatcttaaaagtaactgtttcactaaagcctccagtatttactgaagactgtcagaatcatcctccatcactagatcttctccaccagtcatgttccctgagcagtggggtggcttgaaggtataaaccagagaggcccaagggagggatagttagcagacttctggtctttttctagtttgtgctcttctgttccaaggaccacaggattcttctcatcgcagtgctccaggcagccactaccaatcgattggagttagcctgtgaggaaactggagaggcgtggctggaccaagacctccccccatgtgagcaggcttcctcctcccccaacaaccgttgccaccacgcccagaaacgtccttaagccctggccctcaggggaaaggtaacaggaggccagagccgggaccatgtgacggcgctggccctcgccaccgccgtcccccgaccctggccccaggcccggcaccatgatgttccgagaccaggtgggcatcctcgctggctggttcaaaggctggaatgagtgtgagcagacagtggccctcctgtcacttctgaaacgggtcacccgtacccaggcccgcttcctgcagctctgcctggagcactcactggcggactgcaatgacatccacctgctggagtcggaggccaacagtgctgccatcgtcagccagtggcagcaggagtccaaagagaaggtggtgtccctcctgctgtcccaccttcccctgcttcagccaggcaacacagaggccaagtcggagtacatgaggctactgcagaaagtgctggcctactcaatcgagagcaatgctttcatcgaggagagtcgccagctgctttcctatgccctcatccacccagccaccacactggaggaccgcaacgcactggccctctggctgagccacctggaagagcggttggctagtggcttccgctcccggccagagccctcctaccattcacgtcaaggctcagatgagtgggggggccctgcagagctaggccctggggaggcagggccaggctggcaggacaagccaccccgggaaaatggacacgtgcccttccacccatccagctcagtgccgccagccatcaacagtattgggagcaatgcaaacacaggtctcccctgccaaatccaccctagcccactgaagcgctccatgtcactcatccctacaagcccccaggtccctggtgagtggccgagtccagaggagcttggggcccgggctgcttttaccacgcccgatcacgcacctctctcgccccagagcagcgtggcctcctctggcagtgagcagacagaggagcagggctccagccggaacaccttccaggaggatggcagtggcatgaaagatgtgccctcatggctcaagagcctccgtttgcacaagtatgcagccctcttctcacagatgagctacgaggagatgatgacactgactgagcagcacctggagtctcagaacgtcaccaaaggtgcccgccacaagatagccctgagcatccagaagctgcgtgagagacagagcgtcctcaagtccctagagaaggatgtgctggaaggcgggaacctacgaaacgctctgcaggagctgcagcagatcatcatcactcccatcaaggcctacagtgtcctccaggccaccgtggctgccgccaccaccacccctactgccaaggatggggccccgggggaaccaccgctgccaggtgctgagcctcccctagcccaccccggcacagacaaaggcaccgaggccaaggaccctccagctgtggagaactacccacctccaccagctccagctcccactgatggcagtgagcctgccccggctcccgtcgccgacggagacatccccagccagtttacacgggtgatgggcaaagtgtgcacccaactgctggtgtcccgaccagacgaggagaacatcaccagttacctccagctcatcgaaaagtgcctgactcatgaggctttcacggagacgcagaagaaacggctgctatcctggaaacagcaagtgctgaagctcctccggacattcccgcgcaaagccgcactagagatgcagaactaccggcagcagaaaggctgggcattcggctccaactcgctccccatagctggctctgtggggatgggagtggcccggcgtacccagcggcagttcccaatgcctccccgggccctcccacccggccggatgggcctcctgagcccctcgggcattgggggtgtctcccctcgacatgccctcaccagccccagccttggaggccagggccgacagaacctgtggtttgccaaccctggaggcagcaacagcatgcccagtcagagccgcagctctgtgcagcgcacccactcgctcccggtccactcgtcaccccaggccattctcatgttccctccagactgcccggttcctgggcctgacctggagatcaatcccactctggagtctctgtgtctgagcatgacagaacacgccttgggtgatgggacagacaaaacctccaccatctgacgggacccacagcccagcgcacccataggctccctgggcggcgggcgggggccaacccccaacgggcttctccgcgacagcgagagggtgggctggctcagctatatattctaatatttttctactctcttaccctcttaacttttgtttaacattggcacatgccttgctcactcccaggcccgtcgagggatctctgctgaggcccggggagttgggggcagccaggataaagggggcagggactggccagactgcctgcctctctcctttccttcctcatccccacctggtcccatcccacccctgcctcctccagaccgctgaccacctgcctctccccaagggagcagactccccagagacaaactgaccactaccttgtggagcctgctcagaaacatttgacatttggggtgacgcgcagggcagagaacctgccctccagaatgttattgagaggagctggggagaaggaaggggagcaaggagaggaagctctctctcctctccctgcttccccttcaccattccccacattctgcaaggacaggagccaccttcctctctctcacctcccctggccctgttcaccagaggttctctatgattaatttcttaggcctatttaagatacatatttatatagttcttaacggtttttctctgatcatttcctctcatttttagaatccccaggtctctctcagccaagacagtggcagggagagcctgaactttatgaggggagagggcagagccccctcctccagaccctcaagctctaacccattttcctccagccctggctacccggatgaagaggttggaggtgggcagccagggtagccagtgaggtcaggaagtctgttgccttaacgtccccttccccacgaacacacacccttctccgctcccaggtctggttggtgagacttgggagtcaggaataagggaaaggggattgtttggtttttgggtttttccctaagcccctcccttttctttcagcctttttccttcccccattatgtcatgacctcacttaagtggaacactatatcataacccagagattcgtcccagccccagagtccgacagactgtctggtccctattcctaatgaggggttgtgttggggcccaggtggagggaggggatttgggggttcagactgcggggaagccagggtctccctcttcaacgccctcctccccctcaacccaccttcccaactgggacattctcaagcttttcacaccgaaaaggaaaaaaaatgttatttttagatacattttatgaataacttttgttatgaatatggctggtaaccattgtgtatgttattaaagatacaaaatgttgggaaaaaaacaaaaaaaacaaaaaaaaaaaaaa

SEQ ID NO: 186855 - DNA, 555 bp, Homo sapiens
  Payload ID: 16790
  Gene Symbol: SAMD4B
  Gene Name: sterile alpha motif domain containing 4B
  ENST ID: ENST00000598605
  CDS Start-End: 1-283
ctcccctcgacatgccctcaccagccccagccttggaggccagggccgacagaacctgtggtttgccaaccctggaggcagcaacagcatgcccagtcagagccgcagctctgtgcagcgcacccactcgctcccggtccactcgtcaccccaggccattctcatgttccctccagactgcccggttcctgggcctgacctggagatcaatcccactctggagtctctgtgtctgagcatgacagaacacgccttgggtggtgagcatttcctctttccctgacccagctcccacctacccagcgtctctgcctctgaactgagcaactcagagtcatcctgaggggtccccaggggaggccagactccagggagggcctgactgggatgacaggctacctgagtgccttttcttgggcctccctccagctcctgatcttcctcccttcctccctttcttaccacagatgggacagacaaaacctccaccatctgacgggacccacagcccagcgcacccataggctccctgggcggcgggcgggggccaacccc

SEQ ID NO: 186856 - DNA, 672 bp, Homo sapiens
  Payload ID: 16790
  Gene Symbol: SAMD4B
  Gene Name: sterile alpha motif domain containing 4B
  ENST ID: ENST00000602243
  CDS Start-End: 448-672
ggggcggggccaggggcggtgacgcacggcgcggtgacgcagcgcgacggcggcggcggcggcggcggcggtggtcggtgcgggaggagggaggggagcttgcgggcccgagagggggcgacggcggcggcggtggcctgaggaggcccgagcggcggcggtggcggcgaaggccgaggcggattcttctcatcgcagtgctccaggcagccactaccaatcgattggagttagcctgtgaggaaactggagaggcgtggctggaccaagacctccccccatgtgagcaggcttcctcctcccccaacaaccgttgccaccacgcccagaaacgtccttaagccctggccctcaggggaaaggtaacaggaggccagagccgggaccatgtgacggcgctggccctcgccaccgccgtcccccgaccctggccccaggcccggcaccatgatgttccgagaccaggtgggcatcctcgctggctggttcaaaggctggaatgagtgtgagcagacagtggccctcctgtcacttctgaaacgggtcacccgtacccaggcccgcttcctgcagctctgcctggagcactcactggcggactgcaatgacatccacctgctggagtcggaggccaacagtgctgccatcgtcagccagtggcagcaggagtcc

SEQ ID NO: 186857 - DNA, 925 bp, Homo sapiens
  Payload ID: 16790
  Gene Symbol: SAMD4B
  Gene Name: sterile alpha motif domain containing 4B
  ENST ID: ENST00000599712
  CDS Start-End: 269-925
aggattcttctcatcgcagtgctccaggcagccactaccaatcgattggagttagcctgtgaggaaactggagaggcgtggctggaccaagacctccccccatgtgagcaggcttcctcctcccccaacaaccgttgccaccacgcccagaaacgtccttaagccctggccctcaggggaaaggtaacaggaggccagagccgggaccatgtgacggcgctggccctcgccaccgccgtcccccgaccctggccccaggcccggcaccatgatgttccgagaccaggtgggcatcctcgctggctggttcaaaggctggaatgagtgtgagcagacagtggccctcctgtcacttctgaaacgggtcacccgtacccaggcccgcttcctgcagctctgcctggagcactcactggcggactgcaatgacatccacctgctggagtcggaggccaacagtgctgccatcgtcagccagtggcagcaggagtccaaagagaaggtggtgtccctcctgctgtcccaccttcccctgcttcagccaggcaacacagaggccaagtcggagtacatgaggctactgcagaaagtgctggcctactcaatcgagagcaatgctttcatcgaggagagtcgccagctgctttcctatgccctcatccacccagccaccacactggaggaccgcaacgcactggccctctggctgagccacctggaagagcggttggctagtggcttccgctcccggccagagccctcctaccattcacgtcaaggctcagatgagtgggggggccctgcagagctaggccctggggaggcagggccaggctggcaggacaagccaccccgggaaaatggacacgtgcccttccacccatccagctcagtgccgccagccatcaacagtattgggagcaat

SEQ ID NO: 186858 - DNA, 2877 bp, Homo sapiens
  Payload ID: 16790
  Gene Symbol: SAMD4B
  Gene Name: sterile alpha motif domain containing 4B
  ENST ID: ENST00000598913
  CDS Start-End: 341-2419
acggcggcggcggcggcggcggcggtggtcggtgcgggaggagggaggggagcttgcgggcccgagagggggcgacggcggcggcggtggcctgaggaggcccgagcggcggcggtggcggcgaaggccgaggcggaaactggagaggcgtggctggaccaagacctccccccatgtgagcaggcttcctcctcccccaacaaccgttgccaccacgcccagaaacgtccttaagccctggccctcaggggaaaggtaacaggaggccagagccgggaccatgtgacggcgctggccctcgccaccgccgtcccccgaccctggccccaggcccggcaccatgatgttccgagaccaggtgggcatcctcgctggctggttcaaaggctggaatgagtgtgagcagacagtggccctcctgtcacttctgaaacgggtcacccgtacccaggcccgcttcctgcagctctgcctggagcactcactggcggactgcaatgacatccacctgctggagtcggaggccaacagtgctgccatcgtcagccagtggcagcaggagtccaaagagaaggtggtgtccctcctgctgtcccaccttcccctgcttcagccaggcaacacagaggccaagtcggagtacatgaggctactgcagaaagtgctggcctactcaatcgagagcaatgctttcatcgaggagagtcgccagctgctttcctatgccctcatccacccagccaccacactggaggaccgcaacgcactggccctctggctgagccacctggaagagcggttggctagtggcttccgctcccggccagagccctcctaccattcacgtcaaggctcagatgagtgggggggccctgcagagctaggccctggggaggcagggccaggctggcaggacaagccaccccgggaaaatggacacgtgcccttccacccatccagctcagtgccgccagccatcaacagtattgggagcaatgcaaacacaggtctcccctgccaaatccaccctagcccactgaagcgctccatgtcactcatccctacaagcccccaggtccctggtgagtggccgagtccagaggagcttggggcccgggctgcttttaccacgcccgatcacgcacctctctcgccccagagcagcgtggcctcctctggcagtgagcagacagaggagcagggctccagccggaacaccttccaggaggatggcagtggcatgaaagatgtgccctcatggctcaagagcctccgtttgcacaagtatgcagccctcttctcacagatgagctacgaggagatgatgacactgactgagcagcacctggagtctcagaacgtcaccaaaggtgcccgccacaagatagccctgagcatccagaagctgcgtgagagacagagcgtcctcaagtccctagagaaggatgtgctggaaggcgggaacctacgaaacgctctgcaggagctgcagcagatcatcatcactcccatcaaggcctacagtgtcctccaggccaccgtggctgccgccaccaccacccctactgccaaggatggggccccgggggaaccaccgctgccaggtgctgagcctcccctagcccaccccggcacagacaaaggcaccgaggccaaggaccctccagctgtggagaactacccacctccaccagctccagctcccactgatggcagtgagcctgccccggctcccgtcgccgacggagacatccccagccagtttacacgggtgatgggcaaagtgtgcacccaactgctggtgtcccgaccagacgaggagaacatcaccagttacctccagctcatcgaaaagtgcctgactcatgaggctttcacggagacgcagaagaaacggctgctatcctggaaacagcaagtgctgaagctcctccggacattcccgcgcaaagccgcactagagatgcagaactaccggcagcagaaaggctgggcattcggctccaactcgctccccatagctggctctgtggggatgggagtggcccggcgtacccagcggcagttcccaatgcctccccgggccctcccacccggccggatgggcctcctgagcccctcgggcattgggggtgtctcccctcgacatgccctcaccagccccagccttggaggccagggccgacagaacctgtggtttgccaaccctggaggcagcaacagcatgcccagtcagagccgcagctctgtgcagcgcacccactcgctcccggtccactcgtcaccccaggccattctcatgttccctccagactgcccggttcctgggcctgacctggagatcaatcccactctggagtctctgtgtctgagcatgacagaacacgccttgggtggcccgtcgagggatctctgctgaggcccggggagttgggggcagccaggataaagggggcagggactggccagactgcctgcctctctcctttccttcctcatccccacctggtcccatcccacccctgcctcctccagaccgctgaccacctgcctctccccaagggagcagactccccagagacaaactgaccactaccttgtggagcctgctcagaaacatttgacatttggggtgacgcgcagggcagagaacctgccctccagaatgttattgagaggagctggggagaaggaaggggagcaaggagaggaagctctctctcctctccctgcttccccttcaccattccccacattctgcaaggacaggagccaccttcctctctctcacctcccctggccctgttcaccagaggttctctatgattaatttcttaggcctatttaagatacatatttatatagttcttaacggtt

SEQ ID NO: 186859 - DNA, 144 bp, Homo sapiens
  Payload ID: 16790
  Gene Symbol: SAMD4B
  Gene Name: sterile alpha motif domain containing 4B
  ENST ID: ENST00000600018
  CDS Start-End: 1-144
gccatcaacagtattgggagcaatgcaaacacagatgtgccctcatggctcaagagcctccgtttgcacaagtatgcagccctcttctcacagatgagctacgaggagatgatgacactgactgagcagcacctggagtctcag

SEQ ID NO: 186860 - DNA, 1176 bp, Homo sapiens
  Payload ID: 16790
  Gene Symbol: SAMD4B
  Gene Name: sterile alpha motif domain containing 4B
  ENST ID: ENST00000596368
  CDS Start-End: 79-1056
gaggccagagccgggaccatgtgacggcgctggccctcgccaccgccgtcccccgaccctggccccaggcccggcaccatgatgttccgagaccaggtgggcatcctcgctggctggttcaaaggctggaatgagtgtgagcagacagtggccctcctgtcacttctgaaacgggtcacccgtacccaggcccgcttcctgcagctctgcctggagcactcactggcggactgcaatgacatccacctgctggagtcggaggccaacagtgctgccatcgtcagccagtggcagcaggagtccaaagagaaggtggtgtccctcctgctgtcccaccttcccctgcttcagccaggcaacacagaggccaagtcggagtacatgaggctactgcagaaagtgctggcctactcaatcgagagcaatgctttcatcgaggagagtcgccagctgctttcctatgccctcatccacccagccaccacactggaggaccgcaacgcactggccctctggctgagccacctggaagagcggttggctagtggcttccgctcccggccagagccctcctaccattcacgtcaaggctcagatgagtgggggggccctgcagagctaggccctggggaggcagggccaggctggcaggacaagccaccccgggaaaatggacacgtgcccttccacccatccagctcagtgccgccagccatcaacagtattgggagcaatgcaaacacaggtctcccctgccaaatccaccctagcccactgaagcgctccatgtcactcatccctacaagcccccaggtccctggtgagtggccgagtccagaggagcttggggcccgggctgcttttaccacgcccgatcacgcacctctctcgccccagagcagcgtggcctcctctggcagtgagcagacagaggagcagggctccagccggaacaccttccaggaggatggcagtggcatgaaagatgtgccctcatggctcaagagcctccgtttgcacaagtatgcagccctcttctcacagaatcagctttgagtaactgtacagtttttctcgctgttggagaagacttatttgttggagtttcacttgtttaatggtctgggcttattttggaaaaaaaaaaaacaaacaaaaaaaacgaattctgacctt

SEQ ID NO: 186861 - DNA, 2818 bp, Homo sapiens
  Payload ID: 16790
  Gene Symbol: SAMD4B
  Gene Name: sterile alpha motif domain containing 4B
  ENST ID: ENST00000614559
  CDS Start-End: 284-2275
gggcccgagagggggcgacggcggcggcggtggcctgaggaggcccgagcggcggcggtggcggcgaaggccgaggcggaaactggagaggcgtggctggaccaagacctccccccatgtgagcaggcttcctcctcccccaacaaccgttgccaccacgcccagaaacgtccttaagccctggccctcaggggaaaggtaacaggaggccagagccgggaccatgtgacggcgctggccctcgccaccgccgtcccccgaccctggccccaggcccggcaccatgatgttccgagaccaggtgggcatcctcgctggctggttcaaaggctggaatgagtgtgagcagacagtggccctcctgtcacttctgaaacgggtcacccgtacccaggcccgcttcctgcagctctgcctggagcactcactggcggactgcaatgacatccacctgctggagtcggaggccaacagtgctgccatcgtcagccagtggcagcaggagtccaaagagaaggtggtgtccctcctgctgtcccaccttcccctgcttcagccaggcaacacagaggccaagtcggagtacatgaggctactgcagaaagtgctggcctactcaatcgagagcaatgctttcatcgaggagagtcgccagctgctttcctatgccctcatccacccagccaccacactggaggaccgcaacgcactggccctctggctgagccacctggaagagcggttggctagtggcttccgctcccggccagagccctcctaccattcacgtcaaggctcagatgagtgggggggccctgcagagctaggccctggggaggcagggccaggctggcaggacaagccaccccgggaaaatggacacgtgcccttccacccatccagctcagtgccgccagccatcaacagtattgggagcaatgcaaacacaggtctcccctgccaaatccaccctagcccactgaagcgctccatgtcactcatccctacaagcccccaggtccctggtgagtggccgagtccagaggagcttggggcccgggctgcttttaccacgcccgatcacgcacctctctcgccccagagcagcgtggcctcctctggcagtgagcagacagaggagcagggctccagccggaacaccttccaggaggatggcagtggcatgaaagatgtgccctcatggctcaagagcctccgtttgcacaagtatgcagccctcttctcacagatgagctacgaggagatgatgacactgactgagcagcacctggagtctcagaacgtcaccaaaggtgcccgccacaagatagccctgagcatccagaagctgcgtgagagacagagcgtcctcaagtccctagagaaggatgtgctggaaggcgggaacctacgaaacgctctgcaggagctgcagcagatcatcatcactcccatcaaggcctacagtgtcctccaggccaccgtggctgccgccaccaccacccctactgccaaggatggggccccgggggaaccaccgctgccaggtgctgagcctcccctagcccaccccggcacagacaaaggcaccgaggccaaggaccctccagctgtggagaactacccacctccaccagctccagctcccactgatggcagtgagcctgccccggctcccgtcgccgacggagacatccccagccagtttacacgggtgatgggcaaagtgtgcacccaactgctggtgtcccgaccagacgaggagaacatcaccagttacctccagctcatcgaaaagtgcctgactcatgaggctttcacggagacgcagaagaaacggctgctatcctggaaacagcaagtgctgaagctcctccggacattcccgcgcaaagccgcactagagatgcagaactaccggcagcagaaaggctgggcattcggctccaactcgctccccatagctggctctgtggggatgggagtggcccggcgtacccagcggcagttcccaatgcctccccgggccctcccacccggccggatgggcctcctgagcccctcgggcattggggtgtctcccctcacatgccctcaccagccccagccttggaggccagggccgacagaacctgtggtttgccaaccctggaggcagcaacagcatgcccagtcagagccgcagctctgtgcagcgcacccactcgctcccggtccactcgtcaccccaggccattctcatgttccctccagactgcccggttcctgggcctgacctggagatcaatcccactctggagtctctgtgtctgagcatgacagaacacgccttgggtggcccgtcgagggatctctgctgaggcccggggagttgggggcagccaggataaagggggcagggactggccagactgcctgcctctctcctttccttcctcatccccacctggtcccatcccacccctgcctcctccagaccgctgaccacctgcctctccccaagggagcagactccccagagacaaactgaccactaccttgtggagcctgctcagaaacatttgacatttggggtgacgcgcagggcagagaacctgccctccagaatgttattgagaggagctggggagaaggaaggggagcaaggagaggaagctctctctcctctccctgcttccccttcaccattccccacattctgcaaggacaggagccaccttcctctctctcacctcccctggccctgttcaccagaggttctctatgattaatttcttaggcctatttaagatacatatttatatagttcttaacggtt

SEQ ID NO: 186862 - DNA, 3662 bp, Homo sapiens
  Payload ID: 16790
  Gene Symbol: SAMD4B
  Gene Name: sterile alpha motif domain containing 4B
  ENST ID: ENST00000611159
  CDS Start-End: 212-2203
tttcaggaaactggagaggcgtggctggaccaagacctccccccatgtgagcaggcttcctcctcccccaacaaccgttgccaccacgcccagaaacgtccttaagccctggccctcaggggaaaggtaacaggaggccagagccgggaccatgtgacggcgctggccctcgccaccgccgtcccccgaccctggccccaggcccggcaccatgatgttccgagaccaggtgggcatcctcgctggctggttcaaaggctggaatgagtgtgagcagacagtggccctcctgtcacttctgaaacgggtcacccgtacccaggcccgcttcctgcagctctgcctggagcactcactggcggactgcaatgacatccacctgctggagtcggaggccaacagtgctgccatcgtcagccagtggcagcaggagtccaaagagaaggtggtgtccctcctgctgtcccaccttcccctgcttcagccaggcaacacagaggccaagtcggagtacatgaggctactgcagaaagtgctggcctactcaatcgagagcaatgctttcatcgaggagagtcgccagctgctttcctatgccctcatccacccagccaccacactggaggaccgcaacgcactggccctctggctgagccacctggaagagcggttggctagtggcttccgctcccggccagagccctcctaccattcacgtcaaggctcagatgagtgggggggccctgcagagctaggccctggggaggcagggccaggctggcaggacaagccaccccgggaaaatggacacgtgcccttccacccatccagctcagtgccgccagccatcaacagtattgggagcaatgcaaacacaggtctcccctgccaaatccaccctagcccactgaagcgctccatgtcactcatccctacaagcccccaggtccctggtgagtggccgagtccagaggagcttggggcccgggctgcttttaccacgcccgatcacgcacctctctcgccccagagcagcgtggcctcctctggcagtgagcagacagaggagcagggctccagccggaacaccttccaggaggatggcagtggcatgaaagatgtgccctcatggctcaagagcctccgtttgcacaagtatgcagccctcttctcacagatgagctacgaggagatgatgacactgactgagcagcacctggagtctcagaacgtcaccaaaggtgcccgccacaagatagccctgagcatccagaagctgcgtgagagacagagcgtcctcaagtccctagagaaggatgtgctggaaggcgggaacctacgaaacgctctgcaggagctgcagcagatcatcatcactcccatcaaggcctacagtgtcctccaggccaccgtggctgccgccaccaccacccctactgccaaggatggggccccgggggaaccaccgctgccaggtgctgagcctcccctagcccaccccggcacagacaaaggcaccgaggccaaggaccctccagctgtggagaactacccacctccaccagctccagctcccactgatggcagtgagcctgccccggctcccgtcgccgacggagacatccccagccagtttacacgggtgatgggcaaagtgtgcacccaactgctggtgtcccgaccagacgaggagaacatcaccagttacctccagctcatcgaaaagtgcctgactcatgaggctttcacggagacgcagaagaaacggctgctatcctggaaacagcaagtgctgaagctcctccggacattcccgcgcaaagccgcactagagatgcagaactaccggcagcagaaaggctgggcattcggctccaactcgctccccatagctggctctgtggggatgggagtggcccggcgtacccagcggcagttcccaatgcctccccgggccctcccacccggccggatgggcctcctgagcccctcgggcattgggggtgtctcccctcgacatgccctcaccccccagccttggaggccagggccgacagaacctgtggtttgccaaccctggaggcagcaacagcatgcccagtcagagccgcagctctgtgcagcgcacccactcgctcccggtccactcgtcaccccaggccattctcatgttccctccagactgcccggttcctgggcctgacctggagatcaatcccactctggagtctctgtgtctgagcatgacagaacacgccttgggtgatgggacagacaaaacctccaccatctgacgggacccacagcccagcgcacccataggctccctgggcggcgggcgggggccaacccccaacgggcttctccgcgacagcgagagggtgggctggctcagctatatattctaatatttttctactctcttaccctcttaacttttgtttaacattggcacatgccttgctcactcccaggcccgtcgagggatctctgctgaggcccggggagttgggggcagccaggataaagggggcagggactggccagactgcctgcctctctcctttccttcctcatccccacctggtcccatcccacccctgcctcctccagaccgctgaccacctgcctctccccaagggagcagactccccagagacaaactgaccactaccttgtggagcctgctcagaaacatttgacatttggggtgacgcgcagggcagagaacctgccctccagaatgttattgagaggagctggggagaaggaaggggagcaaggagaggaagctctctctcctctccctgcttccccttcaccattccccacattctgcaaggacaggagccaccttcctctctctcacctcccctggccctgttcaccagaggttctctatgattaatttcttaggcctatttaagatacatatttatatagttcttaacggtttttctctgatcatttcctctcatttttagaatccccaggtctctctcagccaagacagtggcagggagagcctgaactttatgaggggagagggcagagccccctcctccagaccctcaagctctaacccattttcctccagccctggctacccggatgaagaggttggaggtgggcagccagggtagccagtgaggtcaggaagtctgttgccttaacgtccccttccccacgaacacacacccttctccgctcccaggtctggttggtgagacttgggagtcaggaataagggaaaggggattgtttggtttttgggtttttccctaagcccctcccttttctttcagcctttttccttcccccattatgtcatgacctcacttaagtggaacactatatcataacccagagattcgtcccagccccagagtccgacagactgtctggtccctattcctaatgaggggttgtgttggggcccaggtggagggaggggatttgggggttcagactgcggggaagccagggtctccctcttcaacgccctcctccccctcaacccaccttcccaactgggacattctcaagcttttcacaccgaaaaggaaaaaaaatgttatttttagatacattttatgaataacttttgttatgaatatggctggtaaccattgtgtatgttattaaagatacaaaatgttggg

SEQ ID NO: 186863 - DNA, 3664 bp, Homo sapiens
  Payload ID: 16790
  Gene Symbol: SAMD4B
  Gene Name: sterile alpha motif domain containing 4B
  Uniprot ID: Q5PRF9
  ENST ID: ENST00000610417
  CDS Start-End: 212-2296
tttcaggaaactggagaggcgtggctggaccaagacctccccccatgtgagcaggcttcctcctcccccaacaaccgttgccaccacgcccagaaacgtccttaagccctggccctcaggggaaaggtaacaggaggccagagccgggaccatgtgacggcgctggccctcgccaccgccgtcccccgaccctggccccaggcccggcaccatgatgttccgagaccaggtgggcatcctcgctggctggttcaaaggctggaatgagtgtgagcagacagtggccctcctgtcacttctgaaacgggtcacccgtacccaggcccgcttcctgcagctctgcctggagcactcactggcggactgcaatgacatccacctgctggagtcggaggccaacagtgctgccatcgtcagccagtggcagcaggagtccaaagagaaggtggtgtccctcctgctgtcccaccttcccctgcttcagccaggcaacacagaggccaagtcggagtacatgaggctactgcagaaagtgctggcctactcaatcgagagcaatgctttcatcgaggagagtcgccagctgctttcctatgccctcatccacccagccaccacactggaggaccgcaacgcactggccctctggctgagccacctggaagagcggttggctagtggcttccgctcccggccagagccctcctaccattcacgtcaaggctcagatgagtgggggggccctgcagagctaggccctggggaggcagggccaggctggcaggacaagccaccccgggaaaatggacacgtgcccttccacccatccagctcagtgccgccagccatcaacagtattgggagcaatgcaaacacaggtctcccctgccaaatccaccctagcccactgaagcgctccatgtcactcatccctacaagcccccaggtccctggtgagtggccgagtccagaggagcttggggcccgggctgcttttaccacgcccgatcacgcacctctctcgccccagagcagcgtggcctcctctggcagtgagcagacagaggagcagggctccagccggaacaccttccaggaggatggcagtggcatgaaagatgtgccctcatggctcaagagcctccgtttgcacaagtatgcagccctcttctcacagatgagctacgaggagatgatgacactgactgagcagcacctggagtctcagaacgtcaccaaaggtgcccgccacaagatagccctgagcatccagaagctgcgtgagagacagagcgtcctcaagtccctagagaaggatgtgctggaaggcgggaacctacgaaacgctctgcaggagctgcagcagatcatcatcactcccatcaaggcctacagtgtcctccaggccaccgtggctgccgccaccaccacccctactgccaaggatggggccccgggggaaccaccgctgccaggtgctgagcctcccctagcccaccccggcacagacaaaggcaccgaggccaaggaccctccagctgtggagaactacccacctccaccagctccagctcccactgatggcagtgagcctgccccggctcccgtcgccgacggagacatccccagccagtttacacgggtgatgggcaaagtgtgcacccaactgctggtgtcccgaccagacgaggagaacatcaccagttacctccagctcatcgaaaagtgcctgactcatgaggctttcacggagacgcagaagaaacggctgctatcctggaaacagcaagtgctgaagctcctccggacattcccgcgcaaagccgcactagagatgcagaactaccggcagcagaaaggctgggcattcggctccaactcgctccccatagctggctctgtggggatgggagtggcccggcgtacccagcggcagttcccaatgcctccccgggccctcccacccggccggatgggcctcctgagcccctcgggcattgggggtgtctcccctcgacatgccctcaccagccccagccttggaggccagggccgacagaacctgtggtttgccaaccctggaggcagcaacagcatgcccagtcagagccgcagctctgtgcagcgcacccactcgctcccggtccactcgtcaccccaggccattctcatgttccctccagactgcccggttcctgggcctgacctggagatcaatcccactctggagtctctgtgtctgagcatgacagaacacgccttgggtgatgggacagacaaaacctccaccatctgacgggacccacagcccagcgcacccataggctccctgggcggcgggcgggggccaacccccaacgggcttctccgcgacagcgagagggtgggctggctcagctatatattctaatatttttctactctcttaccctcttaacttttgtttaacattggcacatgccttgctcactcccaggcccgtcgagggatctctgctgaggcccggggagttgggggcagccaggataaagggggcagggactggccagactgcctgcctctctcctttccttcctcatccccacctggtcccatcccacccctgcctcctccagaccgctgaccacctgcctctccccaagggagcagactccccagagacaaactgaccactaccttgtggagcctgctcagaaacatttgacatttggggtgacgcgcagggcagagaacctgccctccagaatgttattgagaggagctggggagaaggaaggggagcaaggagaggaagctctctctcctctccctgcttccccttcaccattccccacattctgcaaggacaggagccaccttcctctctctcacctcccctggccctgttcaccagaggttctctatgattaatttcttaggcctatttaagatacatatttatatagttcttaacggtttttctctgatcatttcctctcatttttagaatccccaggtctctctcagccaagacagtggcagggagagcctgaactttatgaggggagagggcagagccccctcctccagaccctcaagctctaacccattttcctccagccctggctacccggatgaagaggttggaggtgggcagccagggtagccagtgaggtcaggaagtctgttgccttaacgtccccttccccacgaacacacacccttctccgctcccaggtctggttggtgagacttgggagtcaggaataagggaaaggggattgtttggtttttgggtttttccctaagcccctcccttttctttcagcctttttccttcccccattatgtcatgacctcacttaagtggaacactatatcataacccagagattcgtcccagccccagagtccgacagactgtctggtccctattcctaatgaggggttgtgttggggcccaggtggagggaggggatttgggggttcagactgcggggaagccagggtctccctcttcaacgccctcctccccctcaacccaccttcccaactgggacattctcaagcttttcacaccgaaaaggaaaaaaaatgttatttttagatacattttatgaataacttttgttatgaatatggctggtaaccattgtgtatgttattaaagatacaaaatgttggg

SEQ ID NO: 186864 - DNA, 6089 bp, Homo sapiens
  Payload ID: 16791
  Gene Symbol: SAMD5
  Gene Name: sterile alpha motif domain containing 5
  Uniprot ID: Q5TGI4
  ENST ID: ENST00000367474
  CDS Start-End: 3-524
ccatgtgcaccaacatagtttacgagtggctcaaagcgctgcagcttccgcagtacgcggagtccttcgtggataacggctacgatgacctggaggtgtgcaagcagatcggggacccggacctggatgccatcggggtgctggcgcccgcgcaccgccgccgtatcctggaggccgtgcgccggctgcgggagcaggacgccaacgccgccggcctctacttcacgcttgagccgcagccggcgccccccgggccgcccgccgacgccgtccccaccggccgccggggggagccgtgcggcggcccggcccagggcacccgcggggactctcgcggccacacgaccgccccccgcagcagggagctggtgagctaccccaaactgaagctgaagatcatgatcagggataagctcgtccgtgacggcatccacctgagcaagcccccgtactcccgcaaggtcccaatggctggcatcctagagtacttaatgaattggccgaagtcatcacagagccgctagatatcatttttgagacctcgtggaggactgatgaggtgcctgaagactggaaaagggcatatttagaaccttctttcaaaaagggaaatggatgatgaccctggaaatactcatcagcttaactttttgcttggacaaattctggaataatcaacttagtaaactgggtaactggcttataacagctagaaataaggcagtgaactatcacgcataaagaagtattgagttcatttttttaagaagatatcatgatgagatacagtcttatgcatttcttggcattctcccttccattcttaatgaaaacagatgaggttggctaaggcatttgagtcataacttagtttaagtacaatataacaaaaaggtagatttctgacagtaagtagtaattatattatttccaaatttgcttttaacttgagaacagtagctttaatttttatattcaagcatacattctacttcatttcatataggaccatgtttttataagataagatacataattctatgtagaatagtttggtgaaggaattcttattttaaggtgcttttatatagttattttgtatattggtacaatgttaaaggtgatgaattaaggaacatcaccaagagaggacaatttcttctaacttctctttttaaatttaatctggctgaggtttagtattaggactaatacaagtgtcttgctctgacatgcatcaagcaagagctagctattttacttcatagctagtttcttgcactctgtggagactgccagggccgcagctcacagcctgttctgagctgcagtgctttatcccaccttgctctccaggcttctgacttcaggcctgtgggggccgggaggtgggcagcggcagtggcctgaggagccctgtagaactacggctgaaaaagaaagtagattgaggtggggggaggaaattaacaggaatctagagtttttctaattcttatcgtcttatcgttcttgtgtttggatgctggtagtttttttttttttagacagagtctcgctctgtcacccaggctggagtgtagtggcacaatcttggctcacagtgactttcgcctcccaggttcaaggaattctcctgcctcggcctcttggtagctgggattacaggcacgcatcaccacacccagctaatttttttgtatttttagtagagatggggttttaccatgttggccaggctgttcttgaactcctggcctcaaatgatccactcgccgtggcctccagtagcgctgggattacaggcgtgagccatcacacccggcctggatgctggtagttttattttctgcttagaaaacgcaaccatgttgatgggaccaaaaacttagttgaaagaagccatggcaaaagatgttgacgtacaactggctcctgaggctgtcaattgtttagagctcccaagtagtactgcattacggaatctactacttagaagaatgtacaagatgtaagttcccatcggcaccgtcatggtaagaagaataagaaactctcaaaggaaaagaaacttacattcactttttcctggtccattttggttcctaagaatagataggccattaagaaggatattaggtttctaaggacaattttaacacaatactgctttaaaaatctgaagtttaaatagtttagctatttctgtaggttaattcaggcactgactaaaatcagtctcattatcatatacaaatgtaaggaagttaaattttaaaagcatgtataggttgtccttaaattatacaaaagcttttagtttcatcaggattatattccagttaacctttcatcttttttttttttccaaatgaactagggtctttaaaattcctaagtagattcttttgagtggtaggggagtctgtatagattacagatataatttattgtgataacaaatggcttcctgtttgacctcatttccaggtgtcgcatccgtggctgatttatttcacagatgtacatttgcatgtacttgttgaactttgctaggaaggactcaatttttgaaaaatctgttattttcactgtgggccttatgaggcaatctactgcaatggaaaaagggttccttggtcatttcaagttttattttctattagagtaatatctaacttcaattattttgccaggtttaaaccttctctctgtgtctgtggttagaatttgaaaataacaatgctctgcttaaagtaagagtcacagtcagcaaaaaaagccaatggattttaaaaagacatcttagttaaagctagaggaagaaaacttcaaataagcaaagaagtattgaaggatgcccacgaattcctttgcattaaaatcaagatgaggtaagaggtagaatataagagaaagggattatttttaccatgaattgtatctggggacagttagtcttagaaggagtaattttttcagcgtttttcctctgtatctaaacaccaataatatacttaatttttgaatataaaagaagtagcaattgactaagaataaatatgttataaaaactaggggattatcttgatttacatttcctagagtattaaaagagattaattacagactttcacttgataatattgaggagtctggagggtcatagcaaaattttctttagttcatcttaaaatttagggaggtaaaaaaagattttattcacataaaagatttcttggcatagggaaggcgtaatgttaagggcttcttccttacccaagtgggagctgaaccagtaattgtggggaaaactgaatttatagcaacaaaggatagtagtttctcaactgggagcatacgagcaatttctcagttcagagatatttatagcatcttggtgttatgcaataaacaatgacaacaacaagcattgagctttcactttggagttactcagatctgagtttaaattctaaaattattctagtagtattttcctgcggtgaatctgttaaggatgtaagctatagtgtagcttggggaatcatcttgaacagttatgaaactcattaaagcttcttttcccttgtctgtaaaatgggaaaaataaatacctctatagctcttaagaggcttaagagttctatggcttacacccacatacagtccttggctcagtgctaggcatgtagcaggtgctgactgcctctctcccttcccttctttactctcagttgtcttatttcttcttatgcagaagagattaccttaaagctgactagaaaactcagacataaattgacatttccttatcattgcctgaaacccactgaataagtcccctttgatttctctcaggaaggataaaaaaggctacagtacctgctcataggagttcagtaaatgtttattgattgaatgaaaagaatttgatttaaggaaacaataacactccatcctgggcaacagagcaagatcccgtctcaaaacaaaacaaaacaaaacaaaacagcaaattcataaaggccagcagttttcaagtctggggaaataggcacatggacagattatatgaaggtatttcattagctttcttctctttatggcagcttcagattgatgaatttgaggtacaaatgagtgagtgacatatgtatattttcctctgattttatgactgatttacaaattaggagtgcaaatgggctgttccccgatagcatcttctgggaagaatccaaccaagatacaaagcagatgatggtggatcggcaaactcttttctatgaaaagaaaaaccagatataccagggactggaaagcacctgcttgaaaattgatatgagcatgtctgaatttttcccttataagagcctgagtattgtaacaggtctcttgcacagggggttgaaaaataaaaaaagaagttaacataattaaaatgcttggacaaaacatttgctttatatagattcttacaagtaatatttgattaggtatcaaaataggtttaggcaggtggaagttctgaatttcaaggcaaataaggcatgaagggtggaacattgcatctagggaaaataagagaaataagtgaaagtctgaccctacattgccaattctcagaccaagtacaaagtattaggaattttttatatcagctgacatcttgtgcttacagtaaagccatatagatgcacacatagtgactttattaaatcaaatgagttgtgcagagcagagcaaatctattaggctttctcttttagagttttctaattttactcttattagctccctcagttgtcatcaattacatattcctacatcagatattttacactatcagattctttgattaaaaaatcatcttcagctttacattattaatctctgaggacataaaatcaaataactttctagtccatgatcattaatccctactattttagatatttccataaaaggcttaaagggaaaaaaaaatggtaggtagttcagaaaaaaatggctgggcacggtggctcacgcctgtaatcccagcactttgggaggccggggtgggcagatcatttgaggtcaggagtttgagaccagcctggccaacatggtgaaaccctgtgtctactaaaaatacaaaaaaaattagctgagtgtggtggtgtgcgcctgtaatcccagctactaaggcaggagaatggcttgaacccaggaggtggaggtcgcagtgagctgagatcgcgccagtgcgctccagcctgggcaacagagtgagactctgtctaaaaaaaaaaaaaaaagaaaagaaaaaagaaaaattgaagaacataacttttctacttatgaaatagataattttttaaaattgtttaaactcctggaaattaagtgttattttttattactgcagttgagagataccttttcagaggaaaacaagaggctaaattccatgttaagagctaagtagtatttttttcttaacaattttgccaaaatttcttctactggaccaaaaggaaataaatctacaataaatctactttctaaatattatttaagatgggaaatgtcttttataggtatattctgtataatacccttaattagatgaattatcccttatcattccaaaaatgaaatgctgtgttaaatatctccagggcaaagtggtatgttgactgggacaaacgttagaaattgtattgttcattgcacttgttgccctgttccccaagcttgtcaatgtttagagatactattcgggttgctaaagccattattcatagaaaatttctgcccctacagaagtgtgtgcatgggccttggaaaatctacatgtgtatatctgagtagcgaagcacagattcactctaattgaaagcagcagtttggttttgtaaatgtaattgcaattgacactttcttttccctttcagttattattttttttaaaggacgttatgagaaggcactatgaaaagcctaattggaatagcattatgaaccatgtaatgcatgcccatgcacactgtgatttgcaaacatatgtccgctcttcaataaatgttacggctttcacagcg

SEQ ID NO: 186865 - DNA, 393 bp, Homo sapiens
  Payload ID: 16791
  Gene Symbol: SAMD5
  Gene Name: sterile alpha motif domain containing 5
  ENST ID: ENST00000566741
  CDS Start-End: 1-294
ggcggcccggcccagggcacccgcggggactctcgcggccacacgaccgccccccgcagcagggagctggtgagctaccccaaactgaagctgaagatcatgatcagggataagctcgtccgtgacggcatccacctgagcaagcccccgtactcccgcaaggtattattatgccgctaccttcaagaagtaatttgcgtgctgtttattggagctgtgaatttaatcatctcaatcccacgctattacaggatgactataagaagatgtattgacatttctttggacacataattttgcctccattgtgtgttgttttgccagaatactgaaggcagtgtttgtatgatggcacatccaaataaaaagcaggtcctccttttgggacagtga

SEQ ID NO: 186866 - DNA, 2376 bp, Homo sapiens
  Payload ID: 16792
  Gene Symbol: SAMD7
  Gene Name: sterile alpha motif domain containing 7
  Uniprot ID: Q7Z3H4
  ENST ID: ENST00000335556
  CDS Start-End: 367-1707
gggcttaacatcttttagcctatctgtagaggatatcagagggcaaagtttctgtcatgaaataggactaatcaacttagttgaatttgtatttaaagcaaggttaaactgaattaagaccatttttgaaagaattgtcagatgtacctttcaacccgcagccagagaagcttctgcagttgaaggccagaaagtctttgtatggttcttccatctgcaatatcaaagacaagaagtcttcatagaggatggcctcctttggggattccaaagtaagacaatctcatctccttttggtgattcatctccacggcttttcctaaagaactccattagtggcgagagatattgaagacaaacccggtgatggctgtgaaccctttattgacaccaacagggcagcagacaatcccactgatcccctcaccatttgggcctccaactgtggacagagatgtattgccttccaccgtagctccaactgacccaagacagttttgcgttccttcccaatttggatcctctgttctaccaaacacaaatatggcaaatgtgttgtccagtcggatctacccaggttggggcattttaccacctgaatccataaaggcagtggccagaaggaatgaaatgattcaacggcatcatactgccaggacagaaatggaaatgtatgctatttaccagcaaaggagaatggaaaaaattaatcccaagggactagcaggcctagggatacccttcctctatggctccagtgtcccagctgcccccgctgcctaccatggcaggagcatgctccctgccggtgacctgcattttcacagaagcaccctcagaaaccttcagggaaaccccatgctagcggcaactgcaccacactttgaggagagctgggggcagagatgtcgtcgactcaggaaaaatacagggaatcaaaaagctctagacagtgatgctgagagttccaaaagtcaagcagaagaaaaaatcctaggtcagactcatgcagttccctatgaagaggatcattatgcaaaagacccagacattgaagcacccagcaaccagaagtcaagtgaaacgaatgaaaagccaacgacagctcttgccaacacctgtggagagctcgagcccacccataggaaaccctgggggtctcacaccactaccctgaaagcaaaggcctgggacgatgggaaagaggaggcttcggagcagatttttgcaacctgtgatgaaaagaatggggtttgccctccagttcctcgaccatctctgccaggaacacatgcactggttacaattggggggaatctttctttggatgaagatattcagaagtggaccgtggatgatgtgcacagcttcattcgcagccttccaggttgttcagactatgctcaggtatttaaagatcatgcaattgatggagaaactttgccattactcacagaagagcatcttcgaggcactatgggattaaagctagggccggcactaaaaattcagtcacaggtatctcagcatgtgggaagtatgttctacaagaaaactctttcatttcctataagacaagcatttgatcaaccagcagatacatcccctcttctggatcctaattcctggagtgatacaatgaacattttttgtccccaggatacaataattcctaaaggaattgagcgaggtagtatgagaaactaaaagccctcaaggaggaagaatagtcttagccagttttccaaagagcctaggatattacaaaggatgtgtgaggatttcccagtactggatggagaatgagaagagaaagtcagcctttctggggctttcatggaggagacttgcccaaggggcttccctgccagggctgaatgaccccagcaccaaatgactggagacgcatccttaggagcaaatgctaatgaaggggagatttacaaacatcaagaaagctgcagatggatgtttccatgaagaaatctctgaagaaaccaaaagagctgaaactgaaaaaagagctccctcccttttttcactcattttccattcccaaaccctgaaagagataaaggcaacccaatgaaaccacagagaggcagaagagaacgggcagaagtacagaacagaaatggagaagctgaccacgactccatctcttctcattccagatttccagcgtgaagcaggcccaagctagggaaggtgagaagctttaaccttaaattttcgagttttggccaggcgcggtggctcacggctgtaatcccaacactttgggagtctgaggcgggcggatcatgaggtcaggagattaagaccagcttggccaacatggtgaaaccccgtctctactaaaaatacaaaaaaaaa

SEQ ID NO: 186867 - DNA, 2399 bp, Homo sapiens
  Payload ID: 16792
  Gene Symbol: SAMD7
  Gene Name: sterile alpha motif domain containing 7
  Uniprot ID: Q7Z3H4
  ENST ID: ENST00000428432
  CDS Start-End: 390-1730
gggcttaacatcttttagcctatctgtagaggatatcagagggcaaagtttctgtcatgaaataggactaatcaacttagttgaatttgtatttaaagcaaggttaaactgaattaagaccatttttgaaagaattgtcagatgtacctttcaacccgcagccagagaagcttctgcagttgaaggccagaaagtctttgtatggttcttccatctgcaatatcaaagacaagaagtcttcatagaggatggcctcctttggggattccaaagtaagacaatctcatctccttttggtgattcatctccacggcttttcctaaaggtaacatgtaagaggaagaggtgaactccattagtggcgagagatattgaagacaaacccggtgatggctgtgaaccctttattgacaccaacagggcagcagacaatcccactgatcccctcaccatttgggcctccaactgtggacagagatgtattgccttccaccgtagctccaactgacccaagacagttttgcgttccttcccaatttggatcctctgttctaccaaacacaaatatggcaaatgtgttgtccagtcggatctacccaggttggggcattttaccacctgaatccataaaggcagtggccagaaggaatgaaatgattcaacggcatcatactgccaggacagaaatggaaatgtatgctatttaccagcaaaggagaatggaaaaaattaatcccaagggactagcaggcctagggatacccttcctctatggctccagtgtcccagctgcccccgctgcctaccatggcaggagcatgctccctgccggtgacctgcattttcacagaagcaccctcagaaaccttcagggaaaccccatgctagcggcaactgcaccacactttgaggagagctgggggcagagatgtcgtcgactcaggaaaaatacagggaatcaaaaagctctagacagtgatgctgagagttccaaaagtcaagcagaagaaaaaatcctaggtcagactcatgcagttccctatgaagaggatcattatgcaaaagacccagacattgaagcacccagcaaccagaagtcaagtgaaacgaatgaaaagccaacgacagctcttgccaacacctgtggagagctcgagcccacccataggaaaccctgggggtctcacaccactaccctgaaagcaaaggcctgggacgatgggaaagaggaggcttcggagcagatttttgcaacctgtgatgaaaagaatggggtttgccctccagttcctcgaccatctctgccaggaacacatgcactggttacaattggggggaatctttctttggatgaagatattcagaagtggaccgtggatgatgtgcacagcttcattcgcagccttccaggttgttcagactatgctcaggtatttaaagatcatgcaattgatggagaaactttgccattactcacagaagagcatcttcgaggcactatgggattaaagctagggccggcactaaaaattcagtcacaggtatctcagcatgtgggaagtatgttctacaagaaaactctttcatttcctataagacaagcatttgatcaaccagcagatacatcccctcttctggatcctaattcctggagtgatacaatgaacattttttgtccccaggatacaataattcctaaaggaattgagcgaggtagtatgagaaactaaaagccctcaaggaggaagaatagtcttagccagttttccaaagagcctaggatattacaaaggatgtgtgaggatttcccagtactggatggagaatgagaagagaaagtcagcctttctggggctttcatggaggagacttgcccaaggggcttccctgccagggctgaatgaccccagcaccaaatgactggagacgcatccttaggagcaaatgctaatgaaggggagatttacaaacatcaagaaagctgcagatggatgtttccatgaagaaatctctgaagaaaccaaaagagctgaaactgaaaaaagagctccctcccttttttcactcattttccattcccaaaccctgaaagagataaaggcaacccaatgaaaccacagagaggcagaagagaacgggcagaagtacagaacagaaatggagaagctgaccacgactccatctcttctcattccagatttccagcgtgaagcaggcccaagctagggaaggtgagaagctttaaccttaaattttcgagttttggccaggcgcggtggctcacggctgtaatcccaacactttgggagtctgaggcgggcggatcatgaggtcaggagattaagaccagcttggccaacatggtgaaaccccgtctctactaaaaatacaaaaaaaaa

SEQ ID NO: 186868 - DNA, 1607 bp, Homo sapiens
  Payload ID: 16792
  Gene Symbol: SAMD7
  Gene Name: sterile alpha motif domain containing 7
  ENST ID: ENST00000487910
  CDS Start-End: 73-369
tggtgattcatctccacggcttttcctaaagaactccattagtggcgagagatattgaagacaaacccggtgatggctgtgaaccctttattgacaccaacagggcagcagacaatcccactgatcccctcaccatttgggcctccaactgtggacagagatgtattgccttccaccgtagctccaactgacccaagacagttttgcgttccttcccaatttggatcctctgttctaccaaacacaaatatggcaaatgtgttgtccagtcggatctacccaggttggggcattttaccacctgaatccataaaggcagtggccagaaggaatgaaatgattcaacggcatcatactgccagggtttgaaaacctcttcccagtactttaggttttttgaggattaatctctggcaaggaactagctgtgctgcgtaagccccatccctgctaaatttgcctcgtctgtttaaaggacagaaatggaaatgtatgctatttaccagcaaaggagaatggaaaaaattaatcccaagggactagcaggcctagggatacccttcctctatggctccagtgtcccagctgcccccgctgcctaccatggcaggagcatgctccctgccggtgacctgcattttcacagaagcaccctcagaaaccttcagggaaaccccatgctagcggcaactgcaccacactttgaggagagctgggggcagagatgtcgtcgactcaggaaaaatacagggaatcaaaaagctctagacagtgatgctgagagttccaaaagtcaagcagaagaaaaaatcctaggtcagactcatgcagttccctatgaagaggatcattatgcaaaagacccagacattgaagcacccagcaaccagaagtcaagtgaaacgaatgaaaagccaacgacagctcttgccaacacctgtggagagctcgagcccacccataggaaaccctgggggtctcacaccactaccctgaaagcaaaggcctgggacgatgggaaagaggaggcttcggagcagatttttgcaacctgtgatgaaaagaatggggtttgccctccagttcctcgaccatctctgccaggaacacatgcactggttacaattggggggaatctttctttggatgaagatattcagaagtggaccgtggatgatgtgcacagcttcattcgcagccttccaggttgttcagactatgctcaggtatttaaagatcatgcaattgatggagaaactttgccattactcacagaagagcatcttcgaggcactatgggattaaagctagggccggcactaaaaattcagtcacaggtatctcagcatgtgggaagtatgttctacaagaaaactctttcatttcctataagacaagcatttgatcaaccagcagatacatcccctcttctggatcctaattcctggagtgatacaatgaacattttttgtccccaggatacaataattcctaaaggaattgagcgaggtagtatgagaaactaaaagccctcaaggaggaagaatagtcttagccagttttccaaagagcctaggatattacaaaggatgtgtgaggatttccca

SEQ ID NO: 186869 - DNA, 6935 bp, Homo sapiens
  Payload ID: 16793
  Gene Symbol: SAMD8
  Gene Name: sterile alpha motif domain containing 8
  Uniprot ID: Q96LT4
  ENST ID: ENST00000372687
  CDS Start-End: 86-1066
ctcggaccgcggaggtgagcgggagctgaggctgaggagaggggagcttggggggcgcctgctgccaagggcagcggaggaggaaatggcaggtcctaatcaactctgcattcgccgctggactaccaagcatgtagctgtgtggctgaaggatgaaggcttttttgaatatgtggacattttatgcaataagcaccgacttgatggaatcacattgctaacattgactgaatatgatctccggtctcctcctctggaaatcaaagtcttaggggacattaaaaggttaatgctctcagtccgaaaattgcagaaaatacatattgatgttttagaagagatgggctacaacagtgacagtcccatgggttccatgacccctttcatcagtgctcttcagagtacagactggctctgtaatggggagctttcccatgactgtgacggacccataactgacttgaattctgatcagtaccagtacatgaatggtaaaaacaaacattctgttcgaagattggacccagaatactggaagactatactgagttgtatatatgtttttatagtatttggatttacatctttcattatggttatagtccatgagcgagtgcctgacatgcagacctatccaccactcccagatatattcttagacagcgttcctagaatcccatgggcctttgccatgacggaagtatgtggcatgattctgtgctatatttggctcctggttcttcttcttcacaagcacaggtcaatacttctgcgaaggctctgtagtctgatgggaactgtattcttgcttcgctgctttaccatgtttgtgacctccctctccgtgccaggacaacacctgcagtgtactggaaagatatatggcagtgtatgggagaaattacatcgagcctttgccatttggagtggctttggtatgaccctgactggcgttcacacatgtggagattacatgtttagtggccacacagtcgtcctaactatgctgaatttctttgtcaccgaatgtaagtatctttttagtgcttctatgcgtattaggtaactagctgcagtgaaggctgtgggaagggtgtcagatcctgtgaagaatggcaaaacagcctgacctgagaaacgtgactgagaagcattggaaggaatgtagctttaaaatgatctttctgtccttttcctagatacaccaagaagctggaatttcttgcacactttatcctgggttctcaacctctttggaatcttcttcatcttggctgcccatgaacattattctattgatgtgtttattgctttttatataacaacaagactctttttgtactaccatactctggccaataccagagcatatcagcagagtaggagagcaaggatttggtttcccatgttctctttttttgaatgcaatgttaatggcacagtacctaatgaatattgttggccattttcaaaaccagcaataatgaaaagactaattggatgaatactatctttctaatgaatttgtgattaaatatataatagttgttgaaaatgagtaactttgcgttctccccctaggttgttcttagatgcctggcttatgtgttgacaaagtaaagttttctgttctgagcaaagttatgattataaaaagcaagaaagaacaatcaagagtccttatgtagctatttgaacagaaagcttaagtagatgttttctgccccttctctttaggaagacttaatgttgtgattgaagtcaggctgtacccttacctgttgagtatttgcttattgaactttaaacaagtcaacttgagcagtttgctggttgaggaattttcattgatttccagtagggctctagtcaagaaataatatgttttgaagctccttattacctttagaagaagaaaccctaacaagtgacagtacttgttctttggactaatctttgtttcattttaaaaaatgcaaccctgggacatgatctgttttactgacaaagagtttttgccttctgaaccatctttaaatatactgagcataccaggatgcctgaaataagaagagaatgaaagaggccatagatgacgtgacagagtactggctaggatgccattggtctcctcattaatgcaaatgtagggctggcatatttcaccaaagatgcaacaaaagatgcagtgccagtgtgaccctcagtgagtattcatgagggaaaaatggctgcatccataaaaataaatgggcttaatgttagtggtataggtacccagaataacttctttgtgctatagttgttagatgacagttcaattttatgcttttttaatggtgttattaaatgagccaaataggagtgttttaccagatgttagataaagttcttaatgccgttaagtagggaggtatgcatgcaaagaattgttttctcctgaaaagaaacttacagcacgcaaaatataactttttggtttttgaaatttatcattcttggctgttggaagtaaacagtctcagacatacttggatatgaaaaagtttcgttgttttttacttttaaatataatggtgtatatacattctttctatttagtcttaatttggcagtcaggaagtgatataacttagctgctatttacaacactagaaatttagtactttaagtaatttcacatctatgataacatttgttactttatttttaatgatttttttacagtagttatgacagtaggatggttatggaattggaatttaaactcccaactaatgagcttaagctgcttggaatattaattatgtagtttttacattccattttaaaacaaaaacttagaaaaggtgctggcattctgaggcctgcaattaggccacatagcagaagcttgctccttccttatctgggtgaaatattttatttttgcactttgagtcatattcccacccctgtataagctacataggagcctgaatgaattgggtaggaaaggaaattatgcaaacaagtctcagctagtgctgaatgaccccaatttgggtctgctgtgaacatcatttttgtatttctcacttgagaaatgctgcaaggcaattcaacttttatgcttttaaatctcacaactcagaatctgatatcttaaatcactgattctgttacatgctaggaacaaaatgccaacatctcatgtaaagaagttgcataatcatgaaaaataaaggatgtttcctatgccagttagagtggtttgacccttcaggtaaaaagatatgttactgttatttttctacgtgacagaacagactgaatttagctagggaggcagtgatgttggcttttgggaaagggttcaaaaaactgtatggcaacattaatgctaaaatgttaagccgagtgcagtggtgcaaggctatagtcccaggttctgaggaggctgaggcaggaggattgcttgaggccaggagttagaaactagagtgtgttataacgcctatgaataaccactgcattccagcccgggcaaggtagcaagacccattctcttaaaaacatggctgggtgcaatggctcacgcctgtaatcccagcactttgggaggccaaggcaggcggatggcttgaggtcaggagttcgagattagcctggccaatatggtgaaacctcatctctactaaaactacaaaaattagctgggcatggtggcacgcacttgtaatcccagctacttgggagactgaggaacaagaaacacttgaacccaggaggtggagtttgcattgagctgagatcactccactgcactccagcctaggtgacagagtgagactccatctcaaaacgaaacaaaacaaaacaaaacaaattagagtgggtgcagtgtctaatgcctgtaatcgcagcactttgggaggctaaggcaggaggatcacttgagctcaggtaaaagagaccagcctgggcaacaaagtgagacctcatccccacaaaaagttgtttagaaaattagctgggcgtggtgatgcatgcctgtggtcccagctacatgggaggctgaggcagaaggatcacttgagcccaaggaggttgaggctacagtgagctgtaatcatgccactgcactccagccttggggacagagtgagaccctgcctcaatcaatcaatcaatcaataacaaaaacttaaatagctattaacctcagtcttctttccttcatataaattctattctaagaccaaatagaaaaataaatgtaactaactttgcagagctattgacattgagagacctaacaacagactgcaatggggattgtaaaataacttttcagccttgcacttgctcatatatgttttgagaaaaatgtaagttaggtataacttattgttttaactattataaggcagtgtttacataaattaatcatctctttcttggaaaacattgagacaaatttattttcagttttacttaaacatgaaacctgtattttagttgctttttgttttgtccagaaatttccagattttgtcttcattttttttcctggttaaaatctaaaccatagtgaagatagtatttatgtttacattttatctgtgaatgtggctaagcagagaagctacatggctttggtctacatattttttgaccttgtatttggttctgtagttgcagacttgtgaaggcttacatcatcatggagactttagtaaggaaggaaccaaaaggtttttggtttggggatgcaaactggaggttatgttacaagtcttcaatgcattttctgtgttcctggcagcagtgttgcctttttttttcttttccttttttttttttaaagaccaggtagggtagtgttattgaagggtaattgaagagtggtagagagtaagaggttttgaaggaggcaggtttgctgttatcacaaaataatttgggggaaacctttcgtggctgtgctgcaagaattctttatgtggctatcctctccatagttttctgaccagaattgcaagggcaaaaatagaacttctagctctatttatttgtatcctttgaaatcagaacttatccttagaaccagtcagttaaataatgcggactatgcctataatcccagcactttaggaggctgaggcaggcagatcacgaggtcaggagttcgaggccagcctggccaatgtggtgaaactccgtctctactaaaaatacaaaaattagccgggcgtggtggtgcacgcccatgcctgtagtcccagctactcgggaggctgaggcagaagaatcgcttgaacccaggaggcggaggttgcagtgagccgagatactgccactacacttcagtctgggtgacagagcgagactccatctcaaaaaaacaaaacaaaataaaataataatgtgggctattcagaagaaaaagtcagtgacagagagaccagaacccattggatcaagagacctgcagggattataactctttactctgtgagcagcggtgtttcgtgccctgtctctgcctgtgtgtttttactaagaattccagaaatcctgtaatttgtaaatgggaaacagaggaaccagattgttttatagctgataagaaacagtctgttttagaaacatctgtttggaaagtattactcatgtattcacaaagtcatatttataacactagtcttctttgactgtattcaacaaaaggcagtttcaccattaatttcatagtaagcttttttaaaggattctagatctaaattgcctaagaatgttaaccacattcttgttttaaactctctaatttaataaatgtaattattttatagtcttttatagacttacattttcttcatactaaaggtaatgataatatagtcatttgccagtactttaaggtattcaggcatttgagacaagaaagctgtcttgtagaatagtccaattgctttcttaaacagtactggtttcatttagacagtttctaagccagcaaaggtgtcaattttaatgccaacttgacagtttaacagttagtgtttgtaagcagtttagcctgaattatcccatactgctgtagaggagaattgttagtaacatcaaaggtcagaatgcttcaggtgactaataagaatggaaagagactgagtaggttttttgtttcttttccctgtctttgagtaactttgaatgactaaaattagtatgaaactaggttttggacccccttctcacctcacccggatgtaatgccaccaatttcaaataactaaaatgtgaccaattactttgcttcaagttctatacaaatatctctgaaatctgtaagccatatttcagctattctggtttttataatacattctaccctaaattaaccaaaggactttttattcagtgtattccatgtttcagcataaggaaagtttgtgcctgatatggcaggagaaagaacactatggtaatttcattgttacttcaggtctctttcaatctgaagaactgggttgtctggagaattgaacatagccaagcaatattatcaattagtaatgtcatcttaaaaatgttcacttttactaagttttattcagaggatctatgtattattagaaaaatgaagtatttctgacatggaacaaagaaagtggaaactggtacttaatgggggaagcaaaattagctgggactaaaacggacatgttttgttttgtgaattctacctaaatgtctctctatccacagagaaactagtattacttgaagatgtgaaagttcctgtggtagccataccttgaagcacagtgtttgtacataagtaaatatcttgattctaaattaaatccagatttaactaatatatattattttatatctttgttgtattaaaatgtttaaaaacactaaaaataaaacatttgaaagttgga

SEQ ID NO: 186870 - DNA, 1654 bp, Homo sapiens
  Payload ID: 16793
  Gene Symbol: SAMD8
  Gene Name: sterile alpha motif domain containing 8
  ENST ID: ENST00000372690
  CDS Start-End: 79-1515
ggtagggccccgcctcccgaagcagttccggttcggctccgagcagctgccggcgcggcggtgacggcggccgggacgatgcctgcgcgcagtcgccaccgcccccgcctccactccggctccccgccccgggctccgcccccgccgcttgaggcgcttcactccggcgaggcggggagggccccggactccgacggcggctcggacgccgactcggaggtgggtccggggagcccgactcggaccgcggaggcagcggaggaggaaatggcaggtcctaatcaactctgcattcgccgctggactaccaagcatgtagctgtgtggctgaaggatgaaggcttttttgaatatgtggacattttatgcaataagcaccgacttgatggaatcacattgctaacattgactgaatatgatctccggtctcctcctctggaaatcaaagtcttaggggacattaaaaggttaatgctctcagtccgaaaattgcagaaaatacatattgatgttttagaagagatgggctacaacagtgacagtcccatgggttccatgacccctttcatcagtgctcttcagagtacagactggctctgtaatggggagctttcccatgactgtgacggacccataactgacttgaattctgatcagtaccagtacatgaatggtaaaaacaaacattctgttcgaagattggacccagaatactggaagactatactgagttgtatatatgtttttatagtatttggatttacatctttcattatggttatagtccatgagcgagtgcctgacatgcagacctatccaccactcccagatatattcttagacagcgttcctagaatcccatgggcctttgccatgacggaagtatgtggcatgattctgtgctatatttggctcctggttcttcttcttcacaagcacaggtcaatacttctgcgaaggctctgtagtctgatgggaactgtattcttgcttcgctgctttaccatgtttgtgacctccctctccgtgccaggacaacacctgcagtgtactggaaagatatatggcagtgtatgggagaaattacatcgagcctttgccatttggagtggctttggtatgaccctgactggcgttcacacatgtggagattacatgtttagtggccacacagtcgtcctaactatgctgaatttctttgtcaccgaatatacaccaagaagctggaatttcttgcacactttatcctgggttctcaacctctttggaatcttcttcatcttggctgcccatgaacattattctattgatgtgtttattgctttttatataacaacaagactctttttgtactaccatactctggccaataccagagcatatcagcagagtaggagagcaaggatttggtttcccatgttctctttttttgaatgcaatgttaatggcacagtacctaatgaatattgttggccattttcaaaaccagcaataatgaaaagactaattggatgaatactatctttctaatgaatttgtgattaaatatataatagttgttgaaaatgagtaactttgcgttctccccctaggttgttcttagatgcctggcttatgtgttgacaaagtaaagttttctgttctgagcaaagtt

SEQ ID NO: 186871 - DNA, 919 bp, Homo sapiens
  Payload ID: 16793
  Gene Symbol: SAMD8
  Gene Name: sterile alpha motif domain containing 8
  ENST ID: ENST00000447533
  CDS Start-End: 159-919
gagagccgactgaggccttgtggactgcagtgggccctccggtccctctaaacccccaggcctcctctctgcttggtatctgtttgggattgaagaccgttggttccataaacctccatgaagatgggagtctacctgaagaggcagcggaggaggaaatggcaggtcctaatcaactctgcattcgccgctggactaccaagcatgtagctgtgtggctgaaggatgaaggcttttttgaatatgtggacattttatgcaataagcaccgacttgatggaatcacattgctaacattgactgaatatgatctccggtctcctcctctggaaatcaaagtcttaggggacattaaaaggttaatgctctcagtccgaaaattgcagaaaatacatattgatgttttagaagagatgggctacaacagtgacagtcccatgggttccatgacccctttcatcagtgctcttcagagtacagactggctctgtaatggggagctttcccatgactgtgacggacccataactgacttgaattctgatcagtaccagtacatgaatggtaaaaacaaacattctgttcgaagattggacccagaatactggaagactatactgagttgtatatatgtttttatagtatttggatttacatctttcattatggttatagtccatgagcgagtgcctgacatgcagacctatccaccactcccagatatattcttagacagcgttcctagaatcccatgggcctttgccatgacggaagtatgtggcatgattctgtgctatatttggctcctggttcttcttcttcacaagcacaggtcaatacttctgcgaaggctctgtagtctgatgggaactgtattcttgcttcgctgctttaccatgtttgtgacctccctctccgt

SEQ ID NO: 186872 - DNA, 6782 bp, Homo sapiens
  Payload ID: 16793
  Gene Symbol: SAMD8
  Gene Name: sterile alpha motif domain containing 8
  Uniprot ID: Q96LT4
  ENST ID: ENST00000542569
  CDS Start-End: 104-1351
cggcgaggcggggagggccccggactccgacggcggctcggacgccgactcggaggtgggtccggggagcccgactcggaccgcggaggcagcggaggaggaaatggcaggtcctaatcaactctgcattcgccgctggactaccaagcatgtagctgtgtggctgaaggatgaaggcttttttgaatatgtggacattttatgcaataagcaccgacttgatggaatcacattgctaacattgactgaatatgatctccggtctcctcctctggaaatcaaagtcttaggggacattaaaaggttaatgctctcagtccgaaaattgcagaaaatacatattgatgttttagaagagatgggctacaacagtgacagtcccatgggttccatgacccctttcatcagtgctcttcagagtacagactggctctgtaatggggagctttcccatgactgtgacggacccataactgacttgaattctgatcagtaccagtacatgaatggtaaaaacaaacattctgttcgaagattggacccagaatactggaagactatactgagttgtatatatgtttttatagtatttggatttacatctttcattatggttatagtccatgagcgagtgcctgacatgcagacctatccaccactcccagatatattcttagacagcgttcctagaatcccatgggcctttgccatgacggaagtatgtggcatgattctgtgctatatttggctcctggttcttcttcttcacaagcacaggtcaatacttctgcgaaggctctgtagtctgatgggaactgtattcttgcttcgctgctttaccatgtttgtgacctccctctccgtgccaggacaacacctgcagtgtactggaaagatatatggcagtgtatgggagaaattacatcgagcctttgccatttggagtggctttggtatgaccctgactggcgttcacacatgtggagattacatgtttagtggccacacagtcgtcctaactatgctgaatttctttgtcaccgaatatacaccaagaagctggaatttcttgcacactttatcctgggttctcaacctctttggaatcttcttcatcttggctgcccatgaacattattctattgatgtgtttattgctttttatataacaacaagactctttttgtactaccatactctggccaataccagagcatatcagcagagtaggagagcaaggatttggtttcccatgttctctttttttgaatgcaatgttaatggcacagtacctaatgaatattgttggccattttcaaaaccagcaataatgaaaagactaattggatgaatactatctttctaatgaatttgtgattaaatatataatagttgttgaaaatgagtaactttgcgttctccccctaggttgttcttagatgcctggcttatgtgttgacaaagtaaagttttctgttctgagcaaagttatgattataaaaagcaagaaagaacaatcaagagtccttatgtagctatttgaacagaaagcttaagtagatgttttctgccccttctctttaggaagacttaatgttgtgattgaagtcaggctgtacccttacctgttgagtatttgcttattgaactttaaacaagtcaacttgagcagtttgctggttgaggaattttcattgatttccagtagggctctagtcaagaaataatatgttttgaagctccttattacctttagaagaagaaaccctaacaagtgacagtacttgttctttggactaatctttgtttcattttaaaaaatgcaaccctgggacatgatctgttttactgacaaagagtttttgccttctgaaccatctttaaatatactgagcataccaggatgcctgaaataagaagagaatgaaagaggccatagatgacgtgacagagtactggctaggatgccattggtctcctcattaatgcaaatgtagggctggcatatttcaccaaagatgcaacaaaagatgcagtgccagtgtgaccctcagtgagtattcatgagggaaaaatggctgcatccataaaaataaatgggcttaatgttagtggtataggtacccagaataacttctttgtgctatagttgttagatgacagttcaattttatgcttttttaatggtgttattaaatgagccaaataggagtgttttaccagatgttagataaagttcttaatgccgttaagtagggaggtatgcatgcaaagaattgttttctcctgaaaagaaacttacagcacgcaaaatataactttttggtttttgaaatttatcattcttggctgttggaagtaaacagtctcagacatacttggatatgaaaaagtttcgttgttttttacttttaaatataatggtgtatatacattctttctatttagtcttaatttggcagtcaggaagtgatataacttagctgctatttacaacactagaaatttagtactttaagtaatttcacatctatgataacatttgttactttatttttaatgatttttttacagtagttatgacagtaggatggttatggaattggaatttaaactcccaactaatgagcttaagctgcttggaatattaattatgtagtttttacattccattttaaaacaaaaacttagaaaaggtgctggcattctgaggcctgcaattaggccacatagcagaagcttgctccttccttatctgggtgaaatattttatttttgcactttgagtcatattcccacccctgtataagctacataggagcctgaatgaattgggtaggaaaggaaattatgcaaacaagtctcagctagtgctgaatgaccccaatttgggtctgctgtgaacatcatttttgtatttctcacttgagaaatgctgcaaggcaattcaacttttatgcttttaaatctcacaactcagaatctgatatcttaaatcactgattctgttacatgctaggaacaaaatgccaacatctcatgtaaagaagttgcataatcatgaaaaataaaggatgtttcctatgccagttagagtggtttgacccttcaggtaaaaagatatgttactgttatttttctacgtgacagaacagactgaatttagctagggaggcagtgatgttggcttttgggaaagggttcaaaaaactgtatggcaacattaatgctaaaatgttaagccgagtgcagtggtgcaaggctatagtcccaggttctgaggaggctgaggcaggaggattgcttgaggccaggagttagaaactagagtgtgttataacgcctatgaataaccactgcattccagcccgggcaaggtagcaagacccattctcttaaaaacatggctgggtgcaatggctcacgcctgtaatcccagcactttgggaggccaaggcaggcggatggcttgaggtcaggagttcgagattagcctggccaatatggtgaaacctcatctctactaaaactacaaaaattagctgggcatggtggcacgcacttgtaatcccagctacttgggagactgaggaacaagaaacacttgaacccaggaggtggagtttgcattgagctgagatcactccactgcactccagcctaggtgacagagtgagactccatctcaaaacgaaacaaaacaaaacaaaacaaattagagtgggtgcagtgtctaatgcctgtaatcgcagcactttgggaggctaaggcaggaggatcacttgagctcaggtaaaagagaccagcctgggcaacaaagtgagacctcatccccacaaaaagttgtttagaaaattagctgggcgtggtgatgcatgcctgtggtcccagctacatgggaggctgaggcagaaggatcacttgagcccaaggaggttgaggctacagtgagctgtaatcatgccactgcactccagccttggggacagagtgagaccctgcctcaatcaatcaatcaatcaataacaaaaacttaaatagctattaacctcagtcttctttccttcatataaattctattctaagaccaaatagaaaaataaatgtaactaactttgcagagctattgacattgagagacctaacaacagactgcaatggggattgtaaaataacttttcagccttgcacttgctcatatatgttttgagaaaaatgtaagttaggtataacttattgttttaactattataaggcagtgtttacataaattaatcatctctttcttggaaaacattgagacaaatttattttcagttttacttaaacatgaaacctgtattttagttgctttttgttttgtccagaaatttccagattttgtcttcattttttttcctggttaaaatctaaaccatagtgaagatagtatttatgtttacattttatctgtgaatgtggctaagcagagaagctacatggctttggtctacatattttttgaccttgtatttggttctgtagttgcagacttgtgaaggcttacatcatcatggagactttagtaaggaaggaaccaaaaggtttttggtttggggatgcaaactggaggttatgttacaagtcttcaatgcattttctgtgttcctggcagcagtgttgcctttttttttcttttccttttttttttttaaagaccaggtagggtagtgttattgaagggtaattgaagagtggtagagagtaagaggttttgaaggaggcaggtttgctgttatcacaaaataatttgggggaaacctttcgtggctgtgctgcaagaattctttatgtggctatcctctccatagttttctgaccagaattgcaagggcaaaaatagaacttctagctctatttatttgtatcctttgaaatcagaacttatccttagaaccagtcagttaaataatgcggactatgcctataatcccagcactttaggaggctgaggcaggcagatcacgaggtcaggagttcgaggccagcctggccaatgtggtgaaactccgtctctactaaaaatacaaaaattagccgggcgtggtggtgcacgcccatgcctgtagtcccagctactcgggaggctgaggcagaagaatcgcttgaacccaggaggcggaggttgcagtgagccgagatactgccactacacttcagtctgggtgacagagcgagactccatctcaaaaaaacaaaacaaaataaaataataatgtgggctattcagaagaaaaagtcagtgacagagagaccagaacccattggatcaagagacctgcagggattataactctttactctgtgagcagcggtgtttcgtgccctgtctctgcctgtgtgtttttactaagaattccagaaatcctgtaatttgtaaatgggaaacagaggaaccagattgttttatagctgataagaaacagtctgttttagaaacatctgtttggaaagtattactcatgtattcacaaagtcatatttataacactagtcttctttgactgtattcaacaaaaggcagtttcaccattaatttcatagtaagcttttttaaaggattctagatctaaattgcctaagaatgttaaccacattcttgttttaaactctctaatttaataaatgtaattattttatagtcttttatagacttacattttcttcatactaaaggtaatgataatatagtcatttgccagtactttaaggtattcaggcatttgagacaagaaagctgtcttgtagaatagtccaattgctttcttaaacagtactggtttcatttagacagtttctaagccagcaaaggtgtcaattttaatgccaacttgacagtttaacagttagtgtttgtaagcagtttagcctgaattatcccatactgctgtagaggagaattgttagtaacatcaaaggtcagaatgcttcaggtgactaataagaatggaaagagactgagtaggttttttgtttcttttccctgtctttgagtaactttgaatgactaaaattagtatgaaactaggttttggacccccttctcacctcacccggatgtaatgccaccaatttcaaataactaaaatgtgaccaattactttgcttcaagttctatacaaatatctctgaaatctgtaagccatatttcagctattctggtttttataatacattctaccctaaattaaccaaaggactttttattcagtgtattccatgtttcagcataaggaaagtttgtgcctgatatggcaggagaaagaacactatggtaatttcattgttacttcaggtctctttcaatctgaagaactgggttgtctggagaattgaacatagccaagcaatattatcaattagtaatgtcatcttaaaaatgttcacttttactaagttttattcagaggatctatgtattattagaaaaatgaagtatttctgacatggaacaaagaaagtggaaactggtacttaatgggggaagcaaaattagctgggactaaaacggacatgttttgttttgtgaattctacctaaatgtctctctatccacagagaaactagtattacttgaagatgtgaaagttcctgtggtagccataccttgaagcacagtgtttgtacataagtaaatatcttgattctaaattaaatccagatttaactaatatatattattttatatctttgttgtattaaaatgtttaaaaacactaaaaataaaacatttgaaagttgga

SEQ ID NO: 186873 - DNA, 6852 bp, Homo sapiens
  Payload ID: 16794
  Gene Symbol: SAMD9
  Gene Name: sterile alpha motif domain containing 9
  Uniprot ID: Q5K651
  ENST ID: ENST00000379958
  CDS Start-End: 271-5040
gacagaagcagagaatacatagacttccgttaaaaccagaatgaggaaaatacttttctctagcatcgtaggaggaagaaaacaaacacatcagatattttcagcactaaaagagatggttttccccacatatatgtaaaagaaatttgcaagactactggattttgatctcatggttgcagtgggtgaataggtggccttttgtgatctcctacatcaccctggaagtgagacttcttcggtttcttctagagtcagtttggtatcagaatggcaaagcaacttaaccttccagaaaatacagatgattggacaaaagaggatgtaaatcagtggttagaaagtcataagattgaccaaaaacacagggaaattttgactgaacaagacgtgaatggagcagtcttgaagtggttaaaaaaagaacatcttgttgatatgggcatcacacatggaccagctattcaaatagaagaactattcaaagaattgcggaaaacagccattgaagattcgattcagacatctaagatgggaaagcccagtaaaaatgctcctaaagaccaaactgtgtctcaaaaggaacgtagagaaacttcaaagcaaaaacaaaagggtaaagagaacccagatatggctaatccgtctgcaatgagtacaactgctaaaggttctaagtcactaaaagttgagctcatagaagataaaatagattatacaaaggaaaggcaaccatccatagacctgacatgtgtatcatatccatttgatgaattcagtaatccatatcgttacaagttggattttagtctacagcctgaaacaggaccaggcaatctcattgatccgatacatgaattcaaagccttcacaaatacagcaacagccacagaagaggatgtcaagatgaaatttagcaatgaggttttccgatttgcttcagcttgtatgaattcacgtaccaatggcactattcattttggagtcaaagacaaaccccatgggaaaattgttggcatcaaagtcaccaatgataccaaggaagccctcattaaccatttcaatctgatgataaacaagtattttgaagaccatcaagtccaacaagcaaagaagtgcattcgagagccaagatttgtggaagttttactgccaaatagtactctatctgacagatttgttattgaagtggacattattccacagttctctgaatgccaatatgattatttccagattaaaatgcaaaattacaacaacaaaatatgggaacaaagtaaaaaattctcactatttgtgcgagatgggaccagctctaaggacattacgaaaaataaagttgatttcagagcatttaaagcagattttaaaacactggcagagtccagaaaagcagcagaagaaaaattcagagcaaaaacaaataaaaaagaaagagagggaccaaagttggttaaattattgacaggaaatcaagatttgttagataattcatactatgaacagtacattcttgtaacaaataaatgccacccagatcaaacaaaacacttagatttcctgaaggaaattaaatggtttgctgtattggagtttgatcctgagtctaacatcaatggagtggtcaaagcttacaaagaaagccgagtagcaaaccttcactttccaagtgtatatgtagaacagaaaaccacaccaaatgagacgatttctactctaaatctttaccatcaacccagctggattttctgcaatggcaggttagaccttgacagtgaaaaatataaaccctttgatccaagttcctggcaaagagaaagagcttctgatgtcaggaaactgatttcatttcttacacatgaagacataatgccaagagggaagtttttggtggtatttctattactgtcctctgtggatgacccaagagatcccctcattgagactttctgtgctttctaccaggatctcaaaggaatggaaaatatactgtgtatttgtgtgcacccacacatatttcagggatggaaagatctacttgaagcaagattaataaaacaccaagatgaaatttcaagccaatgtatttctgctttaagccttgaagagatcaatggcactattcttaaactaaaatctgtgactcaatcttcaaaaaggcttttgccatctattggtttatcgactgtccttctgaaaaaggaagaagatatcatgactgctctggaaattatctgtgaaaatgaatgtgagggtacactgttagagaaggacaaaaataaattccttgaattcaaggcatcaaaagaggaagacttctatcgaggtggcaaagtgtcatggtggaacttctacttctcttctgaaagttattcttcaccttttgtcaaaagggataaatatgaaagacttgaagcaatgattcaaaactgtgcagattcttctaaaccaacaagtaccaaaattattcatctgtatcatcatccaggctgtgggggaactaccttggctatgcacattctctgggaactaaggaagaaattcagatgtgctgtgctgaaaaacaagacagtggatttttctgaaattggagaacaggtaaccagtttaatcacctatggggcaatgaaccgtcaggaatacgtacctgtactactccttgttgatgattttgaagaacaagataatgtctatcttctgcagtactctattcaaacagctatagctaaaaagtacattcgatatgaaaaacctctggtgattatcctaaattgtatgagatcacaaaatcctgaaaaaagtgcaaggatcccagacagtattgccgtaatacagcaactctctcccaaagaacagagagcttttgagcttaaattgaaagaaatcaaagaacagcataaaaactttgaggatttttattcctttatgatcatgaaaaccaattttaataaagaatacatagaaaatgtggtccggaatatcctgaaagggcagaatattttcaccaaggaagcaaagctcttttcttttctggctcttcttaattcatatgtgcctgataccaccatttcactatcacagtgtgaaaaattcttaggaattggaaacaagaaggctttctgggggacagaaaaatttgaagacaagatgggcacctactctacaattctgataaaaacagaggtcatcgaatgtgggaactactgtggagtacgcatcattcactctttgattgcagagttctcactggaagaattgaagaaaagctatcacctgaataaaagtcaaattatgttggatatgctaactgagaatttgttcttcgatactggtatgggaaaaagtaaatttttgcaagatatgcacacactcctactcacaagacaccgcgatgaacatgaaggtgaaacaggaaattggttttccccatttattgaagcattacataaagatgaaggaaatgaagcagttgaagctgtattgcttgaaagtatccatcggttcaacccaaatgcattcatttgccaagcgttggcaagacatttctacattaaaaagaaggactttggcaatgctctaaactgggcaaaacaagcaaaaatcatagaacctgacaattcttatatctcagatacactgggtcaagtctacaaaagtaaaataagatggtggatagaggaaaacggaggaaacgggaacatttcagttgatgatctaattgctcttttggatttagcagaacatgcctcaagtgcattcaaagaatctcaacagcaaagtgaagatagagagtatgaagtgaaggaaagattgtatccgaagtcaaaaaggcggtatgatacttacaatatagctggttatcaaggagagatagaagttgggctttacacaatccaaattctccagctcattcctttttttgataataaaaatgagctatctaaaagatatatggtcaattttgtatcaggaagtagtgatattccaggggatccaaacaatgaatataaattagccctcaaaaactatattccttatttaactaaattgaaattttctttgaaaaagtcctttgatttttttgatgaatactttgtcctgctaaaacccaggaacaatattaagcaaaatgaagaggccaaaactcggagaaaggtggctggatattttaagaaatatgtagatatattttgtctcttagaagaatcacaaaacaacacaggtcttggatcaaagttcagtgagccacttcaagtagagagatgcaggagaaacctagtagctttaaaagcagacaagttttctgggctcttggaatatcttatcaaaagtcaagaggatgctataagcactatgaaatgtatagtgaacgaatatacttttctcttagaacaatgcactgtcaaaatccagtcaaaagaaaagctaaatttcatcttggccaacattattctctcctgtatccaacctacctccagattagtaaagccagttgaaaaactaaaagatcagcttcgagaagtcttgcaaccaataggactgacttatcagttttcagaaccgtattttctagcttccctcttattctggccagaaaatcaacaactagatcaacattctgaacaaatgaaagagtatgctcaagcactaaaaaattctttcaaggggcaatataaacatatgcatcgtacaaagcaaccaattgcatatttctttcttggaaaaggtaaaagactggaaagacttgttcacaaaggaaaaattgaccagtgctttaagaagacaccagatattaattccttgtggcagagtggagatgtgtggaaggaggaaaaagtccaagaacttttgcttcgtttacaaggtcgagctgaaaacaattgtttatatatagaatatggaatcaatgaaaaaatcacaatacccatcactcccgcttttttaggtcaacttagaagtggcagaagcatagagaaggtgtctttttacctgggattttccattggaggcccacttgcttatgacattgaaattgtttaagagcctgatattcttcctccaagaatttgatctcagtacccatttaatttttttggactcaagatctatgctttaaaccggcaaggttatagatacagcctctagctcttcagatctgtacatgcagtatttaatttcctcttaaacatgttatgagttctacaaagacaatagtgaaaaaggaaggagtgagatatatgaaaagtagcaaatatgttccttggtttggttaacatcattgatgacaaaataataaggagctatgactggagtcaggagaagttagtgtaataagctggctacacagaaccccactacttaccaggcatggattgaagaagattgtctactcaaatggcatttagacattagaatgtctgggaaaatatttctcaaagacagcaaaaacctctcaaactgaggagcaacatttattcttactaagcagatcatcaatgtatcatgtgcttggcactcaaggatcttccaaaacagaggaccaaccagtcttctgaaggtcatgcccacagaagtcatcagaccttaccaaagtaggttggagaattagattgccttttcatgcagtgagattcagttaagcaaaaatgaaatttgtctctatagctaattagcttatcaactcccctccaaacaaacaattaaaaaaaaaacatacagacactcaaattccacaagctaatgaacaaaagggactcttgtgagaagactaatgagtccctcatccagaagatgccaatgtactggcagattaacatacaacctatgttttgaacaaaaacaaccagcgatacgtaatcaaaatgtaattttcccctaataaaattatggatatgggcagtcatcaatggctgccaaaaccattaagtggaaagctgattaaaaaacaaaaatttctaatggatttatcaaactgtcccaaatcctgataaatattaacatcacagaggaagaccagacattatgggcctggaagtactataggagtgcacacatcacccgtgacatggtcttgccaaataattaaacctgaatttgatcaggtctctggatcttatttgcaattcaaaagaaattttaaaaaaatcctactaacaccaccacaaatatgcaatcagcaatatccagaaaggggaaattcacaggacaaaaacctggttttcttttttggtttcttcaaccaaaaaagaaagaaattgcaaaggaccaaaaaaatgttggggaatctatacattataagggacttaacaactaaagggcaacatatagactttagatcctaatttgagcaaaatctaaaatcaattattaggcaatcagaaaaatttgaacacagactagatatttgaggatattaaggtactatattattgaagattccatggttatgttttttaaagagttcatgccttttagagatacatactaaagtatttgtaaataaatgacatgatctagaatcagtaattttgtgtttggggtgtgggggtggtgaaagggaagtagaaccgaaacaagattagtcctgagttaacaatggctgcaagctggatacatggaattcagcacacttttctccctcttactgattatgcttttgaaattttctcttgtaaaacatttagaaaacaaaaacaaaaaaaatgtgatttgtttctgtcttcaaaatctcattagaattttttcactggaggaagattttcccttgcttctgcataaaattttaactccataacttataagctcactctttattgttactttctaattgacaaataaaaattgtatattatt

SEQ ID NO: 186874 - DNA, 3957 bp, Homo sapiens
  Payload ID: 16794
  Gene Symbol: SAMD9
  Gene Name: sterile alpha motif domain containing 9
  ENST ID: ENST00000446617
  CDS Start-End: 109-3957
agcatcgtaggaggaagaaaacaaacacatcagatattttcagcactaaaagagatggttttccccacatatatgtaaaagaaatttgcaagactactgggtatcagaatggcaaagcaacttaaccttccagaaaatacagatgattggacaaaagaggatgtaaatcagtggttagaaagtcataagattgaccaaaaacacagggaaattttgactgaacaagacgtgaatggagcagtcttgaagtggttaaaaaaagaacatcttgttgatatgggcatcacacatggaccagctattcaaatagaagaactattcaaagaattgcggaaaacagccattgaagattcgattcagacatctaagatgggaaagcccagtaaaaatgctcctaaagaccaaactgtgtctcaaaaggaacgtagagaaacttcaaagcaaaaacaaaagggtaaagagaacccagatatggctaatccgtctgcaatgagtacaactgctaaaggttctaagtcactaaaagttgagctcatagaagataaaatagattatacaaaggaaaggcaaccatccatagacctgacatgtgtatcatatccatttgatgaattcagtaatccatatcgttacaagttggattttagtctacagcctgaaacaggaccaggcaatctcattgatccgatacatgaattcaaagccttcacaaatacagcaacagccacagaagaggatgtcaagatgaaatttagcaatgaggttttccgatttgcttcagcttgtatgaattcacgtaccaatggcactattcattttggagtcaaagacaaaccccatgggaaaattgttggcatcaaagtcaccaatgataccaaggaagccctcattaaccatttcaatctgatgataaacaagtattttgaagaccatcaagtccaacaagcaaagaagtgcattcgagagccaagatttgtggaagttttactgccaaatagtactctatctgacagatttgttattgaagtggacattattccacagttctctgaatgccaatatgattatttccagattaaaatgcaaaattacaacaacaaaatatgggaacaaagtaaaaaattctcactatttgtgcgagatgggaccagctctaaggacattacgaaaaataaagttgatttcagagcatttaaagcagattttaaaacactggcagagtccagaaaagcagcagaagaaaaattcagagcaaaaacaaataaaaaagaaagagagggaccaaagttggttaaattattgacaggaaatcaagatttgttagataattcatactatgaacagtacattcttgtaacaaataaatgccacccagatcaaacaaaacacttagatttcctgaaggaaattaaatggtttgctgtattggagtttgatcctgagtctaacatcaatggagtggtcaaagcttacaaagaaagccgagtagcaaaccttcactttccaagtgtatatgtagaacagaaaaccacaccaaatgagacgatttctactctaaatctttaccatcaacccagctggattttctgcaatggcaggttagaccttgacagtgaaaaatataaaccctttgatccaagttcctggcaaagagaaagagcttctgatgtcaggaaactgatttcatttcttacacatgaagacataatgccaagagggaagtttttggtggtatttctattactgtcctctgtggatgacccaagagatcccctcattgagactttctgtgctttctaccaggatctcaaaggaatggaaaatatactgtgtatttgtgtgcacccacacatatttcagggatggaaagatctacttgaagcaagattaataaaacaccaagatgaaatttcaagccaatgtatttctgctttaagccttgaagagatcaatggcactattcttaaactaaaatctgtgactcaatcttcaaaaaggcttttgccatctattggtttatcgactgtccttctgaaaaaggaagaagatatcatgactgctctggaaattatctgtgaaaatgaatgtgagggtacactgttagagaaggacaaaaataaattccttgaattcaaggcatcaaaagaggaagacttctatcgaggtggcaaagtgtcatggtggaacttctacttctcttctgaaagttattcttcaccttttgtcaaaagggataaatatgaaagacttgaagcaatgattcaaaactgtgcagattcttctaaaccaacaagtaccaaaattattcatctgtatcatcatccaggctgtgggggaactaccttggctatgcacattctctgggaactaaggaagaaattcagatgtgctgtgctgaaaaacaagacagtggatttttctgaaattggagaacaggtaaccagtttaatcacctatggggcaatgaaccgtcaggaatacgtacctgtactactccttgttgatgattttgaagaacaagataatgtctatcttctgcagtactctattcaaacagctatagctaaaaagtacattcgatatgaaaaacctctggtgattatcctaaattgtatgagatcacaaaatcctgaaaaaagtgcaaggatcccagacagtattgccgtaatacagcaactctctcccaaagaacagagagcttttgagcttaaattgaaagaaatcaaagaacagcataaaaactttgaggatttttattcctttatgatcatgaaaaccaattttaataaagaatacatagaaaatgtggtccggaatatcctgaaagggcagaatattttcaccaaggaagcaaagctcttttcttttctggctcttcttaattcatatgtgcctgataccaccatttcactatcacagtgtgaaaaattcttaggaattggaaacaagaaggctttctgggggacagaaaaatttgaagacaagatgggcacctactctacaattctgataaaaacagaggtcatcgaatgtgggaactactgtggagtacgcatcattcactctttgattgcagagttctcactggaagaattgaagaaaagctatcacctgaataaaagtcaaattatgttggatatgctaactgagaatttgttcttcgatactggtatgggaaaaagtaaatttttgcaagatatgcacacactcctactcacaagacaccgcgatgaacatgaaggtgaaacaggaaattggttttccccatttattgaagcattacataaagatgaaggaaatgaagcagttgaagctgtattgcttgaaagtatccatcggttcaacccaaatgcattcatttgccaagcgttggcaagacatttctacattaaaaagaaggactttggcaatgctctaaactgggcaaaacaagcaaaaatcatagaacctgacaattcttatatctcagatacactgggtcaagtctacaaaagtaaaataagatggtggatagaggaaaacggaggaaacgggaacatttcagttgatgatctaattgctcttttggatttagcagaacatgcctcaagtgcattcaaagaatctcaacagcaaagtgaagatagagagtatgaagtgaaggaaagattgtatccgaagtcaaaaaggcggtatgatacttacaatatagctggttatcaaggagagatagaagttgggctttacacaatccaaattctccagctcattcctttttttgataataaaaatgagctatctaaaagatatatggtcaattttgtatcaggaagtagtgatattccaggggatccaaacaatgaatataaattagccctcaaaaactatattccttatttaactaaattgaaattttctttgaaaaagtcctttgatttttttgatgaatactttgtcctgctaaaacccaggaacaat

SEQ ID NO: 186875 - DNA, 6754 bp, Homo sapiens
  Payload ID: 16794
  Gene Symbol: SAMD9
  Gene Name: sterile alpha motif domain containing 9
  Uniprot ID: Q5K651
  ENST ID: ENST00000620985
  CDS Start-End: 170-4939
gacagaagcagagaatacatagacttccgttaaaaccagaatgaggaaaatacttttctctagcatcgtaggaggaagaaaacaaacacatcagatattttcagcactaaaagagatggttttccccacatatatgtaaaagaaatttgcaagactactgggtatcagaatggcaaagcaacttaaccttccagaaaatacagatgattggacaaaagaggatgtaaatcagtggttagaaagtcataagattgaccaaaaacacagggaaattttgactgaacaagacgtgaatggagcagtcttgaagtggttaaaaaaagaacatcttgttgatatgggcatcacacatggaccagctattcaaatagaagaactattcaaagaattgcggaaaacagccattgaagattcgattcagacatctaagatgggaaagcccagtaaaaatgctcctaaagaccaaactgtgtctcaaaaggaacgtagagaaacttcaaagcaaaaacaaaagggtaaagagaacccagatatggctaatccgtctgcaatgagtacaactgctaaaggttctaagtcactaaaagttgagctcatagaagataaaatagattatacaaaggaaaggcaaccatccatagacctgacatgtgtatcatatccatttgatgaattcagtaatccatatcgttacaagttggattttagtctacagcctgaaacaggaccaggcaatctcattgatccgatacatgaattcaaagccttcacaaatacagcaacagccacagaagaggatgtcaagatgaaatttagcaatgaggttttccgatttgcttcagcttgtatgaattcacgtaccaatggcactattcattttggagtcaaagacaaaccccatgggaaaattgttggcatcaaagtcaccaatgataccaaggaagccctcattaaccatttcaatctgatgataaacaagtattttgaagaccatcaagtccaacaagcaaagaagtgcattcgagagccaagatttgtggaagttttactgccaaatagtactctatctgacagatttgttattgaagtggacattattccacagttctctgaatgccaatatgattatttccagattaaaatgcaaaattacaacaacaaaatatgggaacaaagtaaaaaattctcactatttgtgcgagatgggaccagctctaaggacattacgaaaaataaagttgatttcagagcatttaaagcagattttaaaacactggcagagtccagaaaagcagcagaagaaaaattcagagcaaaaacaaataaaaaagaaagagagggaccaaagttggttaaattattgacaggaaatcaagatttgttagataattcatactatgaacagtacattcttgtaacaaataaatgccacccagatcaaacaaaacacttagatttcctgaaggaaattaaatggtttgctgtattggagtttgatcctgagtctaacatcaatggagtggtcaaagcttacaaagaaagccgagtagcaaaccttcactttccaagtgtatatgtagaacagaaaaccacaccaaatgagacgatttctactctaaatctttaccatcaacccagctggattttctgcaatggcaggttagaccttgacagtgaaaaatataaaccctttgatccaagttcctggcaaagagaaagagcttctgatgtcaggaaactgatttcatttcttacacatgaagacataatgccaagagggaagtttttggtggtatttctattactgtcctctgtggatgacccaagagatcccctcattgagactttctgtgctttctaccaggatctcaaaggaatggaaaatatactgtgtatttgtgtgcacccacacatatttcagggatggaaagatctacttgaagcaagattaataaaacaccaagatgaaatttcaagccaatgtatttctgctttaagccttgaagagatcaatggcactattcttaaactaaaatctgtgactcaatcttcaaaaaggcttttgccatctattggtttatcgactgtccttctgaaaaaggaagaagatatcatgactgctctggaaattatctgtgaaaatgaatgtgagggtacactgttagagaaggacaaaaataaattccttgaattcaaggcatcaaaagaggaagacttctatcgaggtggcaaagtgtcatggtggaacttctacttctcttctgaaagttattcttcaccttttgtcaaaagggataaatatgaaagacttgaagcaatgattcaaaactgtgcagattcttctaaaccaacaagtaccaaaattattcatctgtatcatcatccaggctgtgggggaactaccttggctatgcacattctctgggaactaaggaagaaattcagatgtgctgtgctgaaaaacaagacagtggatttttctgaaattggagaacaggtaaccagtttaatcacctatggggcaatgaaccgtcaggaatacgtacctgtactactccttgttgatgattttgaagaacaagataatgtctatcttctgcagtactctattcaaacagctatagctaaaaagtacattcgatatgaaaaacctctggtgattatcctaaattgtatgagatcacaaaatcctgaaaaaagtgcaaggatcccagacagtattgccgtaatacagcaactctctcccaaagaacagagagcttttgagcttaaattgaaagaaatcaaagaacagcataaaaactttgaggatttttattcctttatgatcatgaaaaccaattttaataaagaatacatagaaaatgtggtccggaatatcctgaaagggcagaatattttcaccaaggaagcaaagctcttttcttttctggctcttcttaattcatatgtgcctgataccaccatttcactatcacagtgtgaaaaattcttaggaattggaaacaagaaggctttctgggggacagaaaaatttgaagacaagatgggcacctactctacaattctgataaaaacagaggtcatcgaatgtgggaactactgtggagtacgcatcattcactctttgattgcagagttctcactggaagaattgaagaaaagctatcacctgaataaaagtcaaattatgttggatatgctaactgagaatttgttcttcgatactggtatgggaaaaagtaaatttttgcaagatatgcacacactcctactcacaagacaccgcgatgaacatgaaggtgaaacaggaaattggttttccccatttattgaagcattacataaagatgaaggaaatgaagcagttgaagctgtattgcttgaaagtatccatcggttcaacccaaatgcattcatttgccaagcgttggcaagacatttctacattaaaaagaaggactttggcaatgctctaaactgggcaaaacaagcaaaaatcatagaacctgacaattcttatatctcagatacactgggtcaagtctacaaaagtaaaataagatggtggatagaggaaaacggaggaaacgggaacatttcagttgatgatctaattgctcttttggatttagcagaacatgcctcaagtgcattcaaagaatctcaacagcaaagtgaagatagagagtatgaagtgaaggaaagattgtatccgaagtcaaaaaggcggtatgatacttacaatatagctggttatcaaggagagatagaagttgggctttacacaatccaaattctccagctcattcctttttttgataataaaaatgagctatctaaaagatatatggtcaattttgtatcaggaagtagtgatattccaggggatccaaacaatgaatataaattagccctcaaaaactatattccttatttaactaaattgaaattttctttgaaaaagtcctttgatttttttgatgaatactttgtcctgctaaaacccaggaacaatattaagcaaaatgaagaggccaaaactcggagaaaggtggctggatattttaagaaatatgtagatatattttgtctcttagaagaatcacaaaacaacacaggtcttggatcaaagttcagtgagccacttcaagtagagagatgcaggagaaacctagtagctttaaaagcagacaagttttctgggctcttggaatatcttatcaaaagtcaagaggatgctataagcactatgaaatgtatagtgaacgaatatacttttctcttagaacaatgcactgtcaaaatccagtcaaaagaaaagctaaatttcatcttggccaacattattctctcctgtatccaacctacctccagattagtaaagccagttgaaaaactaaaagatcagcttcgagaagtcttgcaaccaataggactgacttatcagttttcagaaccgtattttctagcttccctcttattctggccagaaaatcaacaactagatcaacattctgaacaaatgaaagagtatgctcaagcactaaaaaattctttcaaggggcaatataaacatatgcatcgtacaaagcaaccaattgcatatttctttcttggaaaaggtaaaagactggaaagacttgttcacaaaggaaaaattgaccagtgctttaagaagacaccagatattaattccttgtggcagagtggagatgtgtggaaggaggaaaaagtccaagaacttttgcttcgtttacaaggtcgagctgaaaacaattgtttatatatagaatatggaatcaatgaaaaaatcacaatacccatcactcccgcttttttaggtcaacttagaagtggcagaagcatagagaaggtgtctttttacctgggattttccattggaggcccacttgcttatgacattgaaattgtttaagagcctgatattcttcctccaagaatttgatctcagtacccatttaatttttttggactcaagatctatgctttaaaccggcaaggttatagatacagcctctagctcttcagatctgtacatgcagtatttaatttcctcttaaacatgttatgagttctacaaagacaatagtgaaaaaggaaggagtgagatatatgaaaagtagcaaatatgttccttggtttggttaacatcattgatgacaaaataataaggagctatgactggagtcaggagaagttagtgtaataagctggctacacagaaccccactacttaccaggcatggattgaagaagattgtctactcaaatggcatttagacattagaatgtctgggaaaatatttctcaaagacagcaaaaacctctcaaactgaggagcaacatttattcttactaagcagatcatcaatgtatcatgtgcttggcactcaaggatcttccaaaacagaggaccaaccagtcttctgaaggtcatgcccacagaagtcatcagaccttaccaaagtaggttggagaattagattgccttttcatgcagtgagattcagttaagcaaaaatgaaatttgtctctatagctaattagcttatcaactcccctccaaacaaacaattaaaaaaaaaacatacagacactcaaattccacaagctaatgaacaaaagggactcttgtgagaagactaatgagtccctcatccagaagatgccaatgtactggcagattaacatacaacctatgttttgaacaaaaacaaccagcgatacgtaatcaaaatgtaattttcccctaataaaattatggatatgggcagtcatcaatggctgccaaaaccattaagtggaaagctgattaaaaaacaaaaatttctaatggatttatcaaactgtcccaaatcctgataaatattaacatcacagaggaagaccagacattatgggcctggaagtactataggagtgcacacatcacccgtgacatggtcttgccaaataattaaacctgaatttgatcaggtctctggatcttatttgcaattcaaaagaaattttaaaaaaatcctactaacaccaccacaaatatgcaatcagcaatatccagaaaggggaaattcacaggacaaaaacctggttttcttttttggtttcttcaaccaaaaaagaaagaaattgcaaaggaccaaaaaaatgttggggaatctatacattataagggacttaacaactaaagggcaacatatagactttagatcctaatttgagcaaaatctaaaatcaattattaggcaatcagaaaaatttgaacacagactagatatttgaggatattaaggtactatattattgaagattccatggttatgttttttaaagagttcatgccttttagagatacatactaaagtatttgtaaataaatgacatgatctagaatcagtaattttgtgtttggggtgtgggggtggtgaaagggaagtagaaccgaaacaagattagtcctgagttaacaatggctgcaagctggatacatggaattcagcacacttttctccctcttactgattatgcttttgaaattttctcttgtaaaacatttagaaaacaaaaacaaaaaaaatgtgatttgtttctgtcttcaaaatctcattagaattttttcactggaggaagattttcccttgcttctgcataaaattttaactccataacttataagctcactctttattgttactttctaattgacaaataaaaattgtatattatttat

SEQ ID NO: 186876 - DNA, 7134 bp, Homo sapiens
  Payload ID: 16795
  Gene Symbol: SAMD9L
  Gene Name: sterile alpha motif domain containing 9-like
  Uniprot ID: Q8IVG5
  ENST ID: ENST00000318238
  CDS Start-End: 1218-5972
gaaagtcagagtactgggagaacagaagacttcacaatttaatgcctcagtttttaaaaaaggatccttacacttcatgtctcctagccatcagaagaggaatgagacagcaaaagttcaaatggcctgtttcaagtttctgatataaaacgatgacattttcaggaaaatcctgcatttccagagagagactggctggttaaatttctgaaagaggacaccagctaaaagaaggtattgcatctcacccgagcagactgtgtctgtggaaagtgtaagccccttgccagaagagcagcttcccagcaaaggcagagggtgaaaacagcaaaggtcttaagacactggggacctagagtcaaaagggacctcctccagggaaaacgctgtgtgagaaatggcctcattcggtgactgtgagtgacacagcagaaagttgggtcattccggctgcttttttgagaagtccctgaagagatcaataacagcaagagggaacctggcaaggaagctattcctataatccaggaaagagatgaggaaggcttggaccaggtggtagtggtgtcaggtagtcaaatgctgggtatattttgaagatacaccccataggatttgctccacattgaatgtggaatgctggaagagagataaagtgtacctgtcacatactttttgagttttatttattttcttagaagtaagtacacaaagagatgctacctaggagaagggtattcttttcactattctttcaaattttctgtatgttcaaacattttcatagtagaaagttggggggaaaatctgtttcataaacatttcctcagcagcagtccagtctattgcattttaattggttgtgatatcattgttttatgcaatacgttctcaacaagtatatcctccggcaaactgaacaaggaccaagtctgttctgcctacagctctgcttcctcatagctgctttccagaacgtgactcttgcaaattatcaagaaaggggaactaatctaagggatccagatcaaacagcctcatgaagacttattttatgtttctaatataaagatagaagttttcagaaaagccctgctacacagaggatcagagcaggggtgggcctgctgggctgcagctgggattctgagcatcctttcccggaggcacggaaagtgagtgagtgagcccagtgaggaagaagttgaagctttgatatgagtaaacaagtatctctacctgaaatgattaaagactggaccaaagagcatgtgaaaaaatgggtaaatgaagaccttaagattaatgagcaatacgggcaaattctgctcagtgaagaagtaacaggattagtcctgcaggaattaactgagaaggaccttgtagaaatggggctaccatggggtccagcacttttgataaaacgttcatacaacaaattgaatagtaagtcccctgaaagtgacaatcatgatccgggacaattagataattcaaaaccgtccaaaacagaacaccagaaaaatccaaaacacaccaaaaaggaagaagaaaattcaatgtcatctaatattgattatgatcccagagagatcagagatatcaaacaagaagaatcaattcttatgaaagaaaatgtgttagatgaagtagcaaatgctaaacacaagaaaaagggtaagctaaaacctgaacaattgacttgtatgccatatccttttgatcagttccatgacagccatcgctacatagaacattatactctacaacctgaaacaggagcactcaatctcattgatccaatacatgagttcaaagctctcacaaacacagaaacagccacggaagtggacattaagatgaaattcagcaatgaagtcttccgatttgcatcagcttgtatgaattcacgcaccaatggcaccatccattttggagtcaaggacaaaccccatggagaaattgttggtgtgaaaatcaccagtaaggctgccttcattgaccacttcaatgtaatgatcaaaaagtattttgaagaaagtgagatcaatgaagccaagaagtgtattcgggagccaaggtttgtggaagtccttctgcagaacaatacaccatctgacagatttgtcattgaagttgatactattccaaaacactctatatgtaatgataagtatttctacattcagatgcaaatttgtaaagataaaatatggaaacaaaaccaaaatctttcactgtttgtaagagaaggggctagctctagggatatcctggccaattccaagcaacgggatgtagatttcaaggcatttttacaaaatttaaagtcactggtagcatctagaaaagaggctgaagaagagtatggaatgaaggcaatgaagaaggagagtgaaggactaaagctggttaaacttctcataggaaaccgagactcactggataattcatactatgactggtacattcttgtaacaaataaatgccatccaaaccaaataaagcacttagattttttaaaagaaattaaatggtttgctgtgttggagtttgatcctgaatctatgatcaatggagtggtcaaagcttacaaagaaagtcgggtggcaaaccttcactttccaaatcaatatgaagacaagacaactaacatgtgggagaagatttctactcttaatctttaccaacagcccagctggattttctgcaacggcagatcagacctgaaaagcgagacatataaacctctagaaccacatttatggcagagagaaagagcttcagaagtcaggaaactaattttatttctcacagatgaaaatataatgacaagaggaaaatttttggtagtgtttctattactctcttcagtggaaagcccaggagatccactcattgaaactttctgggctttctatcaagctctcaaaggaatggaaaatatgttgtgtatctctgtaaactcacatatttatcaacgatggaaagatctactacaaacaagaatgaagatggaagatgaactaacaaaccacagtatttccactttaaatatagaactggtaaacagcactatccttaaactaaaatcggtgactcggtcatcaagaaggtttttgcccgcccgtggatcttcttcagttatcctagagaaaaagaaagaggatgtcttgactgcactggaaatcctctgtgaaaatgagtgtacagagacagacatcgagaaagacaaatctaaattcctggagtttaagaaatcaaaagaagaacacttttatcgaggtggcaaagtatcctggtggaacttctatttttcttctgaaaactattcttcagattttgttaaaagggacagttatgaaaagcttaaagatttaatacactgctgggcagagtctcctaaaccaatatttgcaaaaatcatcaatctttatcatcatccaggctgtggaggtaccacactggctatgcatgttctctgggacttaaagaaaaacttcagatgtgctgtgttaaaaaacaagacaactgattttgcagaaattgcagagcaagtgatcaatctggtcacctatagggcaaagagccatcaggattacattcctgtgcttctccttgtggatgattttgaagaacaagaaaatgtctactttctacaaaatgccatccattccgttttagcagaaaaggatttgcgatatgaaaaaacattggtaattatcttaaactgcatgagatcccggaatccagatgaaagtgcaaaattggcagacagtattgcactaaattaccaactttcttccaaggaacaaagagcttttggtgccaaactgaaggaaattgaaaagcagcacaagaactgtgaaaacttttattccttcatgatcatgaaaagcaattttgatgaaacatatatagaaaatgtagtcaggaatatcctaaaaggacaggatgttgacagcaaggaagcacaactcatttccttcctggctttactcagctcttatgttactgactctacaatttcagtttcacagtgtgaaatatttttgggaatcatatacactagtacaccctgggaacctgaaagcttagaagacaagatgggaacttattctacacttctaataaaaacagaagttgcagaatatgggagatacacaggtgtgcgtatcattcaccctctgattgccctgtactgtctaaaagaactggaaagaagctatcacttggataaatgtcaaattgcattgaatatattagaagagaatttattctatgattctggaataggaagagacaaatttcaacatgatgttcaaactcttctgcttacaagacagcgcaaggtgtatggagatgaaacagacactctgttttccccattaatggaagctttacagaataaagacattgaaaaggtcttgagtgcaggaagtagacgattcccacaaaatgcattcatttgtcaagccttagcaagacatttctacattaaagagaaggactttaacacagctctggactgggcacgtcaggccaaaatgaaagcacctaaaaattcctatatttcagatacactaggtcaagtctacaaaagtgaaatcaaatggtggttggatgggaacaaaaactgtaggagcattactgttaatgacctaacacatctcctagaagctgcggaaaaagcctcaagagctttcaaagaatcccaaaggcaaactgatagtaaaaactatgaaaccgagaactggtcaccacagaagtcccagagacgatatgacatgtataacacagcttgtttcttgggtgaaatagaagttggtctttacactatccagattcttcagctcactccctttttccacaaagaaaatgaattatccaaaaaacatatggtgcaatttttatcaggaaagtggaccattcctcctgatcccagaaatgaatgttatttggctcttagcaagttcacatcccacctaaaaaatttacaatcagatctgaaaaggtgctttgacttttttattgattatatggttcttctgaaaatgaggtatacccaaaaagaaattgcagaaatcatgttaagcaagaaagtcagtcgttgtttcaggaaatacacagaacttttctgtcatttggatccatgtctattacaaagtaaagagagtcaattactccaggaggagaattgcaggaaaaagctagaagctctgagagcagataggtttgctggactcttggaatatcttaatccaaactacaaagatgctaccaccatggaaagtatagtgaatgaatatgccttcctactgcagcaaaactcaaaaaagcccatgacaaatgagaaacaaaattccattttggccaacattattctgagttgtctaaagcccaactccaagttaattcaaccacttaccacgctaaaaaaacaactccgagaggtcttgcaatttgtaggactaagtcatcaatatccaggtccttatttcttggcctgcctcctgttctggccagaaaatcaagagctagatcaagattccaaactaatagaaaagtatgtttcatccttaaatagatccttcaggggacagtacaagcgcatgtgcaggtccaagcaggcaagcacacttttctatctgggcaaaaggaagggtctaaacagtattgttcacaaggccaaaatagagcagtactttgataaagcacaaaatacaaattccctctggcacagtggggatgtgtggaaaaaaaatgaagtcaaagacctcctgcgtcgtctaactggtcaggctgaaggcaagctaatctctgtagaatatggaacagaggaaaaaataaaaataccagtaatatctgtttattcaggtccactcagaagtggtaggaacatagaaagagtgtctttctacctaggattttccattgaaggccctctggcatatgatatagaagtaatttaagacaatacatcacctgtagttcaaatacgtttatttatatctttatgattttattctctctctctattctcatggcactttcataacattatggctaacctctaattacagattttgcttttgcctccctgaatgaattacaagcctttttaagatatgaaatatgcctacccgcagagcttggcacaaagtggagtcaatcttttaatgttttaaatatgcattttcagactcaaataattaagaagtttcattgatatccactggtcacatcataactgtctatagggcaataaaatctgtgttaaactcaattgcttttataagttttctaaattatttcttcactgtgacagcaaagatttaaataagatgaatgtaaaagagaaagcttattggactcaaacccacagatccacaccagagttctatttacctcatcttggtatcaataaaaacttatgtggaaggtaaatatattgttccccatccaccacataacactctccccaacacacacacacacacacacacacacacacacacacacacacactccttgtaccccttgcccttctcccagctcattgctccaggagagagaagagttcaaaaaataaagtaatcataaacttgaactctctccattctcttgttcccatttacaggtgaatctcttcctttaagccatttttgtctcctgtgaatacagccttatctccacctgtttcttagatcccatctcccctggcttattttttccattcattaccctctttgttccctttacttctcaacctgtgctatatacatgctgttctctctgttgagattgccttatttccatctaacattctctctcctgctattctgatttgtcattcacaactgatttcaagagtcaccttcaccaggaagtcttccttgaccaccatcattcctgcctgattagagggcttcctcatggtaatatgtgttctcaagttttcagtgtcaaggaatgccatcccagaagctcattctcagatgcacaacagccagaacagtctcaagcagcattctagagcttggaatttaagaactacgcattgcctataaagtgaaacataggctaatatagattaaattgaatattgaataaaaaatatatttatttatccac

SEQ ID NO: 186877 - DNA, 631 bp, Homo sapiens
  Payload ID: 16795
  Gene Symbol: SAMD9L
  Gene Name: sterile alpha motif domain containing 9-like
  ENST ID: ENST00000439952
  CDS Start-End: 423-631
agaagacttcacaatttaatgcctcagtttttaaaaaaggatccttacacttcatgtctcctagccatcagaagaggaatgagacagcaaaagttcaaatggcctgtttcaagtttctgatataaaacgatgacattttcaggaaaatcctgctctgcttcctcatagctgctttccagaacgtgactcttgcaaattatcaagaaaggggaactaatctaagggatccagatcaaacagcctcatgaagacttattttatgtttctaatataaagatagaagttttcagaaaagccctgctacacagaggatcagagcaggggtgggcctgctgggctgcagctgggattctgagcatcctttcccggaggcacggaaagtgagtgagtgagcccagtgaggaagaagttgaagctttgatatgagtaaacaagtatctctacctgaaatgattaaagactggaccaaagagcatgtgaaaaaatgggtaaatgaagaccttaagattaatgagcaatacgggcaaattctgctcagtgaagaagtaacaggattagtcctgcaggaattaactgagaaggaccttgtagaaatggggctaccatggggtccagcacttttgataaaacg

SEQ ID NO: 186878 - DNA, 763 bp, Homo sapiens
  Payload ID: 16795
  Gene Symbol: SAMD9L
  Gene Name: sterile alpha motif domain containing 9-like
  ENST ID: ENST00000446959
  CDS Start-End: 555-763
agaagacttcacaatttaatgcctcagtttttaaaaaaggatccttacacttcatgtctcctagccatcagaagaggaatgagacagcaaaagttcaaatggcctgtttcaagtttctgatataaaacgatgacattttcaggaaaatcctgggtcattccggctgcttttttgagaagtccctgaagagatcaataacagcaagagggaacctggcaaggaagctattcctataatccaggaaagagatgaggaaggcttggaccaggtggtagtggtgtcagctctgcttcctcatagctgctttccagaacgtgactcttgcaaattatcaagaaaggggaactaatctaagggatccagatcaaacagcctcatgaagacttattttatgtttctaatataaagatagaagttttcagaaaagccctgctacacagaggatcagagcaggggtgggcctgctgggctgcagctgggattctgagcatcctttcccggaggcacggaaagtgagtgagtgagcccagtgaggaagaagttgaagctttgatatgagtaaacaagtatctctacctgaaatgattaaagactggaccaaagagcatgtgaaaaaatgggtaaatgaagaccttaagattaatgagcaatacgggcaaattctgctcagtgaagaagtaacaggattagtcctgcaggaattaactgagaaggaccttgtagaaatggggctaccatggggtccagcacttttgataaaacg

SEQ ID NO: 186879 - DNA, 381 bp, Homo sapiens
  Payload ID: 16795
  Gene Symbol: SAMD9L
  Gene Name: sterile alpha motif domain containing 9-like
  ENST ID: ENST00000414791
  CDS Start-End: 173-381
agaagacttcacaatttaatgcctcagtttttaaaaaaggatccttacacttcatgtctcctagccatcagaagaggaatgagacagcaaaagttcaaatggcctgtttcaagtttctgatataaaacgatgacattttcaggaaaatcctggaagaagttgaagctttgatatgagtaaacaagtatctctacctgaaatgattaaagactggaccaaagagcatgtgaaaaaatgggtaaatgaagaccttaagattaatgagcaatacgggcaaattctgctcagtgaagaagtaacaggattagtcctgcaggaattaactgagaaggaccttgtagaaatggggctaccatggggtccagcacttttgataaaacg

SEQ ID NO: 186880 - DNA, 5831 bp, Homo sapiens
  Payload ID: 16795
  Gene Symbol: SAMD9L
  Gene Name: sterile alpha motif domain containing 9-like
  Uniprot ID: Q8IVG5
  ENST ID: ENST00000411955
  CDS Start-End: 623-5377
tgggagaacagaagacttcacaatttaatgcctcagtttttaaaaaaggatccttacacttcatgtctcctagccatcagaagaggaatgagacagcaaaagttcaaatggcctgtttcaagtttctgatataaaacgatgacattttcaggaaaatcctgcatttccagagagagactggctggttaaatttctgaaagaggacaccagctaaaagaagggtcattccggctgcttttttgagaagtccctgaagagatcaataacagcaagagggaacctggcaaggaagctattcctataatccaggaaagagatgaggaaggcttggaccaggtggtagtggtgtcagctctgcttcctcatagctgctttccagaacgtgactcttgcaaattatcaagaaaggggaactaatctaagggatccagatcaaacagcctcatgaagacttattttatgtttctaatataaagatagaagttttcagaaaagccctgctacacagaggatcagagcaggggtgggcctgctgggctgcagctgggattctgagcatcctttcccggaggcacggaaagtgagtgagtgagcccagtgaggaagaagttgaagctttgatatgagtaaacaagtatctctacctgaaatgattaaagactggaccaaagagcatgtgaaaaaatgggtaaatgaagaccttaagattaatgagcaatacgggcaaattctgctcagtgaagaagtaacaggattagtcctgcaggaattaactgagaaggaccttgtagaaatggggctaccatggggtccagcacttttgataaaacgttcatacaacaaattgaatagtaagtcccctgaaagtgacaatcatgatccgggacaattagataattcaaaaccgtccaaaacagaacaccagaaaaatccaaaacacaccaaaaaggaagaagaaaattcaatgtcatctaatattgattatgatcccagagagatcagagatatcaaacaagaagaatcaattcttatgaaagaaaatgtgttagatgaagtagcaaatgctaaacacaagaaaaagggtaagctaaaacctgaacaattgacttgtatgccatatccttttgatcagttccatgacagccatcgctacatagaacattatactctacaacctgaaacaggagcactcaatctcattgatccaatacatgagttcaaagctctcacaaacacagaaacagccacggaagtggacattaagatgaaattcagcaatgaagtcttccgatttgcatcagcttgtatgaattcacgcaccaatggcaccatccattttggagtcaaggacaaaccccatggagaaattgttggtgtgaaaatcaccagtaaggctgccttcattgaccacttcaatgtaatgatcaaaaagtattttgaagaaagtgagatcaatgaagccaagaagtgtattcgggagccaaggtttgtggaagtccttctgcagaacaatacaccatctgacagatttgtcattgaagttgatactattccaaaacactctatatgtaatgataagtatttctacattcagatgcaaatttgtaaagataaaatatggaaacaaaaccaaaatctttcactgtttgtaagagaaggggctagctctagggatatcctggccaattccaagcaacgggatgtagatttcaaggcatttttacaaaatttaaagtcactggtagcatctagaaaagaggctgaagaagagtatggaatgaaggcaatgaagaaggagagtgaaggactaaagctggttaaacttctcataggaaaccgagactcactggataattcatactatgactggtacattcttgtaacaaataaatgccatccaaaccaaataaagcacttagattttttaaaagaaattaaatggtttgctgtgttggagtttgatcctgaatctatgatcaatggagtggtcaaagcttacaaagaaagtcgggtggcaaaccttcactttccaaatcaatatgaagacaagacaactaacatgtgggagaagatttctactcttaatctttaccaacagcccagctggattttctgcaacggcagatcagacctgaaaagcgagacatataaacctctagaaccacatttatggcagagagaaagagcttcagaagtcaggaaactaattttatttctcacagatgaaaatataatgacaagaggaaaatttttggtagtgtttctattactctcttcagtggaaagcccaggagatccactcattgaaactttctgggctttctatcaagctctcaaaggaatggaaaatatgttgtgtatctctgtaaactcacatatttatcaacgatggaaagatctactacaaacaagaatgaagatggaagatgaactaacaaaccacagtatttccactttaaatatagaactggtaaacagcactatccttaaactaaaatcggtgactcggtcatcaagaaggtttttgcccgcccgtggatcttcttcagttatcctagagaaaaagaaagaggatgtcttgactgcactggaaatcctctgtgaaaatgagtgtacagagacagacatcgagaaagacaaatctaaattcctggagtttaagaaatcaaaagaagaacacttttatcgaggtggcaaagtatcctggtggaacttctatttttcttctgaaaactattcttcagattttgttaaaagggacagttatgaaaagcttaaagatttaatacactgctgggcagagtctcctaaaccaatatttgcaaaaatcatcaatctttatcatcatccaggctgtggaggtaccacactggctatgcatgttctctgggacttaaagaaaaacttcagatgtgctgtgttaaaaaacaagacaactgattttgcagaaattgcagagcaagtgatcaatctggtcacctatagggcaaagagccatcaggattacattcctgtgcttctccttgtggatgattttgaagaacaagaaaatgtctactttctacaaaatgccatccattccgttttagcagaaaaggatttgcgatatgaaaaaacattggtaattatcttaaactgcatgagatcccggaatccagatgaaagtgcaaaattggcagacagtattgcactaaattaccaactttcttccaaggaacaaagagcttttggtgccaaactgaaggaaattgaaaagcagcacaagaactgtgaaaacttttattccttcatgatcatgaaaagcaattttgatgaaacatatatagaaaatgtagtcaggaatatcctaaaaggacaggatgttgacagcaaggaagcacaactcatttccttcctggctttactcagctcttatgttactgactctacaatttcagtttcacagtgtgaaatatttttgggaatcatatacactagtacaccctgggaacctgaaagcttagaagacaagatgggaacttattctacacttctaataaaaacagaagttgcagaatatgggagatacacaggtgtgcgtatcattcaccctctgattgccctgtactgtctaaaagaactggaaagaagctatcacttggataaatgtcaaattgcattgaatatattagaagagaatttattctatgattctggaataggaagagacaaatttcaacatgatgttcaaactcttctgcttacaagacagcgcaaggtgtatggagatgaaacagacactctgttttccccattaatggaagctttacagaataaagacattgaaaaggtcttgagtgcaggaagtagacgattcccacaaaatgcattcatttgtcaagccttagcaagacatttctacattaaagagaaggactttaacacagctctggactgggcacgtcaggccaaaatgaaagcacctaaaaattcctatatttcagatacactaggtcaagtctacaaaagtgaaatcaaatggtggttggatgggaacaaaaactgtaggagcattactgttaatgacctaacacatctcctagaagctgcggaaaaagcctcaagagctttcaaagaatcccaaaggcaaactgatagtaaaaactatgaaaccgagaactggtcaccacagaagtcccagagacgatatgacatgtataacacagcttgtttcttgggtgaaatagaagttggtctttacactatccagattcttcagctcactccctttttccacaaagaaaatgaattatccaaaaaacatatggtgcaatttttatcaggaaagtggaccattcctcctgatcccagaaatgaatgttatttggctcttagcaagttcacatcccacctaaaaaatttacaatcagatctgaaaaggtgctttgacttttttattgattatatggttcttctgaaaatgaggtatacccaaaaagaaattgcagaaatcatgttaagcaagaaagtcagtcgttgtttcaggaaatacacagaacttttctgtcatttggatccatgtctattacaaagtaaagagagtcaattactccaggaggagaattgcaggaaaaagctagaagctctgagagcagataggtttgctggactcttggaatatcttaatccaaactacaaagatgctaccaccatggaaagtatagtgaatgaatatgccttcctactgcagcaaaactcaaaaaagcccatgacaaatgagaaacaaaattccattttggccaacattattctgagttgtctaaagcccaactccaagttaattcaaccacttaccacgctaaaaaaacaactccgagaggtcttgcaatttgtaggactaagtcatcaatatccaggtccttatttcttggcctgcctcctgttctggccagaaaatcaagagctagatcaagattccaaactaatagaaaagtatgtttcatccttaaatagatccttcaggggacagtacaagcgcatgtgcaggtccaagcaggcaagcacacttttctatctgggcaaaaggaagggtctaaacagtattgttcacaaggccaaaatagagcagtactttgataaagcacaaaatacaaattccctctggcacagtggggatgtgtggaaaaaaaatgaagtcaaagacctcctgcgtcgtctaactggtcaggctgaaggcaagctaatctctgtagaatatggaacagaggaaaaaataaaaataccagtaatatctgtttattcaggtccactcagaagtggtaggaacatagaaagagtgtctttctacctaggattttccattgaaggccctctggcatatgatatagaagtaatttaagacaatacatcacctgtagttcaaatacgtttatttatatctttatgattttattctctctctctattctcatggcactttcataacattatggctaacctctaattacagattttgcttttgcctccctgaatgaattacaagcctttttaagatatgaaatatgcctacccgcagagcttggcacaaagtggagtcaatcttttaatgttttaaatatgcattttcagactcaaataattaagaagtttcattgatatccactggtcacatcataactgtctatagggcaataaaatctgtgttaaactcaattgcttttataagttttctaaattatttcttcactgtgacagcaaagatttaaataagatgaatgtaaaagagaaagcttattggactcaaacccacagatccacaccagagttctatttacctcatcttggtatcaata

SEQ ID NO: 186881 - DNA, 5757 bp, Homo sapiens
  Payload ID: 16795
  Gene Symbol: SAMD9L
  Gene Name: sterile alpha motif domain containing 9-like
  Uniprot ID: Q8IVG5
  ENST ID: ENST00000437805
  CDS Start-End: 819-5573
agaagacttcacaatttaatgcctcagtttttaaaaaaggatccttacacttcatgtctcctagccatcagaagaggaatgagacagcaaaagttcaaatggcctgtttcaagtttctgatataaaacgatgacattttcaggaaaatcctgcatttccagagagagactggctggttaaatttctgaaagaggacaccagctaaaagaaggtattgcatctcacccgagcagactgtgtctgtggaaagtgtaagccccttgccagaagagcagcttcccagcaaaggcagagggtgaaaacagcaaaggtcttaagacactggggacctagagtcaaaagggacctcctccagggaaaacgctgtgtgagaaatggcctcattcggtgactgtgagtgacacagcagaaagttgggtcattccggctgcttttttgagaagtccctgaagagatcaataacagcaagagggaacctggcaaggaagctattcctataatccaggaaagagatgaggaaggcttggaccaggtggtagtggtgtcagctctgcttcctcatagctgctttccagaacgtgactcttgcaaattatcaagaaaggggaactaatctaagggatccagatcaaacagcctcatgaagacttattttatgtttctaatataaagatagaagttttcagaaaagccctgctacacagaggatcagagcaggggtgggcctgctgggctgcagctgggattctgagcatcctttcccggaggcacggaaagtgagtgagtgagcccagtgaggaagaagttgaagctttgatatgagtaaacaagtatctctacctgaaatgattaaagactggaccaaagagcatgtgaaaaaatgggtaaatgaagaccttaagattaatgagcaatacgggcaaattctgctcagtgaagaagtaacaggattagtcctgcaggaattaactgagaaggaccttgtagaaatggggctaccatggggtccagcacttttgataaaacgttcatacaacaaattgaatagtaagtcccctgaaagtgacaatcatgatccgggacaattagataattcaaaaccgtccaaaacagaacaccagaaaaatccaaaacacaccaaaaaggaagaagaaaattcaatgtcatctaatattgattatgatcccagagagatcagagatatcaaacaagaagaatcaattcttatgaaagaaaatgtgttagatgaagtagcaaatgctaaacacaagaaaaagggtaagctaaaacctgaacaattgacttgtatgccatatccttttgatcagttccatgacagccatcgctacatagaacattatactctacaacctgaaacaggagcactcaatctcattgatccaatacatgagttcaaagctctcacaaacacagaaacagccacggaagtggacattaagatgaaattcagcaatgaagtcttccgatttgcatcagcttgtatgaattcacgcaccaatggcaccatccattttggagtcaaggacaaaccccatggagaaattgttggtgtgaaaatcaccagtaaggctgccttcattgaccacttcaatgtaatgatcaaaaagtattttgaagaaagtgagatcaatgaagccaagaagtgtattcgggagccaaggtttgtggaagtccttctgcagaacaatacaccatctgacagatttgtcattgaagttgatactattccaaaacactctatatgtaatgataagtatttctacattcagatgcaaatttgtaaagataaaatatggaaacaaaaccaaaatctttcactgtttgtaagagaaggggctagctctagggatatcctggccaattccaagcaacgggatgtagatttcaaggcatttttacaaaatttaaagtcactggtagcatctagaaaagaggctgaagaagagtatggaatgaaggcaatgaagaaggagagtgaaggactaaagctggttaaacttctcataggaaaccgagactcactggataattcatactatgactggtacattcttgtaacaaataaatgccatccaaaccaaataaagcacttagattttttaaaagaaattaaatggtttgctgtgttggagtttgatcctgaatctatgatcaatggagtggtcaaagcttacaaagaaagtcgggtggcaaaccttcactttccaaatcaatatgaagacaagacaactaacatgtgggagaagatttctactcttaatctttaccaacagcccagctggattttctgcaacggcagatcagacctgaaaagcgagacatataaacctctagaaccacatttatggcagagagaaagagcttcagaagtcaggaaactaattttatttctcacagatgaaaatataatgacaagaggaaaatttttggtagtgtttctattactctcttcagtggaaagcccaggagatccactcattgaaactttctgggctttctatcaagctctcaaaggaatggaaaatatgttgtgtatctctgtaaactcacatatttatcaacgatggaaagatctactacaaacaagaatgaagatggaagatgaactaacaaaccacagtatttccactttaaatatagaactggtaaacagcactatccttaaactaaaatcggtgactcggtcatcaagaaggtttttgcccgcccgtggatcttcttcagttatcctagagaaaaagaaagaggatgtcttgactgcactggaaatcctctgtgaaaatgagtgtacagagacagacatcgagaaagacaaatctaaattcctggagtttaagaaatcaaaagaagaacacttttatcgaggtggcaaagtatcctggtggaacttctatttttcttctgaaaactattcttcagattttgttaaaagggacagttatgaaaagcttaaagatttaatacactgctgggcagagtctcctaaaccaatatttgcaaaaatcatcaatctttatcatcatccaggctgtggaggtaccacactggctatgcatgttctctgggacttaaagaaaaacttcagatgtgctgtgttaaaaaacaagacaactgattttgcagaaattgcagagcaagtgatcaatctggtcacctatagggcaaagagccatcaggattacattcctgtgcttctccttgtggatgattttgaagaacaagaaaatgtctactttctacaaaatgccatccattccgttttagcagaaaaggatttgcgatatgaaaaaacattggtaattatcttaaactgcatgagatcccggaatccagatgaaagtgcaaaattggcagacagtattgcactaaattaccaactttcttccaaggaacaaagagcttttggtgccaaactgaaggaaattgaaaagcagcacaagaactgtgaaaacttttattccttcatgatcatgaaaagcaattttgatgaaacatatatagaaaatgtagtcaggaatatcctaaaaggacaggatgttgacagcaaggaagcacaactcatttccttcctggctttactcagctcttatgttactgactctacaatttcagtttcacagtgtgaaatatttttgggaatcatatacactagtacaccctgggaacctgaaagcttagaagacaagatgggaacttattctacacttctaataaaaacagaagttgcagaatatgggagatacacaggtgtgcgtatcattcaccctctgattgccctgtactgtctaaaagaactggaaagaagctatcacttggataaatgtcaaattgcattgaatatattagaagagaatttattctatgattctggaataggaagagacaaatttcaacatgatgttcaaactcttctgcttacaagacagcgcaaggtgtatggagatgaaacagacactctgttttccccattaatggaagctttacagaataaagacattgaaaaggtcttgagtgcaggaagtagacgattcccacaaaatgcattcatttgtcaagccttagcaagacatttctacattaaagagaaggactttaacacagctctggactgggcacgtcaggccaaaatgaaagcacctaaaaattcctatatttcagatacactaggtcaagtctacaaaagtgaaatcaaatggtggttggatgggaacaaaaactgtaggagcattactgttaatgacctaacacatctcctagaagctgcggaaaaagcctcaagagctttcaaagaatcccaaaggcaaactgatagtaaaaactatgaaaccgagaactggtcaccacagaagtcccagagacgatatgacatgtataacacagcttgtttcttgggtgaaatagaagttggtctttacactatccagattcttcagctcactccctttttccacaaagaaaatgaattatccaaaaaacatatggtgcaatttttatcaggaaagtggaccattcctcctgatcccagaaatgaatgttatttggctcttagcaagttcacatcccacctaaaaaatttacaatcagatctgaaaaggtgctttgacttttttattgattatatggttcttctgaaaatgaggtatacccaaaaagaaattgcagaaatcatgttaagcaagaaagtcagtcgttgtttcaggaaatacacagaacttttctgtcatttggatccatgtctattacaaagtaaagagagtcaattactccaggaggagaattgcaggaaaaagctagaagctctgagagcagataggtttgctggactcttggaatatcttaatccaaactacaaagatgctaccaccatggaaagtatagtgaatgaatatgccttcctactgcagcaaaactcaaaaaagcccatgacaaatgagaaacaaaattccattttggccaacattattctgagttgtctaaagcccaactccaagttaattcaaccacttaccacgctaaaaaaacaactccgagaggtcttgcaatttgtaggactaagtcatcaatatccaggtccttatttcttggcctgcctcctgttctggccagaaaatcaagagctagatcaagattccaaactaatagaaaagtatgtttcatccttaaatagatccttcaggggacagtacaagcgcatgtgcaggtccaagcaggcaagcacacttttctatctgggcaaaaggaagggtctaaacagtattgttcacaaggccaaaatagagcagtactttgataaagcacaaaatacaaattccctctggcacagtggggatgtgtggaaaaaaaatgaagtcaaagacctcctgcgtcgtctaactggtcaggctgaaggcaagctaatctctgtagaatatggaacagaggaaaaaataaaaataccagtaatatctgtttattcaggtccactcagaagtggtaggaacatagaaagagtgtctttctacctaggattttccattgaaggccctctggcatatgatatagaagtaatttaagacaatacatcacctgtagttcaaatacgtttatttatatctttatgattttattctctctctctattctcatggcactttcataacattatggctaacctctaattacagattttgcttttgcctccctgaatgaattacaagcctttttaagatatgaaatatgcctacccgcagagcttgg

SEQ ID NO: 186882 - DNA, 1198 bp, Homo sapiens
  Payload ID: 16795
  Gene Symbol: SAMD9L
  Gene Name: sterile alpha motif domain containing 9-like
  ENST ID: ENST00000446033
  CDS Start-End: 990-1198
agaagacttcacaatttaatgcctcagtttttaaaaaaggatccttacacttcatgtctcctagccatcagaagaggaatgagacagcaaaagttcaaatggcctgtttcaagtttctgatataaaacgatgacattttcaggaaaatcctgcatttccagagagagactggctggttaaatttctgaaagaggacaccagctaaaagaagggtcattccggctgcttttttgagaagtccctgaagagatcaataacagcaagagggaacctggcaaggaagctattcctataatccaggaaagagatgaggaaggcttggaccaggtggtagtggtgtcaggtagtcaaatgctgggtatattttgaagatacaccccataggatttgctccacattgaatgtggaatgctggaagagagataaagtgtacctgtcacatactttttgagttttatttattttcttagaagtaagtacacaaagagatgctacctaggagaagggtattcttttcactattctttcaaattttctgtatgttcaaacattttcatagtagaaagttggggggaaaatctgtttcataaacatttcctcagcagcagtccagtctattgcattttaattggttgtgatatcattgttttatgcaatacgttctcaacaagtatatcctccggcaaactgaacaaggaccaagtctgttctgcctacagctctgcttcctcatagctgctttccagaacgtgactcttgcaaattatcaagaaaggggaactaatctaagggatccagatcaaacagcctcatgaagacttattttatgtttctaatataaagatagaagttttcagaaaagccctgctacacagaggatcagagcaggggtgggcctgctgggctgcagctgggattctgagcatcctttcccggaggcacggaaagtgagtgagtgagcccagtgaggaagaagttgaagctttgatatgagtaaacaagtatctctacctgaaatgattaaagactggaccaaagagcatgtgaaaaaatgggtaaatgaagaccttaagattaatgagcaatacgggcaaattctgctcagtgaagaagtaacaggattagtcctgcaggaattaactgagaaggaccttgtagaaatggggctaccatggggtccagcacttttgataaaacg

SEQ ID NO: 186883 - DNA, 1221 bp, Homo sapiens
  Payload ID: 16795
  Gene Symbol: SAMD9L
  Gene Name: sterile alpha motif domain containing 9-like
  Uniprot ID: Q8IVG5
  ENST ID: ENST00000610760
  CDS Start-End: 1-1221
atgagtaaacaagtatctctacctgaaatgattaaagactggaccaaagagcatgtgaaaaaatgggtaaatgaagaccttaagattaatgagcaatacgggcaaattctgctcagtgaagaagtaacaggattagtcctgcaggaattaactgagaaggaccttgtagaaatggggctaccatggggtccagcacttttgataaaacgttcatacaacaaattgaatagtaagtcccctgaaagtgacaatcatgatccgggacaattagataattcaaaaccgtccaaaacagaacaccagaaaaatccaaaacacaccaaaaaggaagaagaaaattcaatgtcatctaatattgattatgatcccagagagatcagagatatcaaacaagaagaatcaattcttatgaaagaaaatgtgttagatgaagtagcaaatgctaaacacaagaaaaagctagaagctctgagagcagataggtttgctggactcttggaatatcttaatccaaactacaaagatgctaccaccatggaaagtatagtgaatgaatatgccttcctactgcagcaaaactcaaaaaagcccatgacaaatgagaaacaaaattccattttggccaacattattctgagttgtctaaagcccaactccaagttaattcaaccacttaccacgctaaaaaaacaactccgagaggtcttgcaatttgtaggactaagtcatcaatatccaggtccttatttcttggcctgcctcctgttctggccagaaaatcaagagctagatcaagattccaaactaatagaaaagtatgtttcatccttaaatagatccttcaggggacagtacaagcgcatgtgcaggtccaagcaggcaagcacacttttctatctgggcaaaaggaagggtctaaacagtattgttcacaaggccaaaatagagcagtactttgataaagcacaaaatacaaattccctctggcacagtggggatgtgtggaaaaaaaatgaagtcaaagacctcctgcgtcgtctaactggtcaggctgaaggcaagctaatctctgtagaatatggaacagaggaaaaaataaaaataccagtaatatctgtttattcaggtccactcagaagtggtaggaacatagaaagagtgtctttctacctaggattttccattgaaggccctctggcatatgatatagaagtaatttaa

SEQ ID NO: 186884 - DNA, 4190 bp, Homo sapiens
  Payload ID: 16796
  Gene Symbol: SRD5A3
  Gene Name: steroid 5 alpha-reductase 3
  Uniprot ID: Q9H8P0
  ENST ID: ENST00000264228
  CDS Start-End: 229-1185
atgcccagattagggactgcgagcgaccacccagcgccagcgcgaccaggaccaaggacctccgcggctgagcggcgagtccgggaggggctctgcgcgtccccgccccgcgccgcgtcaccgacgtcccgctaggctgagaccggtgcgccgcgcgctagtggccgctcttccgcgggctagcgggcggtgggggcgccagcagcgcggaaggcgggcacgcgggccatggctccctgggcggaggccgagcactcggcgctgaacccgctgcgcgcggtgtggctcacgctgaccgccgccttcctgctgaccctactgctgcagctcctgccgcccggcctgctcccgggctgcgcgatcttccaggacctgatccgctatgggaaaaccaagtgtggggagccgtcgcgccccgccgcctgccgagcctttgatgtccccaagagatatttttcccacttttatatcatctcagtgctgtggaatggcttcctgctttggtgccttactcaatctctgttcctgggagcaccttttccaagctggcttcatggtttgctcagaattctcggggcggcacagttccagggaggggagctggcactgtctgcattcttagtgctagtatttctgtggctgcacagcttacgaagactcttcgagtgcctctacgtcagtgtcttctccaatgtcatgattcacgtcgtgcagtactgttttggacttgtctattatgtccttgttggcctaactgtgctgagccaagtgccaatggatggcaggaatgcctacataacagggaaaaatctattgatgcaagcacggtggttccatattcttgggatgatgatgttcatctggtcatctgcccatcagtataagtgccatgttattctcggcaatctcaggaaaaataaagcaggagtggtcattcactgtaaccacaggatcccatttggagactggtttgaatatgtttcttcccctaactacttagcagagctgatgatctacgtttccatggccgtcacctttgggttccacaacttaacttggtggctagtggtgacaaatgtcttctttaatcaggccctgtctgcctttctcagccaccaattctacaaaagcaaatttgtctcttacccgaagcataggaaagctttcctaccatttttgttttaagttaacctcagtcatgaagaatgcaaaccaggtgatggtttcaatgcctaaggacagtgaagtctggagcccaaagtacagtttcagcaaagctgtttgaaactctccattccatttctataccccacaagttttcactgaatgagcatggcagtgccactcaagaaaatgaatctccaaagtatcttcaaagaataaatactaatggcagatctgcgatttctgggtccactttctgagatgctttctaaaaccaaccaactgataaaaagtagatgagacttctccaagctgcttcacaagcaaactaaccgaaaaaccgaaaatatacaaacagcttcacacacacacacacacacacacacacacacacacacacacaaaggaagatcatcaatggctgcggtagcctagtaggaatggactatataataatatagcaggtgctcaataactgtttgttgcatttcagtaaaagcagaataacctttcaaaataataacaggctgggtgcaatggctcacacctgttaatcccagcacttcgggaggccaaggtgggcagttcgcttgggcccaagagttcgagaccagcctgggcaacatggtgaaaccctatctccgtgaaaaaatatgaaaattagccaagagtggtggcacatgcctgtagtcccagatacttgggagtgggctgagatgggagaatcgcttgagcccaggaggtcaagggtacagtgagccgaggtcatgccactgcactccagcctggcctgggcaacagagcaagaccctgtctcaaaataataataatatataattttacaccaaaagtttcaggaaaaaacgagtttgttggagttagtttatactttcacatatcaccacaaagatctccagttaaataactatcaatatccatttccattcatctccccctcaaatcatagcctaacagaacactttgaaagctcttttatttaatatttttttacatcctttgaagggagtgcttcaaaaatgaaagcatcagaagataaaatatttttatatttatgcatagcaagccttcgtgaacggaagtgacacactctggattgaataatactgtagcctcattcatatgtagttattcaaattggattaatgtctgtgtgagtttatttgaactagcagaaagtatctgaagatattcaggaataaagtttatacttaaaatagcttatgttaaagaaaatacctgtgattaattcagagggaaataaatgcatggtataaaagaaaaccaaaaacttaaaaaataatactatagcctgagcaacacattaaaactgcacacttgtgcagcgtaagattctctggcttattggctgaggtgttaagtttattccttttatgaagatgtcctattacagtcagctaagcactaaagctttgcatttatatgtactttgctatgggggaaagaaccttatgattaataagacacatatcaaatgcatagtcaatcattcccacccccatccctggagctgtaacccaaaactgttaaactaagattcctttgttttttttgtttttttgagatggagtctcactctgtcgcccagactggagtgcagtggtgggatcctggctcactgcaacctccgccttctgggttccagcgattctcctctgcctcagcctcccaagtagctgggattacaggcacatgccaccatgcccaggtaattgttgtatttttagtagagatagagtttcaccatgttggccaggctggtctcaaactcctgacctcaggtgatccacctgcttcggcctcccaaagtgctgggattacaggtgtaagtcactgctcccggatgcatgtcaagcacattggaaagttcttacaacaattctgatggaggattttctctcccatcaaccaaacaccacttaagattaacctgtggctcagtctacttaaataaatgccatatttattttacttatcatttagaatttgccattctcaggaacaaaactttttgtacattggaaatggaaaacattgcagtttggtcttaatttccacatgaatatcaagtgtaatttttaataaattatttggagaaaaatgtattttattttagcatgcaattttatgcccaggttagactagagatttggctgatgttctggaatctcattgtactcttaagtaaaataacgagcatcccatgacgcaccctgtcaggggttgtgagaaagctgcagtgtccagtttcccacccctgtttcctgctgtctctctcccactcatccctgtttcttactcatcccttttccttctttgcccaaacatcatatttctaggcaaagataagagaggagatagtgatgtcctgaaaggggttcagaacaacgtagcatggcctttggtgaaagcgtcaccgatgggaaataattgagaattgtgcagtgcttgcagcgtcagaatcagcactgttttttgtgttggtgaaaatattccatgtgcgtaaagggagagcatcagggactttgcaaattcttcacaaggacccagaaatagcttaaagattcatggttttcctgttggcttaaatagccttaatctttcattttctactaccattaagtcggggaaatgacattgaactacctcattagcagccttcccttgattaactactgactaaaagtgtgctgaaaatggcctttgtttttgtgaagctcatcctatacactaacatttgcttaaccatggattattttgtctctacaaagctgtgccctgtattcgatttttacttcaatgagtggttattgctagaattcctacaaaaaaaaaaaaaaccgttgcagatatttttgtatgtagcttaatagatatttagtttaaggagactgcaacatttgcataaggtgcctaaaaactcaagaaccattgataagtgagatcactcaaaatgagctgatatattaaagaagaccttaaaacag

SEQ ID NO: 186885 - DNA, 768 bp, Homo sapiens
  Payload ID: 16796
  Gene Symbol: SRD5A3
  Gene Name: steroid 5 alpha-reductase 3
  ENST ID: ENST00000505210
  CDS Start-End: 1-549
ttcctgctgaccctactgctgcagctcctgccgcccggcctgctcccgggctgcgcgatcttccaggacctgatccgctatgggaaaaccaagtgtggggagccgtcgcgccccgccgcctgccgagcctttgatgtccccaagagatatttttcccacttttatatcatctcagtgctgtggaatggcttcctgctttggtgccttactcaatctctgttcctgggagcaccttttccaagctggcttcatggtttgctcagaattctcggggcggcacagttccagggagtggtcattcactgtaaccacaggatcccatttggagactggtttgaatatgtttcttcccctaactacttagcagagctgatgatctacgtttccatggccgtcacctttgggttccacaacttaacttggtggctagtggtgacaaatgtcttctttaatcaggccctgtctgcctttctcagccaccaattctacaaaagcaaatttgtctcttacccgaagcataggaaagctttcctaccatttttgttttaagttaacctcagtcatgaagaatgcaaaccaggtgatggtttcaatgcctaaggacagtgaagtctggagcccaaagtacagtttcagcaaagctgtttgaaactctccattccatttctataccccacaagttttcactgaatgagcatggcagtgccactcaagaaaatgaatctccaaagtatcttcaaagaataaatactaatggcagatctgcga

SEQ ID NO: 186886 - DNA, 2165 bp, Homo sapiens
  Payload ID: 16797
  Gene Symbol: SRA1
  Gene Name: steroid receptor RNA activator 1
  Uniprot ID: Q9HD15
  ENST ID: ENST00000336283
  CDS Start-End: 823-1533
ttatagcaaaatcagtgcaaataaaaatccctcagtgacctcactggatgtgagtatattgggcctgggacagggctgggggctaacaccctgtgtgagatgagtgtctttgtgtctgtgcttgatgttggtggctctctgtagtcacatgacagcatgggtgtgatggagatctgacttcattcaacaaacatattttctaaggagttccctgtgccaggcactaagctgggcactgggaatgtaataaaatagtcaaggtcccaccttctaagactgtccgacagggaaacgaacaagagtcaaataaggcagaagatgtgatgtaatacacctacgaaatctcagagggttgtagggtcgtgggagctcaagtgagacacttaacctggcctgagacattccagaaggcctcctgaagaactgacatctgaactgagaactgaaggaagatgagtactagtgaggctaccggacgtgaatgtggagattgtgcagggcaatgcaagaggaggctgtagaagtcaacctggctagatcacagcggggtgtatgtggggcaggagcttctttgtttgaatttgctcctgagaggatgaggcctcctagagcactggctcctggacagcaacctcctttggtgccttgtgaccagggccctgatggttcattagatggagccttcgagtcttagggagttgccgcagggtccccacagcggctcccgacggttgtgaaccagcatccatcctccacggattccggcaacccgcctggccctggacgtgtctcaactggcccgcgtgaggggccgccccggaaatgacgcgctgccccgctggccaagcggaagtggagatggcggagctgtacgtgaagccgggcaacaaggaacgcggctggaacgacccgccgcagttctcatacgggctgcagacccaggccggcggacccaggcgctcgctgcttaccaagagggtcgccgcaccccaggatggatcccccagagtccccgcatcagagacttctcctgggcctcccccaatggggcctccacctccttcaagtaaggctcccaggtccccacctgtggggagtggtcctgcctctggcgtggagcccacaagtttcccagtcgagtctgaggctgtgatggaggatgtgctgagacctttggaacaggcattggaagactgccgtggccacacaaggaagcaggtatgtgatgacatcagccgacgcctggcactgctgcaggaacagtgggctggaggaaagttgtcaatacctgtaaagaagagaatggctctactggtgcaagagctttcaagccaccggtgggacgcagcagatgacatccaccgctccctcatggttgaccatgtgactgaggtcagtcagtggatggtaggagttaaaagattaattgcagaaaagaggagtctgttttcagaggaggcagccaatgaagagaaatctgcagccacagctgagaagaaccataccataccaggcttccagcaggcttcataatcctcggttccccagactcaccggacaccatctcctatgccttggagaccttctgtcacttggctcccttcttaccaccaccaagactgtcccactgggcctgacccacctatgagggaagaagtcccacctgggccagagggagttcatgtgttactcataacatgcatttcaataaaaacatctctgcggtgggccttgggtaggagagatgaacccttccggtgccaagctagtcccctctggtgtcctcgactgccctgctccctgtgtatctgcaaacctctgttctcccttctccattcatcaggaagggatctgctgggtaaagtcagactactgcctaccactttttcccaaagtagactgaaagcacatcctgtgctgggcggagcagctgtgtttggatggtttcatttcagcatgagaacagactcaaatagaacggggagacttttccctcaacaaaaggaaagacagtcctatttgcactgtatcacccttgagatactactgttacagagattagaaccacattgagtggggttttctgtgtaaatcgaaggagaaaaagaccagattactgagattggggattgtaactctgacttgccaaacaaactgctgcctca

SEQ ID NO: 186887 - DNA, 461 bp, Homo sapiens
  Payload ID: 16797
  Gene Symbol: SRA1
  Gene Name: steroid receptor RNA activator 1
  ENST ID: ENST00000602657
  CDS Start-End: 1-226
gcaggaacagtgggctggaggaaagttgtcaatacctgtaaagaagagaatggctctactggtgcaagagctttcaagccaccggtgggacgcagcagatgacatccaccgctccctcatggttgaccatgtgactgaggaactaagttttaatggcaaacctacagcttacttaagatatccctccagagagagagcaaggcaattgtacctgacacagcattgacaccaaatgaccagattccactgtgtccaacgggagcgacaaaactggtccccgccggggcttgtgcaacagaccctccttgccgaattcgggccagtctctctgttccaattgggggaggtatctttcgatcttgactggcactgactccttttggttggcccaacgttggtggggcagaagtggctgaaagaggtgaagatgatcccgaagaaacagatggaataggagagtc

SEQ ID NO: 186888 - DNA, 6521 bp, Homo sapiens
  Payload ID: 16798
  Gene Symbol: STS
  Gene Name: steroid sulfatase (microsomal), isozyme S
  Uniprot ID: P08842
  ENST ID: ENST00000217961
  CDS Start-End: 221-1972
acagtgctgttggccaagcctccagcagctgacgggacccagctgtagtgaggttgcagtgattgagtaggattggcctgcttcaaagcagaggtttctcatgggaatatgcttattaaactcccactggtgcagaaaccatgaacagaggatgaacaagtgaagttgcaatctcctccatcacagctcagttccccaacaacaggatcacaagctggagatgcctttaaggaagatgaagatccctttcctcctactgttctttctgtgggaagccgagagccacgcagcatcaaggccgaacatcatcctggtgatggctgacgacctcggcattggagatcctgggtgctatgggaacaaaactatcaggactcccaatatcgaccggttggccagtgggggagtgaaactcactcagcacctggcagcatcaccgctgtgcacaccaagcagggcagccttcatgactggccggtaccctgtccgatcaggaatggcatcttggtcccgcactggagttttcctcttcacagcctcttcgggaggacttcccaccgatgagattacctttgctaagcttctgaaggatcaaggttattcaacagcactgatagggaaatggcaccttgggatgagctgtcacagcaagactgacttctgtcaccaccctttacatcacggcttcaattatttctatgggatctctttgaccaatctgagagactgcaagcccggagagggcagtgtcttcaccacgggcttcaagaggctggtcttcctccccctgcagatcgtcggggtcaccctccttacccttgctgcactcaattgtctggggctactccacgtgcctctaggcgtttttttcagccttctcttcctagcagccctaatcctgacccttttcttgggcttccttcattacttccggcccctgaactgcttcatgatgaggaactacgagatcattcagcagcccatgtcctatgacaatctcacccagaggctaacggtggaggcggcccagttcatacagcggaacactgagactccgttcctgcttgtcttgtcctacctccacgtgcacacagccctgttctccagcaaagactttgctggcaaaagtcaacacggagtctacggggatgctgttgaggaaatggactggagtgtggggcagatcttgaaccttctggatgagctgagattggctaatgataccctcatctacttcacatcggaccagggagcacatgtagaagaagtgtcttccaaaggagaaattcatggcggaagtaatgggatctataaaggaggaaaagcaaacaactgggaaggaggtatccgggttccaggcatccttcgttggcccagggtgatacaggctggccagaagattgatgagcccactagcaacatggacatatttcctacagtagccaagctggctggagctcccttgcctgaggacaggatcattgatggacgtgatctgatgcccctgcttgaaggaaaaagccaacgctccgatcatgagtttctcttccattactgcaacgcctacttaaatgctgtgcgctggcaccctcagaacagcacatccatctggaaggcctttttcttcacccccaacttcaaccccgtgggttccaacggatgctttgccacacacgtgtgcttctgtttcgggagttatgtcacccatcacgacccacctttactctttgatatttccaaagatcccagagagagaaacccactaactccagcatccgagccccggttttatgaaatcctcaaagtcatgcaggaagctgcggacagacacacccagaccctgccagaggtgcccgatcagttttcatggaacaactttctttggaagccctggcttcagctgtgctgtccttccaccggcctgtcttgccagtgtgatagagaaaaacaggataagagactgagccgctagcagcgcctggggaccagacagacgcatgtggcaaagctcaccatcttcactacaaacacgcctgagagtggcactggggaaacataactccatctacaccttggatttggactgattctccattttatcacctgaaggcttgggccagagctcaacagctactcaactggaggggtgagggggataaggtctgtagtatacagacaggaagatggtaggtttatgccttctgtggccagagtcttggactcatggaaatagaatgaatagaggggcattcacaaggcacaccagtgcaagcagatgacaaaaaggtgcagaaggcaatcttaaaacagaaaggtgcaggaggtaccttaactcacccctcagcaaatacctatgtcaacagtataagttaccatttactctataatctgcagtgatgcaataaccagcataataaaaaggcaatcacataaaaaagagtttagtcgtctaaacataagtaactttaaggtgaatgaaagatcttctttaggaataatagatgatggtaagttccactttggttattggaaggcaagtcattattactggtattagttaaaacacatatcaaatgcttgctcttcatcatatatatagttatgcatacatacacacacacacatacagtatattctttcctcaaaagggttaagatgtctaaaatagggacctagaagcttaacactatttaagtaaatacagtagaagctcacaaatagatttctttgcacaatgattttttgcaaaattttacagtaataataatcccaaggcaaatctctcctgaactgctttccattccataatttgtagtataattcttggattccactgttttctttggggaatggaagttctgaattaaaagcccactgtggagatgctgtggttcatggaatctcttccagtgtaattcagaatcattggcctagaaagtctctgatatttggaggggaacaaaaatcactcacaagcaatccatgatctatacacataagcataatttcctttagttctagttagtcatcagagaacagtcatgtatgcaagttttgtgactgagaaatttctgtgcttccaatccacaatgagatgcatgattttgttttcatcccatttcccccaagcccctgtaaatcagggaaaatgcgcaactgatcgcctaggagagggcctcgtagtggcacagctggagatagtttcaaagtctaaaccaccagcccatcctgaggaaagcctcctatggaatgtaaagtgcaatcatttcttcagatataagactttccccaacaatgtgattggattcctttatggcaaaatcgagagaagctgccatccacctgcttatgcatttatctcttttgtggacttgtctgaccaccttctatttgcccagagtttgctcaattccaagacagtgcccatgaatgggacacctgtaatgtaacccacacagcggtttgcagagaatgttagccatgacttgggctttctgaaagttggctataatttctctatccctacccacaaccctgggaagttggagcaagaggggcatactattgggctgggaggatttgacagcatttccccagttgccctttaagttcttctatttcaaacgttaattttgcttctctttctaaaaaaaaaaaaaaaaaagaaagagaagaaagaagtgattcctaccccctacctccagagttgttgaaagctgaaaagcatacaagattcttccttttaacttggatttctcgttccagaaattgtgggataatctgtattcttgctttagaaaacattcttagagagggtactagcttactgatgatgtgttaggattgctactgatgctgtcatgtggaaactatttaaaggcactattataaatttatcctataagatgacaatgtttactcaaagtctaacatattcaatgcaagtaagactttctgaaaacacttgatgatgtggaaatgctgcaggattaaataacttgaagagcctttatagattatatgaatgcctatttgtgtctagaaccagttatttaacctgtaaaatgtcaatagcaaatgaaggatgaagtatatctctagatgcaaatacattgagtttaaaagtgcctcaaaataattgagatcacatttcaggacatttggaaatcaggtcgatttgtggtaactgtagtcatcttaaatttcaaaccatttaccatctgaaagttttgatttgaatgtaaaacaggaaattggaattcctttgtccaggagaaacctcacaaaccttctttaaggcatagttttgttgtttgtttgcttgtttgttgcaggctgtaaggcatggctgcttgtttacaaagcatctcattcatattacctgtggagttgcatatccaaaccttagtgagttttgaagctttaagcaaattcttttaaaaaattcttgtatttctagcattactagatattaaaagttaagcaaatagattaatgacgtatacataggcatcatttcacaaggtcagtaatgctgcaggaaaagcaaaattgcaatctacgtatctatggtactaaggaagtcctgtttttcaaaaatggaagcccacttctcagatttttctgaagggcatacaatgaaaagtgaaggggaaacacacacacacaaaaaaacaagtatttggcttgtcacaggaatctgattgcattaagtgaaaggattatttagaatatgttaatgcaaagctaaaataaaattttccttggcaattaaaaatgctgtgcgctaataccctgctttctatcgtgactcaattcaacaatgtggggaatgtttactacatttccaacttgatgtcaagcaatggggaatacaagttccagttctgcaaagattcgtcaactttcttagctcaagagagaggctgagaaatgcagagaagaataagacataaaatagctccgacctccatgatccgagagtgggaaaaggcccgattattacccataaggcacactctctaaggccttttaaggggcctacaaaaatgttttattttataatcagaagaaaaggaaatgaacattggggattgaaaatcatattggtatttgcaccaacatagtcataaaatagtatgttaatatgtttttactttatatatttatatattaaaatatatttaatatgttttgcctttgtggcccatgaaagtcttactgggccctggggaaggtatcctaccctggtgaagcagctgctttgctctacaaatacctggggcagaaatttgatttgaaaagtattattctctcttctctttgtttcaactggattcctttggaaaaccaaactagtatcagaacaaaccccgaaacagtaagaaattggagtgagaagggcatggtattgggactaggatcggctctcattcgatcgagctattctcttaaaatgacaaaaagtgtccataaagaggctgctggagagtgcgtggccatagggagccgacatgcccgggaggaaaggtgttgattacatggatacttctaaaagctaaagccttgttgccttctctttaatgcctagagaatgggatgtgtgatgcaaatgctcaaaacctcttaaatcatagctgtctgacctctacggacctcacatccatctgaggcttcatggacaaagattctccacttggccaaactttagccaagctcctcaaccttctcccaggcccaatctgggcacttccttgtaaaatctagttttggcaagaagtctattaggtcagtttagcaagaacacctaacccccccatatctgttcaacctcagtatctgatcaggctcctcagcctccaccatcccccaggtgatgtctggtcaactggcctgccttcagctagaatcctgttaggtcggtttagatgaatgctccctgatatttcctcttggtaatcttccatccactgcccctgaccctgttccctgtctataaatccccagttttccatggtgtattcagagctgagtccagtctctctcccctactacaagtccccattgctgtggtccccgtacctgtcatgatggtcctaaataaagtcttactgtgctttaataggtagcattgaaaaatttttttctttgacatcattcatgacaacatgaaacctattgggacagcatgactgtgcagggtctttagagctcagctttctgaggccctgagcattcttggttttccgacatcgtgaacctgttctgtgttgcaagatatcactcaagccagtgttgcttaataccatctctttgtgtaatagatctgaataaagtaattgtaatacaccaatattttactttgttgagtattattttaatgggagcctttccaatgaaggaaacatcagctttccttgttagaatgcaagcagcttaaaaactacccatgtctttctggaaaggaaacattgccatgtaactatgtatcagttttctaagaacttcatgggccttccata

SEQ ID NO: 186889 - DNA, 7132 bp, Homo sapiens
  Payload ID: 16799
  Gene Symbol: SRD5A1
  Gene Name: steroid-5-alpha-reductase, alpha polypeptide 1 (3-oxo-5 alpha-steroid delta 4-dehydrogenase alpha 1)
  Uniprot ID: P18405
  ENST ID: ENST00000274192
  CDS Start-End: 235-1014
tggggcgcttgcaggtccctccccgcgcaagtgctcgccccgcccccggggccgcacccacagccccggctaccccggagaagcctgacttgagaaccctttctgcagagtcccggcagtgcgggactccggtagccgcccctccggtagccgcccctcctgcccccgcgccgccgccctatatgttgcccgccgcggcctctggggcatggagcacgctgcccagccctggcgatggcaacggcgacgggggtggcggaggagcgcctgctggccgcgctcgcctacctgcagtgcgccgtgggctgcgcggtcttcgcgcgcaatcgtcagacgaactcagtgtacggccgccacgcgctgcccagccacaggctccgagtgccggcgcgggccgcctgggtggtgcaggagctgccctcgctggccctgccgctctaccagtacgccagcgagtccgccccgcgtctccgcagcgcgcccaactgcatcctcctggccatgttcctcgtccactacgggcatcggtgcttaatttacccatttctgatgcgaggaggaaagcctatgccactgttggcgtgtacaatggcgattatgttctgtacctgtaacggctatttgcaaagcagatacttgagccattgtgcagtgtatgctgatgactgggtaacagatccccgttttctaataggttttggcttgtggttaacgggcatgttgataaacatccattcagatcatatcctaaggaatctcagaaaaccaggagatactggatacaaaataccaaggggaggcttatttgaatacgtaactgcagccaactattttggagaaatcatggagtggtgtggctatgccctggccagctggtctgtccaaggcgcggcttttgctttcttcacgttttgttttttatctggtagagcaaaagagcatcatgagtggtacctccggaaatttgaagagtatccaaagttcagaaaaattataattccatttttgttttaagtgcgtttttcatgaaattatcttcaacttgaagctttccaatggcgcttctctatggactttgtaaataagttatatctttgtaattttcctgctactttatcattttcaagatgtcctctaggaattttttttctagtaattttgcaatctacctaataagtacctaaatacgctgaaatggaggttgaatatcctactgtgtaacaggtcagaatttcaagctctgggtaataactgctgatattttttctaatttcaaatttacctcttttggctatgtcttgccaagtgtgtatgagactagactttacaactgtctttgatggcattttcagaacaataaatgtcacaatcccttctatagccccctacagtgatctcttcaaggtcaactgcagtgttgcttccctccccctatagggctggaatctgtctaggagccctctctcggaggccacagaggctgggggtagccattgtgcagtcatggcccgggggaaacttgccaaccttcgtgtcaggtgctgtgtgtaagtggagaacttggggatagaggaggaagctcctcgtggcccttccaaggtgaggcaaaggcatctggacttgttccagcccagcccaccgggtgacatcaccgggcagggaggggtgctggtggtggttcatacggagtaagctgctctgcctgtgtgagtggctcctgggccctaaacaggcacctttaggccatgggtcactcaccgtgagccatcaatgtgctctggtctgacatggtttctctctgtcttctagtctagacctagtttttttgttctgttccccacgtatggatatagtagagattgttgtctgtgaaatttctcttttgtagattttgagttttcccttgtagtgtaaagaatgatcactttctgtaacaataacaagaccactttttaagatttatcctgtttgttctttgttgattgaaacataataattgttaaaattctctacagccttctttttcttccatagctaatcttccttctaatagtttttgctttctgttttgctgttgttgctttgcaaagctttcccctcatagcctgtacctgttatcaatataaaataatcttcctgttgaatgcttcatgacttgaattctactttgataaaaacattgccatactgctttttatcttgatgaattcatctggcattgctttgccttatcatctcatctggagtttttaaatgccatttgtttcagttgtctttaacaacataataaatagactttgccatttaacaaggtagctcaaattcttttactaattgttacatcgaaacattctttcatcatatttcctgtttttatttggttttttcaacttcttctgtttactatctacagtgatttggaaaggagatttcctttaaaacaaacaagcttattgggaatggcttttatgatttttaaagtagccttgagagcttccagttaaatctgatgagctgaacatacacctttccttctcccctctctattctgaccccagttgaaatcacctcaaaggaatttaggtgggggagtggccccataaagagagtgagagagagtcaccactgcagatggaccacagcacgggtggagatgggcctgatgtggcagagcagagaggccatgacagtgcacaccctgcggagaccctgggtcctcacatctgggctgacagaaggcagagggaaatgagcatctcaaagtgagaccaactaaacatggcgcctgcagcagaaagcagtgtcctctgcacccccactctccagggagagcacagagagcccagaaatgagccatgtgcccattgccggggaagagaaggtaggctgaggaggtggcctttcctaacacaaaaattaactaagtggggaaaaccagagaactaggtgttggcatcccaggaaaaaaataaagtctccacattttggcctatagggatcctgccccataatggctggttacctcctgcctcaagctgcagggaagccagggggtggcatggccatggcttctccctcagagaggcctctgtgcacgacttcagtcacccaacactgacagaacttggaacccaaaagcccatttctctccttccgtccagaccctgtctgctgttatctgtaggaagaccacagccaactgctatcatgaccaaagctaaaatccaatgaggcagagaacaatagttgtacccatctcctccttagtctccaaggccagcggtgcatgcatttgtgcattcaacaacatttgccaagcacttactgtatatcaagcacagcagtgggtgctgaggacggatgggtagaaaaaacagtcctggcccaggtggagtgacaggtaagaaacaagtaagtagctaaaataatgttaggtagaaaaaaataacaagaataaaagcaaggaaaagggaagggaccctcacttgtgtctgatacagccataatcttctctatcggccattgctgtaaccaaagcttaaccacctttcttaagatattgatcaaccagatcattgcaaatactgctaattgattcctttttatggctgagtagtattccattgtatatatatatataccacttgttgactgatgggcatttgggttggttccacgattttgcagttgtgaattgtgctgctataaacatgtgcgtgcaagtatctttttttgaataatgacttcttttcctctgggtagatacccagtaatgggattgctggatcaaatggtagttctacttttagttctaaggaatttccacactgttttccatggtggctctaatagtttacattcccaccagcagtgtggaagtgttccatgattgccgcatgcatgccaacatctactgttttttgatttttttggttatggccgttcttgcaggagtaagggggtatcgcactgtagtttttatttgcatttccctgatcattagtgatgttgagcattttttcatactttgttggccatttgtatatcttcttttgagaattgtctattcatgtccttaacccactttttgatgggattgtttgtttttttcttactgatttgtttgagtttgttgtagattctggatattagtcctttgtctgatgtatagattgtgaagattttctcccactctgtgcgttgtctgtttactctgctgactgttgcttttaccatgcaaaagctctttagtttaattaagtcccatctatttatctttgtttttattgttggaaactattattctaagttaagtaactcaggaatggaaaaccaaacaacctatgttctcattgatatgtgggagctaagctatgaggacacaaaggcataagaatggtacaatggactttggggacttggggggaagggtaagggggggtgaggaataaaagacaacatatatggtatagtatatactactcaggagatgggtgcaccaggatctcacaaatcaccactaaagaatttactcatgtaaccaaataccacctgtacccccaataacttatgggaaaaaaagatattcatcgacctattccaggtcctctctccaccactgagcctcgtggggacataaagagctgcctgccctcccctgttccccttgcctttttgcagcaggattcctgaaaatgttgacttacagatacgtttttgagatatgaacgtttgttatttcctggtgcttagggaagaaaataattgatgttgtgagttgggcgggactttagggactatgctgaacaatccactgaccactgcaggctcccatttatgatcttgggccaacagccaccagcctctgttcatgcagtctcactgagggcagttacttctttggagtggcatgcctctgagcagataattccaataatcaatgtcaaactagatattgaaacagcccaagtgtcctggtaaagctagctgttgatactcctgactgttgcattattttgttttttgttttgttttgttttgagacggagtcttgctctgtcacccaggctggagtgcaatggtgcgatcttggctcactgcaagctgtgcctcccgggttcaaacaattcttctgcctcagcctcccgagtagctgggattacaggtgcatgccaccatgcccagctaattttgtatttttagtagagacagggtttcaccatgttgtccaggctggtcttgaactcctgacctcaagtgatccacccaccttggcctcccaaggtgctgggattacaggcacaagccacagctcccggcccaactgttgcattattatttgcaaatgttggctatccctgctgttgtctatatatcaattttgtctacccaacacagctgtaaacttctcaaggtgaggagtgagccatcactctttgcacctcttgctgtgattgacatggtataccttaagatatatgttaattcctatgtcttaataaatattggcttatggagaatttgttggagcaagtacagaccctatgtttaacttcttttattcaacagaattaaaaaactagctagttctctcaataaaataatactttcttttctttcttaaaatctagctgatctggtctaaaatacacatgtgggaggcgggattgtagaaatatctcaaattaattagcgtctagctctttgtaaggtaattgacagtctgagttagttgcttcccccactgcaaagcagcaaaatctgctctcaaaggcttcacgtagccgggaaaactccgttcccaattcagatcctctggggagggcatcaattatttcctattgtttttagcaccgattgttctgtctaatttgaaaggatccaaaaaaggaaatgatacttggcattagtatcattctccatcactcttgaaagatatatgaagggaatgttggcgcaatcagtctagaaacatatttctcccataacaataagccagttctttttgctttgaatcagaaatagctccatcaggcccatgaaggaaagggaaacaaaactgagtgccaagcatatgataacatgctcagcatcatatgacattaggggattgcaaattgaaacaacagtaccaccacacacctatcagaatggccaaaatccagaagactgacatcaccaatgctagtgagaatgtggagcaacaggaactctcattcacggctggtggggatgcaaagtggtggagccacttgggaagacagtctggcagattcctaaaaaggtaaacatactcttactaaacaatctagtagatttgctcctaggtgtttacccaaaggagttgaaaacatgtccacacagaaaacctgcacatgaatgtttatagcagctttactcaaaattgccaaaaattggaagcaaccaagatgtccttcaataggtgggcggataaagaaattgtatccaattctatttctatgaggaaaatctattcatacaatagaatactagtgtcagagatttttttttaacaaagagctatcaagccatgaaaagataaggaagaactttaatgcatattggtaagtgaaaaaagccagtttgcaaaggctagatactatatgatcccaactgtataacattctgaaaaaggcacaactatggagacaataaaaagaacagagttttggatgaagggagggatgaacaggcagaatacaaacaaattttagggcagtgaaactattattatgatactttatggatatagaatattatgcatttttcaaaacacatagaatatacaacatgaagaatgaatgctaatgtaaactctggatttttattaataatattatttaattaaaatgatttattttacttattttcattattatctaaaatgttatttaattattaaatttagatgctacttaatttttgctttattattattatgttaatatcatcaactgtaactagtgtacaacactaatgcaagatgttaataggggaaatcgtgttggagagagagatatgtgagaactctgtactttcttttcaatgtttctgtaaacataaagctgctctaaaaaattaaatctattaaaaaaaaaactgagtggaaaaa

SEQ ID NO: 186890 - DNA, 1467 bp, Homo sapiens
  Payload ID: 16799
  Gene Symbol: SRD5A1
  Gene Name: steroid-5-alpha-reductase, alpha polypeptide 1 (3-oxo-5 alpha-steroid delta 4-dehydrogenase alpha 1)
  ENST ID: ENST00000513117
  CDS Start-End: 151-558
ctgacttgagaaccctttctgcagagtcccggcagtgcgggactccggtagccgcccctccggtagccgcccctcctgcccccgcgccgccgccctatatgttgcccgccgcggcctctggggcatggagcacgctgcccagccctggcgatggcaacggcgacgggggtggcggaggagcgcctgctggccgcgctcgcctacctgcagtgcgccgtgggctgcgcggtcttcgcgcgcaatcgtcagacgaactcagtgtacggccgccacgcgctgcccagccacaggctccgagtgccggcgcgggccgcctgggtggtgcaggagctgccctcgctggccctgccgctctaccagtacgccagcgagtccgccccgcgtctccgcagcgcgcccaactgcatcctcctggccatgttcctcgtccactacgggcatcggttttggcttgtggttaacgggcatgttgataaacatccattcagatcatatcctaaggaatctcagaaaaccaggagatactggatacaaaataccaaggggaggcttatttgaatacgtaactgcagccaactattttggagaaatcatggagtggtgtggctatgccctggccagctggtctgtccaaggcgcggcttttgctttcttcacgttttgttttttatctggtagagcaaaagagcatcatgagtggtacctccggaaatttgaagagtatccaaagttcagaaaaattataattccatttttgttttaagtgcgtttttcatgaaattatcttcaacttgaagctttccaatggcgcttctctatggactttgtaaataagttatatctttgtaattttcctgctactttatcattttcaagatgtcctctaggaattttttttctagtaattttgcaatctacctaataagtacctaaatacgctgaaatggaggttgaatatcctactgtgtaacaggtcagaatttcaagctctgggtaataactgctgatattttttctaatttcaaatttacctcttttggctatgtcttgccaagtgtgtatgagactagactttacaactgtctttgatggcattttcagaacaataaatgtcacaatcccttctatagccccctacagtgatctcttcaaggtcaactgcagtgttgcttccctccccctatagggctggaatctgtctaggagccctctctcggaggccacagaggctgggggtagccattgtgcagtcatggcccgggggaaacttgccaaccttcgtgtcaggtgctgtgtgtaagtggagaacttggggatagaggaggaagctcctcgtggcccttccaaggtgaggcaaaggcatctggacttgttccagcccagcccaccgggtgacatcaccgggcagggaggggtgctggtggtggttcatacggagtaagctgctctgcctgtgtgagtggctcc

SEQ ID NO: 186891 - DNA, 2013 bp, Homo sapiens
  Payload ID: 16799
  Gene Symbol: SRD5A1
  Gene Name: steroid-5-alpha-reductase, alpha polypeptide 1 (3-oxo-5 alpha-steroid delta 4-dehydrogenase alpha 1)
  ENST ID: ENST00000510531
  CDS Start-End: 151-531
ctgacttgagaaccctttctgcagagtcccggcagtgcgggactccggtagccgcccctccggtagccgcccctcctgcccccgcgccgccgccctatatgttgcccgccgcggcctctggggcatggagcacgctgcccagccctggcgatggcaacggcgacgggggtggcggaggagcgcctgctggccgcgctcgcctacctgcagtgcgccgtgggctgcgcggtcttcgcgcgcaatcgtcagacgaactcagtgtacggccgccacgcgctgcccagccacaggctccgagtgccggcgcgggccgcctgggtggtgcaggagctgccctcgctggccctgccgctctaccagtacgccagcgagtccgccccgcgtctccgcagcgcgcccaactgcatcctcctggccatgttcctcgtccactacgggcatcggaaatgttggtatgcaagcacttgcagtgtgcctacatcccaaatgccagcccatggtacccattgtctgcccggatctgaatcatgattccaagacgcagagagaaattgctgggattcgttgttcttattcattgcttggcaacactgcagcttccaggagaatacccacctcactgatgacacaacatctgaatgcacacttactggccaacacgtgctttgctgtaaatcagtatgaagtcttcctaggggtcctggcctgaatgagatgagaaccttggaggctgcttttgactcatgtgaatgtcttccccaggagttaagtgggagtgctggggagagagtggcttgaggatgcacagccagcatgacactactattatgtgattactgtcgacgttcataaccataactaatgactaattatgactttaccctggcgcacatggtcagaatggaaacaaataacaagctttacagtttttcctgctctattaaggtgcttaatttacccatttctgatgcgaggaggaaagcctatgccactgttggcgtgtacaatggcgattatgttctgtacctgtaacggctatttgcaaagcagatacttgagccattgtgcagtgtatgctgatgactgggtaacagatccccgttttctaataggttttggcttgtggttaacgggcatgttgataaacatccattcagatcatatcctaaggaatctcagaaaaccaggagatactggatacaaaataccaaggggaggcttatttgaatacgtaactgcagccaactattttggagaaatcatggagtggtgtggctatgccctggccagctggtctgtccaaggcgcggcttttgctttcttcacgttttgttttttatctggtagagcaaaagagcatcatgagtggtacctccggaaatttgaagagtatccaaagttcagaaaaattataattccatttttgttttaagtgcgtttttcatgaaattatcttcaacttgaagctttccaatggcgcttctctatggactttgtaaataagttatatctttgtaattttcctgctactttatcattttcaagatgtcctctaggaattttttttctagtaattttgcaatctacctaataagtacctaaatacgctgaaatggaggttgaatatcctactgtgtaacaggtcagaatttcaagctctgggtaataactgctgatattttttctaatttcaaatttacctcttttggctatgtcttgccaagtgtgtatgagactagactttacaactgtctttgatggcattttcagaacaataaatgtcacaatcccttctatagccccctacagtgatctcttcaaggtcaactgcagtgttgcttccctccccctatagggctggaatctgtctaggagccctctctcggaggccacagaggctgggggtagccattgtgcagtcatggcccgggggaaacttgccaaccttcgtgtcaggtgctgtgtgtaagtggagaacttggggatagaggaggaagctcctcgtggcccttc

SEQ ID NO: 186892 - DNA, 4648 bp, Homo sapiens
  Payload ID: 16800
  Gene Symbol: SRD5A2
  Gene Name: steroid-5-alpha-reductase, alpha polypeptide 2 (3-oxo-5 alpha-steroid delta 4-dehydrogenase alpha 2)
  Uniprot ID: P31213
  ENST ID: ENST00000622030
  CDS Start-End: 168-932
tgcgaaccgcgccagggctggacgcggcgaggtgggaggcaggatggaggggcgggagccaaggccgagggggcggacacgggtggcgtctggcgctccataaaggggttgcgggggccgcgctctcttctgggagggcagcggccaccggcgaggaacacggcgcgatgcaggttcagtgccagcagagcccagtgctggcaggcagcgccactttggtcgcccttggggcactggccttgtacgtcgcgaagccctccggctacgggaagcacacggagagcctgaagccggcggctacccgcctgccagcccgcgccgcctggttcctgcaggagctgccttccttcgcggtgcccgcggggatcctcgcccggcagcccctctccctcttcgggccacctgggacggtacttctgggcctcttctgcctacattacttccacaggacatttgtgtactcactgctcaatcgagggaggccttatccagctatactcattctcagaggcactgccttctgcactggaaatggagtccttcaaggctactatctgatttactgtgctgaataccctgatgggtggtacacagacatacggtttagcttgggtgtcttcttatttattttgggaatgggaataaacattcatagtgactatatattgcgccagctcaggaagcctggagaaatcagctacaggattccacaaggtggcttgtttacgtatgtttctggagccaatttcctcggtgagatcattgaatggatcggctatgccctggccacttggtccctcccagcacttgcatttgcatttttctcactttgtttccttgggctgcgagcttttcaccaccataggttctacctcaagatgtttgaggactaccccaaatctcggaaagcccttattccattcatcttttaaaggaaccaaattaaaaaggagcagagctcccacaatgctgatgaaaactgtcaagctgctgaaactgtaattttcatgatataatagtcccgtatatatgtaatagtaggtctcctggcgttctgccagctggcctggggattctgagtggtgtctgcttagagtttactcctacccttccagggacccctatcctgatccccaactgaagcttcaaaaagccacttttccaaatggcgacagttgcttcttagctattgctctgagaaagtacaaacttctcctatgtctttcaccgggcaatccaagtacatgtggcttcatacccactccctgtcaatgcaggacaactctgtaatcaagaattttttgacttgaaggcagtacttatagaccttattaaaggtatgcattttatacatgtaacagagtagcagaaatttaaactctgaagccacaaagacccagagcaaacccactcccaaatgaaaaccccagtcatggcttcctttttcttggttaattaggaaagatgagaaattattaggtagaccttgaatacaggagccctctcctcatagtgctgaaaagatactgatgcattgacctcatttcaaatttgtgcagtgtcttagttgatgagtgcctctgttttccagaagatttcacaatccccggaaaactggtatggctattcttgaaggccaggttttaataaccacaaacaaaaaggcatgaacctgggtggcttatgagagagtagagaacaacatgaccctggatggctactaagaggatagagaacagttttacaatagacattgcaaactctcatgtttttggaaactagtggcaatatccaaataatgagtagtgtaaaacaaagagaattaatgatgaggttacatgctgcttgcctccaccagatgtccacaacaatatgaagtacagcagaagccccaagcaactttcctttcctggagcttcttccttgtagttctcaggacctgttcaagaaggtgtctcctaggggcagcctgaatgcctccctcaaaggacctgcaggcagagactgaaaattgcagacagaggggcacgtctgggcagaaaacctgttttgtttggctcagacatatagttttttttttttttacaaagtttcaaaaacttaaaaatcaggagattccttcataaaactctagcattctagtttcatttaaaaagttggaggatctgaacatacagagcccacatttccacaccagaactggaactacgtagctagtaagcatttgagtttgcaaactcttgtgaaggggtcaccccagcatgagtgctgagatatggactctctaaggaaggggccgaacgcttgtaattggaatacatggaaatatttgtcttctcaggcctatgtttgcggaatgcattgtcaatatttagcaaactgttttgacaaatgagcaccagtggtactaagcacagaaactcactatataagtcacataggaaacttgaaaggtctgaggatgatgtagattactgaaaaatgcaaattgcaatcatataaataagtgtttttgttgttcattaaatacctttaaatcatggatgttaagcagttttgtttgaattaaaatatcctgggacttctggagattttcacaaggtattggggtgtgcttccctgtcccgcctgtccctcattcccattcaccctgtctgtagtgtcgtttcctttcttctcttctctcttcatgaaattaggggctgtgtgctggaaataaagaagtatgacttatacagcctctcagccacaattcagaactacaaggaagtacaataaaggtgcaggaaaacgtcatgaggttagatgccactcctggtgctgaggaatacacagggggaatgaacacacttggtgaagtaaatcttcaggtgtagcttgagctctgtgacataaaagacttccagttctctccatgacattgaaaactaccttgcttaagtcctttattttactaccatgtaaaacatccaggccggtccttgagatgaaataaatatacaataaatggcagtactcagtctcaggacaaaaccgccatttggcaatttcactttttgccacaagagggcgctttctaaaatagtatttagtccaaccttgacttaattaggtccaaccccagtcctgttgcctgatcgtggacctttcaagttagcatgatcgtggaacttcttaatctgaatatagggtagagtagcgtgaactctatgaaagctgaaaccttcccttgataattcaggtattctcagtgttctagggctgttgtgttcaatgacagtttgtcattgtttagggctaggatatgtatgtggattaaatacagtaaaggtctgaacatgtgctcatctctaaacatatttcttcccacttttaaaaatagggtgcaacaaaattatagttaattgaggtttccatggactgttttttggctaaaataatctaacagtgtcctagctcacaagatactctatcttggtcttgctgaagctttcacggaagaggcgttttcctgccaaccttgaagaaaatgttgagttttgtttgtttttcagaatttagacttaaagagctgaagcagacctcagacatcagctattcctaccacttcacattataggtagtgacactgagacccacagagttaaaaggcctcctcacagctggtacagagctggtcagagcagccatctcattttgtccctttgagggtcagatgtatgcttcttctgcttaaggcacagcctttagggctgccatctggatttctacagagctcatgcaggagaaaaatagccagagcttaagtgctgttgcatagttcagtttatacacctattgtcccatgcctgtttgtgtgtgaggcttccctcgctccgtgggagcaccaggctcatgccctttcataaacctatttgacagaatagagagttttccctcattggtgtagtcaagacaacatgtgtgttcagcatggaaaaaaggtttcaggtcataaacccccttatccctaatgcttactttcataaagaacaacagtggctccactgtattctaaaaggaaaaaggagctctaatgagaaatacgcaattaaacagctatttaggcggcttagaccctttcaggaacaaataaataaatccgtggttttacaaccctgaagtttgataatagctctcttggatttttgtggttacctcatggcaatctcactaagaagcaggggagcaagctcttggcacatgaaggaataggctcatgaagattcatttcttttcccgcttggccttttggttctctaataagctgtgagctgaggtccatgcagggaaaacaaggagggtaacggcaaatgtaaagtgaatttttctggagaaggatgctgattattttatagcatctacactatcctatgatgaaagaggcatagagccgggtggcaatgtgagttcttgggtgatttaataagccatcgagtggatttaatttctaagtaagacatttgtttattctttgtacaagtccatggagttgtgatcttaaagagttctgtgttatttgcattgtgcctcatttctccccatcaaccttagcttgagatttggatgaataaaataaataactggagaaggttaaagtatgcaccaa

SEQ ID NO: 186893 - DNA, 1929 bp, Homo sapiens
  Payload ID: 16801
  Gene Symbol: STAR
  Gene Name: steroidogenic acute regulatory protein
  Uniprot ID: P49675
  ENST ID: ENST00000276449
  CDS Start-End: 448-1305
agctgagcctggagtttctgaagacaagggctagaaatctgcactttaaagtcttgaaaaccactgtgtgccttcatctaagctgcccctgcttctctcccctccatccctcgcctggccctgtcctccctactctcccctgcaccctcccccgccccaagctccccacaaacggccaaagcagcagtgtgaggcaatcgctctatccttgaccccttcctttgcacagtgagtgatggcgtttttatctcctgatgatgatgcacagccttcagcgggggacatttaagacgcagaacaccaggtccaggctgcagctgcgggactcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggtcctgcagaagatcggaaaagatacattcattactcacgagctggctgccgaggcagcaggaaacctggtggggccccgtgactttgtgagcgtgcgctgtgccaagcgccgaggctccacctgtgtgctggctggcatggccacagacttcgggaacatgcctgagcagaagggtgtcatcagggcggagcacggtcccacttgcatggtgcttcacccgttggctggaagtccctctaagaccaaacttacgtggctactcagcatcgacctcaaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacacaaa

SEQ ID NO: 186894 - DNA, 748 bp, Homo sapiens
  Payload ID: 16801
  Gene Symbol: STAR
  Gene Name: steroidogenic acute regulatory protein
  ENST ID: ENST00000522050
  CDS Start-End: 1-748
ggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggtcctgcagaagatcggaaaagatacattcattactcacgagctggctgccgaggcagcaggaaacctggtggggccccgtgactttgtgagcgtgcgctgtgccaagcgccgaggctccacctgtgtgctggctggcatggccacagacttcgggaacatgcctgagcagaagggtgtcatcaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacg

SEQ ID NO: 186895 - DNA, 402 bp, Homo sapiens
  Payload ID: 16801
  Gene Symbol: STAR
  Gene Name: steroidogenic acute regulatory protein
  ENST ID: ENST00000521236
  CDS Start-End: 258-402
catgcaagcacacaggcctcaggagttgtattctccttatgaaggctgaggcaacaggctgtgatggccatcagccaggagctgaaccggagggccctggggggccccacccctagcacgtggattaaccaggttcggcggcggagctctctactcggaagctctgtctctcctcggctgtgtatccaggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatgg

SEQ ID NO: 186896 - DNA, 1889 bp, Homo sapiens
  Payload ID: 16802
  Gene Symbol: SCP2
  Gene Name: sterol carrier protein 2
  Uniprot ID: P22307
  ENST ID: ENST00000371509
  CDS Start-End: 112-1623
gttgccgcccgcggccctggcttcgggcttcagggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaagtttgtgaagcctggagctgagaattcaagagactaccctgacttggcagaagaagcaggcaagaaggctttagctgatgcacagatcccttattcagcagtggaccaggcatgtgttggctatgtttttggtgtggcagaatgtgtcttggctcttgggtttgagaagatgagtaagggaagccttggaataaaattttcagatagaaccattcccactgataagcatgttgacctcctgatcaataagtatggattgtctgctcacccagttgctcctcagatgtttgggtatgctggaaaagaacatatggaaaaatatggaacaaaaattgaacactttgcaaaaattggatggaaaaatcataaacattcagttaataacccgtattcccagttccaagatgaatacagtttagatgaagtgatggcatctaaagaagtttttgattttttgactatcttacaatgttgtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggacaaggtgcaacgctggttgatagaggagataatacatatggaggaaagtgggtcataaatcctagtggtggactgatttcaaagggacacccactaggcgctacaggtcttgctcagtgtgcagaactctgctggcagctgagaggggaagccggaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcag

SEQ ID NO: 186897 - DNA, 2003 bp, Homo sapiens
  Payload ID: 16802
  Gene Symbol: SCP2
  Gene Name: sterol carrier protein 2
  Uniprot ID: P22307
  ENST ID: ENST00000371513
  CDS Start-End: 80-1048
gggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaagtttgtgaagcctggagctgagaattcaagagactaccctgacttggcagaagaagcaggcaagaaggctttagctgatgcacagatcccttattcagcagtggaccaggcatgtgttggctatgtttttggtgtggcagaatgtgtcttggctcttgggtttgagaagatgagtaagggaagccttggaataaaattttcagatagaaccattcccactgataagcatgttgacctcctgatcaataagtatggattgtctgctcacccagttgctcctcagatgtttgggtatgctggaaaagaacatatggaaaaatatggaacaaaaattgaacactttgcaaaaattggatggaaaaatcataaacattcagttaataacccgtattcccagttccaagatgaatacagtttagatgaagtgatggcatctaaagaagtttttgattttttgactatcttacaatgttgtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggacaaggtgcaacgctggttgatagaggagataatacatatggaggaaagtgggtcataaatcctagtggtggactgatttcaaagggacacccactaggcgctacaggaggacattcctgctcttgaaatttcctgataacccggacaagttcatggaaagcttgatctacattcatcctaatctttgctgatgcctccatgtatgttaccttaagttgccgtgctaactgccgtccttcttcctgtgttacctgtctttgatgatccagatctgctttattaccaattaaaatcattgggaactcatcacgatcctttactctgagaatctgtctttgaaacttatagatttcttcaaaactgcctctatctgtgactgaaaagaccaacaggaagccctcgccagtcctcatatactgttctctcatggctccaagctcttcttgtcctgctgtatccaaaatatctagccgggctgctctgtcatctatcacacactgctttgtgtaagaatcttcattggttggatcataatccgttacaaaataggactcccaacttaggaaacaaaacatttgtaatatgattgaagactcctgcatgcctcctcaataatattcccctctctcctcccccagcaccaagaggtaatcaatatcctgaatttggtatctgtcattctcatgcatttatacaacattagtaatcatatgatagtattcctaagctatgttttggagaggacaccactgcaaatcttcagccctatactagcttttatcggtagccatcaattgcagttttaatagaaatacaaatacatcaagtgtctgttctttaatttgtaaagaaaatttgttttctagcgtgacaccctcaaggtaccgtatctgtatgtaaatgttgtgcccaatgctacacagacattattttaaaactattttctgcctttggtaaatagactaaactgttttctttattcctcaaaagaattagatcatacttcagtgttgattttgttgctaatgggacatggagatgtctggatgataataaatattcctgtggtatggtcactgaa

SEQ ID NO: 186898 - DNA, 2811 bp, Homo sapiens
  Payload ID: 16802
  Gene Symbol: SCP2
  Gene Name: sterol carrier protein 2
  Uniprot ID: P22307
  ENST ID: ENST00000371514
  CDS Start-End: 169-1812
gcgccccaccccgccccctcctcctgcccctacgcacgcgcactctcacgcgcctgtgttgccgcccgcggccctggcttcgggcttcagggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaagtttgtgaagcctggagctgagaattcaagagactaccctgacttggcagaagaagcaggcaagaaggctttagctgatgcacagatcccttattcagcagtggaccaggcatgtgttggctatgtttttggtgactctacctgtgggcagagggctatctatcacagtttgggaatgactggaattcctataatcaatgtcaacaataactgtgctactggttctactgctttgtttatggcccgccagctgattcagggtggtgtggcagaatgtgtcttggctcttgggtttgagaagatgagtaagggaagccttggaataaaattttcagatagaaccattcccactgataagcatgttgacctcctgatcaataagtatggattgtctgctcacccagttgctcctcagatgtttgggtatgctggaaaagaacatatggaaaaatatggaacaaaaattgaacactttgcaaaaattggatggaaaaatcataaacattcagttaataacccgtattcccagttccaagatgaatacagtttagatgaagtgatggcatctaaagaagtttttgattttttgactatcttacaatgttgtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggacaaggtgcaacgctggttgatagaggagataatacatatggaggaaagtgggtcataaatcctagtggtggactgatttcaaagggacacccactaggcgctacaggtcttgctcagtgtgcagaactctgctggcagctgagaggggaagccggaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataactttttctggcctctcttgtttttactgtgtatgttcttgctcagggctctctagataatgcagaataaagagaaacgttgggggatttataaactgaatgtta

SEQ ID NO: 186899 - DNA, 2239 bp, Homo sapiens
  Payload ID: 16802
  Gene Symbol: SCP2
  Gene Name: sterol carrier protein 2
  Uniprot ID: P22307
  ENST ID: ENST00000407246
  CDS Start-End: 112-1683
gttgccgcccgcggccctggcttcgggcttcagggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaagtttgtgaagcctggagctgagaattcaagagactaccctgacttggcagaagaagcaggtgactctacctgtgggcagagggctatctatcacagtttgggaatgactggaattcctataatcaatgtcaacaataactgtgctactggttctactgctttgtttatggcccgccagctgattcagggtggtgtggcagaatgtgtcttggctcttgggtttgagaagatgagtaagggaagccttggaataaaattttcagatagaaccattcccactgataagcatgttgacctcctgatcaataagtatggattgtctgctcacccagttgctcctcagatgtttgggtatgctggaaaagaacatatggaaaaatatggaacaaaaattgaacactttgcaaaaattggatggaaaaatcataaacattcagttaataacccgtattcccagttccaagatgaatacagtttagatgaagtgatggcatctaaagaagtttttgattttttgactatcttacaatgttgtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggacaaggtgcaacgctggttgatagaggagataatacatatggaggaaagtgggtcataaatcctagtggtggactgatttcaaagggacacccactaggcgctacaggtcttgctcagtgtgcagaactctgctggcagctgagaggggaagccggaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaaga

SEQ ID NO: 186900 - DNA, 1298 bp, Homo sapiens
  Payload ID: 16802
  Gene Symbol: SCP2
  Gene Name: sterol carrier protein 2
  Uniprot ID: P22307
  ENST ID: ENST00000408941
  CDS Start-End: 84-263
gaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataactttttctggcctctctt

SEQ ID NO: 186901 - DNA, 894 bp, Homo sapiens
  Payload ID: 16802
  Gene Symbol: SCP2
  Gene Name: sterol carrier protein 2
  Uniprot ID: P22307
  ENST ID: ENST00000435345
  CDS Start-End: 54-485
ctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgc

SEQ ID NO: 186902 - DNA, 938 bp, Homo sapiens
  Payload ID: 16802
  Gene Symbol: SCP2
  Gene Name: sterol carrier protein 2
  Uniprot ID: P22307
  ENST ID: ENST00000430330
  CDS Start-End: 94-516
ggggaagccggaaagaggcaagttcctggtgcaaaggtggctctgcagcataatttaggcattggaggagctgtggttgtaacactctacaagatgggttttccggaagccgccagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggcca

SEQ ID NO: 186903 - DNA, 720 bp, Homo sapiens
  Payload ID: 16802
  Gene Symbol: SCP2
  Gene Name: sterol carrier protein 2
  ENST ID: ENST00000529363
  CDS Start-End: 1-720
agcctggagctgagaattcaagagactaccctgacttggcagaagaagcaggcaagaaggctttagctgatgcacagatcccttattcagcagtggaccaggcatgtgttggctatgtttttggtgactctacctgtgggcagagggctatctatcacagtttgggaatgactggaattcctataatcaatgtcaacaataactgtgctactggttctactgctttgtttatggcccgccagctgattcagggtggtgtggcagaatgtgtcttggctcttgggtttgagaagatgagtaagggaagccttggaataaaattttcagatagaaccattcccactgataagcatgttgacctcctgatcaataagtatggattgtctgctcacccagttgctcctcagatgtttgggtatgctggaaaagaacatatggaaaaatatggaacaaaaattgaacactttgcaaaaattggatggaaaaatcataaacattcagttaataaccctcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctga

SEQ ID NO: 186904 - DNA, 671 bp, Homo sapiens
  Payload ID: 16802
  Gene Symbol: SCP2
  Gene Name: sterol carrier protein 2
  ENST ID: ENST00000484100
  CDS Start-End: 1-235
ggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaag

SEQ ID NO: 186905 - DNA, 1896 bp, Homo sapiens
  Payload ID: 16802
  Gene Symbol: SCP2
  Gene Name: sterol carrier protein 2
  Uniprot ID: P22307
  ENST ID: ENST00000528311
  CDS Start-End: 297-1697
gttgccgcccgcggccctggcttcgggcttcagggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaaggcaagaaggctttagctgatgcacagatcccttattcagcagtggaccaggcatgtgttggctatgtttttggtgactctacctgtgggcagagggctatctatcacagtttgggaatgactggaattcctataatcaatgtcaacaataactgtgctactggttctactgctttgtttatggcccgccagctgattcagggtggtgtggcagaatgtgtcttggctcttgggtttgagaagatgagtaagggaagccttggaataaaattttcagatagaaccattcccactgataagcatgttgacctcctgatcaataagtatggattgtctgctcacccagttgctcctcagatgtttgggtatgctggaaaagaacatatggaaaaatatggaacaaaaattgaacactttgcaaaaattggatggaaaaatcataaacattcagttaataacccgtattcccagttccaagatgaatacagtttagatgaagtgatggcatctaaagaagtttttgattttttgactatcttacaatgttgtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggacaaggtgcaacgctggttgatagaggagataatacatatggaggaaagtgggtcataaatcctagtggtggactgatttcaaagggacacccactaggcgctacaggtcttgctcagtgtgcagaactctgctggcagctgagaggggaagccggaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcgga

SEQ ID NO: 186906 - DNA, 5204 bp, Homo sapiens
  Payload ID: 16802
  Gene Symbol: SCP2
  Gene Name: sterol carrier protein 2
  ENST ID: ENST00000478631
  CDS Start-End: 121-1221
cgcgcctgtgttgccgcccgcggccctggcttcgggcttcagggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaagtttgtgaagcctggagctgagaattcaagagactaccctgacttggcagaagaagcaggcaagaaggctttagctgatgcacagatcccttattcagcagtggaccaggcatgtgttggctatgtttttggtgactctacctgtgggcagagggctatctatcacagtttgggaatgactggaattcctataatcaatgtcaacaataactgtgctactggttctactgctttgtttatggcccgccagctgattcagggtggtgtggcagaatgtgtcttggctcttgggtttgagaagatgagtaagggaagccttggaataaaattttcagatagaaccattcccactgataagcatgttgacctcctgatcaataagtatggattgtctgctcacccagttgctcctcagatgtttgggtatgctggaaaagaacatatggaaaaatatggaacaaaaattgaacactttgcaaaaattggatggaaaaatcataaacattcagttaataacccgtattcccagttccaagatgaatacagtttagatgaagtgatggcatctaaagaagtttttgattttttgactatcttacaatgttgtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggacaaggtgcaacgctggttgatagaggagataatacatatggaggaaagtgggtcataaatcctagtggtggactgatttcaaagggacacccactaggcgctacaggaggacattcctgctcttgaaatttcctgataacccggacaagttcatggaaagcttgatctacattcatcctaatctttgctgatgcctccatgtatgttaccttaagttgccgtgctaactgccgtccttcttcctgtgttacctgtctttgatgatccagatctgctttattaccaattaaaatcattgggaactcatcacgatcctttactctgagaatctgtctttgaaacttatagatttcttcaaaactgcctctatctgtgactgaaaagaccaacaggaagccctcgccagtcctcatatactgttctctcatggctccaagctcttcttgtcctgctgtatccaaaatatctagccgggctgctctgtcatctatcacacactgctttgtgtaagaatcttcattggttggatcataatccgttacaaaataggactcccaacttaggaaacaaaacatttgtaatatgattgaagactcctgcatgcctcctcaataatattcccctctctcctcccccagcaccaagaggtaatcaatatcctgaatttggtatctgtcattctcatgcatttatacaacattagtaatcatatgatagtattcctaagctatgttttggagaggacaccactgcaaatcttcagccctatactagcttttatcggtagccatcaattgcagttttaatagaaatacaaatacatcaagtgtctgttctttaatttgtaaagaaaatttgttttctagcgtgacaccctcaaggtaccgtatctgtatgtaaatgttgtgcccaatgctacacagacattattttaaaactattttctgcctttggtaaatagactaaactgttttctttattcctcaaaagaattagatcatacttcagtgttgattttgttgctaatgggacatggagatgtctggatgataataaatattcctgtggtatggtcactgaagcctttaagagttatgctgtagtttgtgtgtaaagaagtgacttaaatcctcctttcagacagcttccttacgcatataggaaacctctgtttcattaggagatgaatatgatatttcattttagttgttcttgttgacatacaacttttttctcttctgaaatagcatgtttttattataatttgcttgattgccattattagatatttttgtcatgccatccactgaaatactcagaaatcatgctttatagtaacaatataatttttcatatctatatttgttattaaaatttagatctaatttttatacaataaaatgcacagttctgcctctcagaaccttcctgctgccacatttgcaccttgctgctctagcctctggggtgcattccatcctttcagcctgcaactagcagagaaaaaaagttacatattttcttgccccatgcataccttgaggcgagcaaaaaaattaaaataaattttaaccatgagggaaatcgtgcacatccaggcctgtcagtgtggcaaccggatgggtgccaagtgctgggatgtgatcagtgatgaacgtgaaatcgaccccaccagcacctaacatggggacagcgacctgcagctggactgtgtctccatgtactacagtgaagccatagatggcaaatatgttccttgtgctaacctggtggatctagaacctgggaccatggactctgctagctcaggcccttttggccaggtgcttaaaccagacaactttgtttttggtcaatctggggcaggcaacaactgggccaaaggccactacatagagggggccaagctggttgattcagttgtagatgtggtgcaggaggagtaagagagctgtgactgcctgcagggcttgcagctgacccactcaatgggctctggaatgggtactctctttatcagcaagatccgagaagagtgccctgattgcatcatgaacaccctcagtgtggtgcctccacccaaagtgtctgacaccgtggtcgagccctacaacatcaccctctccatccatcagtcggtagagaacactgatgagacctactgcattgacaatgaggccctctatgacatctgctcccgcactttgaagctgaccacaccaaactatggggacttgaaccaccttgtctcagccaccacaagcagtgttaccacctgtctccacttccctggccagctcaatgctgacctccgcaagttggcagtcaaactggtgcccttaccacatctccactacttcatggctggctttgccctctcaccagctgtggaagctagcagcatcgagctttcacagtgcccaaactcatcaggtaggatttcaatgccaagaacataatgagacccctgccacagcttatatctcaccgtggctgctgtctttgtggatggatgtccatgagcagttgctcaacgtgcagaaccagaacagcagctactttgtggagtggatccccaacaacatcaagacagctgtctgtgacatcccacctcatggcttcaagatggcggtcaccttaatcggcagcagcacggccatccaggagctcttcaggtgcatcttggagcagttcactgccatgttcccctggaaggccttcctccactggtacacagctgagggcatggatgagacgagagttcaacaaggctgagagcaacatgaacgacctcgtctctgagtatcagcagtaccaggatgccaccacagaagaggaggaggattttggtcttgctcagtgtgcagaactctgctggcagctgagaggggaagccggaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgc

SEQ ID NO: 186907 - DNA, 3926 bp, Homo sapiens
  Payload ID: 16802
  Gene Symbol: SCP2
  Gene Name: sterol carrier protein 2
  Uniprot ID: P22307
  ENST ID: ENST00000488965
  CDS Start-End: 48-227
agcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagagataagaaggctgactgcacaatcacaatggctgactcagacttcctggctttaatgactggtaaaatgaatcctcagtcggtaagtatgatggagcttatatcctgctagtaggtaggtctttcagccctttctactccatctcctgactcagactctaaagtgcaaagtggtcagactcacaaaactcagtgttccccaaacagttgacagacgtctgtggagcaagctgtgtgccacacactgtcttgtgtgctggaagtgcccagaagagtaagaaagttcccacgctcagggcatccacagatgtgtaaaagagtcagtgcagccagagatccaaggtgccacacctggcttgtggtcaggggaggatgaaggcaggagcagccatatctctctgggccatcagggagagcaccacagaggaagcagctcttgagcttagtacccaggcggaaagtaggagtgttccaggaggagggaggggtggcatgaacaaaggcctgaccttttacattccatttatttgcccatgctcttctttttgcctgacctgtccttacctgacaaatgacttgtctttcaaaattagctcagatattatctccaaggacctctttccaagttgctggggagctgtaaccagtccctctcctgagccacgtactggactgccagcttagtgcctgttgtgttatgttagtcataatatgcctctctctcttccctgttaggctgtgagtgtctcaaagcatcaaagcacatcttatttgtctttatgtttccagaatttagcacagtatctgatgtttttaggtattctgtaaacaactgttggactaaattgcatttgtctaaagtgtgtttatgccttgtatagattttcctagtccccaaattgtcaagggtcctcttaggctcttcagctgcagtgttgaatggacttgatatagtgagctttctgtcaacttgatatatactgagctttccattaataaaaaagaaactaagacgtttctttccaatgtaacttaattttttctgttgtctcagtctggtttgttttaggttttattcctgtggttctctggtaatttccaagattggataaaacaactaaatctcactcccacttgcttttttaaaatgctttttctacgtaaccaagcacattttagttgatgccatgacaagtgagaaatttgcatctgtgatgtttcagctgaatacacaccattggcactgacatttccactgagcctgctccagaaatctggacagaacagaggccaccagtataggagctggctgtcatcctccttcccacccactgcacatgccatgcacagctttggcaggctgttcagacttcacacatcagctgccttcattctctcaatttatctttgtactgcccattttgggggcaaggtgtcagcttattttccttcagcacctgttaacacccaaaggaattaaagataaaaatagcagacctttctattaatgtgctaatggacttcccttatgctcagaggatttccagaggatttgactggaaatcgttaaatgcagtggaaattctaatttcagtgtttggctccagcagcaagcgtacatgaagaacacctaggggccagattaaaatcatctttatgtatggactctctgaagggtgaagattcatgttttctctattgttagtaaataaaaagtgattttctttgttaacttacaaaggagaaaggtggcgagtttctcctgtactactggtccgtatttttaaatgatgtttgttcaatatattgtgttctgagacacctgacctttaaggcatcagacagaaggctttgtgccatatagaaaggaaatatttagtttgtccagacagaggaaggggaaaaaaaggaattagtcacccttaccaggaggtacagaaaaaaacagagctccttacattcccatggatgatgtagaagagctcctagcttcttaatgtactgttaaaaacctaggactaccagaagctttttttttaaatctagcccttccttattttaagcattcagttaaaatactgagatcatggcagggaaattatgctacgttcccaattttgctgtttctcttaagttttcctgggattttgttacatggtaaatttagcaaacatcatgtgatctaatcccaggcagttgttaaatggaacaaattgtggctctgcacttcagattggtttgatttttcttgttgagccaaagagtaacacaagcacctcattctcagcaggctctgtgccctctgtagggataagtcctttatcattggtggcatttcattcacatgcatgttggattgaatcccaagagtttctgtgttttttgtgtatgctttttctctcagcagcctgctaaaaatttcagttcatatttcccacctacatggaatgttttaaaacataatcagtgtagtatgaacccactttgaggaggacaggtgaaaacaggctcaatttctatgagaaatttgggaaagctgctcctttctgctgatctgcaaaaagtgtggcctttacaaattcttccttttgaagaatgtggttccaaatctattccagaaagccaagtttcatattttagagaaagtcatgtgacctggataaataaatgatctcagggctagatagtgtagaaacatcagcaatcttaaaacaaaaaaacaccaagtaatgaattttctttcttcttcacaggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataactttttctggc

SEQ ID NO: 186908 - DNA, 742 bp, Homo sapiens
  Payload ID: 16802
  Gene Symbol: SCP2
  Gene Name: sterol carrier protein 2
  ENST ID: ENST00000533119
  CDS Start-End: 1-97
ggctctgcagcataatttaggcattggaggagctgtggttgtaacactctacaagatgggttttccggaagccgccaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctga

SEQ ID NO: 186909 - DNA, 969 bp, Homo sapiens
  Payload ID: 16802
  Gene Symbol: SCP2
  Gene Name: sterol carrier protein 2
  ENST ID: ENST00000478274
  CDS Start-End: 1-421
ggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggtaagtatgatggagcttatatcctgctagtaggtaggtctttcagccctttctactccatctcctgactcagactctaaagtgcaaagtggtcagactcacaaaactcagtgttccccaaacagttgacagacgtctgtggagcaagctgtgtgccacacactgtcttgtgtgctggaagtgcccagaagagtaagaaagttcccacgctcagggcatccacagatgtgtaaaagagtcagtgcagccagagatccaaggtgccacacctggcttgtggtcaggggaggatgaaggcaggagcagccatatctctctgggccatcagggagagcaccacagaggaagcagctcttgagcttagtacccaggcggaaagtaggagtgttccaggaggagggaggggtggcatgaacaaaggcctgaccttttacattccatttatttgcccatgctcttctttttgcctgacctgtccttacctgacaaatgacttgtctttcaaaattagctcagatattatctccaaggacctctttccaagttgctggggagctgtaaccagtccctctcctgag

SEQ ID NO: 186910 - DNA, 6835 bp, Homo sapiens
  Payload ID: 16803
  Gene Symbol: SOAT1
  Gene Name: sterol O-acyltransferase 1
  Uniprot ID: P35610
  ENST ID: ENST00000367619
  CDS Start-End: 144-1796
agcttagcaggcgacgttgcgggccctgggcgccaggagagcttcccggagtcgaccttcctgctggctgctctgtgaccgcttcccggctctgccctcttggccgaagtgcccgctgccgggcgcgggcctcagacaatacaatggtgggtgaagagaagatgtctctaagaaaccggctgtcaaagtccagggaaaatcctgaggaagatgaagaccagagaaaccctgcaaaggagtccctagagacacctagtaatggtcgaattgacataaaacagttgatagcaaagaagataaagttgacagcagaggcagaggaattgaagccattttttatgaaggaagttggcagtcactttgatgattttgtgaccaatctcattgaaaagtcagcatcattagataatggtgggtgcgctctcacaaccttttctgttcttgaaggagagaaaaacaaccatagagcgaaggatttgagagcacctccagaacaaggaaagatttttattgcaaggcgctctctcttagatgaactgcttgaagtggaccacatcagaacaatatatcacatgtttattgccctcctcattctctttatcctcagcacacttgtagtagattacattgatgaaggaaggctggtgcttgagttcagcctcctgtcttatgcttttggcaaatttcctaccgttgtttggacctggtggatcatgttcctgtctacattttcagttccctattttctgtttcaacattgggccactggctatagcaagagttctcatccgctgatccgttctctcttccatggctttcttttcatgatcttccagattggagttctaggttttggaccaacatatgttgtgttagcatatacactgccaccagcttcccggttcatcattatattcgagcagattcgttttgtaatgaaggcccactcatttgtcagagagaacgtgcctcgggtactaaattcagctaaggagaaatcaagcactgttccaatacctacagtcaaccagtatttgtacttcttatttgctcctacccttatctaccgtgacagctatcccaggaatcccactgtaagatggggttatgtcgctatgaagtttgcacaggtctttggttgctttttctatgtgtactacatctttgaaaggctttgtgcccccttgtttcggaatatcaaacaggagcccttcagcgctcgtgttctggtcctatgtgtatttaactccatcttgccaggtgtgctgattctcttccttactttttttgcctttttgcactgctggctcaatgcctttgctgagatgttacgctttggtgacaggatgttctataaggattggtggaactccacgtcatactccaactattatagaacctggaatgtggtggtccatgactggctatattactatgcttacaaggactttctctggtttttctccaagagattcaaatctgctgccatgttagctgtctttgctgtatctgctgtagtacacgaatatgccttggctgtttgcttgagctttttctatcccgtgctcttcgtgctcttcatgttctttggaatggctttcaacttcattgtcaatgatagtcggaaaaagccgatttggaatgttctgatgtggacttctcttttcttgggcaatggagtcttactctgcttttattctcaagaatggtatgcacgtcagcactgtcctctgaaaaatcccacatttttggattatgtccggccacgttcctggacttgtcgttacgtgttttagaagcttggactttgtttcctccttgtcactgaagattgggtagctccctgatttggagccagctgtttccagttgttactgaagttatctgtgttatttggaccactccaggctttacagatgactcactccattcctaggtcacttgaagccaaactgttggaagttcactggagtcttgtacacttaagcagagcagaactttttttgtggggctgggtggggggagaagaccgactaacagctgaagtaatgacagattgttgctgggtcatatcagctttatcccttggtaattatatctgttttgtttcttgactctgtccaatcagagaataaacatcatagtttcttggccactgaattagccaaaacacttaggaagaaatcacttaaatacctctggcttagaaattttttcatgcacactgttggaatgtatgctaattgaacatgcaattggggaagaaaaaatgtagaatgatttttgctatttctagtagaaagaaaatgtctgttttccaaagataatgttatacatcctattttgtaatttttttgaaaaaagttcaatgttcagttttccttagtttttaccttgttttctctataggtcatgatttctgtgaagcaaaaagatgccttttaccatgaattcttgagtttacatcaataatattgtatattaaggggatcagaagtaggaaggaaaaaataagagatagcagaggaaaaagaaaaacatttcctcttataacttctgaagtaatttgtaaaaaagatttgtagagtcaatcatgtgtttaaattattttatcacaaacttaacatggaagatattcctttttaactttgtggtaacttctttgaagttatttagaaatatcctttggaacaattattttattgtctaataaatattgacttctcttgaattattttgcagactagtgagtctgtaccataagtattaatcacctccactcatattaaagtgatcattaagaatccagaagctggcttctgcatttgctcagttatacttttaatggtagtatgtttttaggtggaataaattaatatgtgattggtttcaaggaaatgtactctattatgtaatacttccattttataagatgcccatttctaatacaatgtgtgtaggaattatttgtatgtatgaggtatgattgtaaagattgagcattggaaggggtatcagagaccatgtagttcaactttccactcaaagtaagatttatgaattatttaaatgatagttgttacttggaacagccacttgagaggctctcttggtattgtttggaattgttttaaagtcagtttgagtctcacaagaaggtaagtagagtttcttaatagtcacaacttaatttgaaccacaagtatccagcttaatcacgtatcttactcacgataccactggtccagatgagtttaggtaattttcaaacattaaatccaacttcaacggaaacaaatacactcaagggaagttatttttaaaaaggtactctgcatgttcccgcagtaatgttctgcacaacagtattgtaattgtaatggaatcataacctgctaactagtttgctttaatatggcttgtaattcttgacatttttcttaaaattaaaacgaatttttattttgaatttataactgcattttaaatatattggggacagattgcgctgagacctggttatgagcaagccaatcttttgaatctagagaatggaattcttaggtttatatttctgttaagaaatactataaatatgactcttatgagaagactttgttgctctgtagtgtttctgaatactgtatttgttggattgatcaaggctatttttcaaaaagctctctgcttcctgtttgtttgtttgtttgtttttgagacagagtcttgctctgtcgccggggctggagtgcaatggcgtgaactcagctcactgcaacctctgcctccctggttcaagctattctcctgcctcagcctcctgagtagctgggattacagggccacgcctggctaatttttgtatttttagtagagatggggtttcaccctgttggtcaggctggtctcaaactcctgaccttgtgatctgcccacctcagcctcccaaagtgctgggaagacaggcgttagccaccgtgcccggcctctgtttcctgttattagtgattttcctgcccaagattgcaacaacaaatatgtagaactacagactgtttagaatgctgagactgttctaagaaactttcaaaaacagtagcacttcaaggaatggtcactttctatgaaagaaactggtttgatagccataatcttattgctagctgcttttagcaaaagtcttttcttgaaaccaccacctatactctttaaacaaataaaaactaaaatctcttgctaatgtttcaggaagatttattttttctattttgctattgtggcgaaaattattttcagttataggatacttttttccttctgaaaagtaataagcttaaagtttttgtttctgtaagatgtaatgatagtaactattattttgggcatattaaccaacagaacaattatgtagtatgtatatcactttctcattagatctctaacttgaccttctagtacctttatgtgtgaggataaatttgttagatccttttattctcaatcttggataatgatgcaaaatggaattttgttttgtttgttggtagattcacatactaaaactttgcaggtaaagttgcttgcctcatgttagaatttaattagaaaactgaggctgcctttttttttttttttttttttttttaagacagagtcttgttctgtcgcccaggccagttttttttttcttgtacagatggggttttaccatgttgctcaggctggtctcaaactcctggagtcaagggatctatttgcctcagcctctcaaagtgctgggattacaggtgtgagccacggctcctggctccttgctccagaatcagttttttaatggaagatagctcatactttgtttttgtttttaaagagacagggtctcactctgttgcccaggctggtagtagcgtgatcatagctcactgcagtctcaaactcctggactcaaatagtgctctggagtacctagaactacaagtgcctaccaccacacccagctaatttatttgtttttttttttttagagatggggggggtctccctatgttgcccaggctggtctcaaactcttcacctcaagcaaaactcccactgcagaaagctttgggattacaggcatgagccaccatgccaagcccatacttattgttaataaagtttcagtgacttgcttactaatcttatgcaaaatttcatgtaatttatgtaatactacataacaatgctacatatggtatgtatacatacactgtatacacacaaaggtctgttctgggtattttatgtatcttatctctaggctttatggctctgaaatggagggaactggacataaatgtttcaaggaataaagtgaatgttttgtttgtttgtttgttttgagacggagtctcagtcaccaggctggagtgcagtgctgtgatctcagctcactgcaacctctgcctcctgggttcaagcgattctcctgcctcagcctcccgagtagctggcattacaggtgcctgccaccatgtccagctaatttttgtgtttttagtagagatggggtttcaccatgatggtcaggctggtctcgaactcctgacctcatgatccgccagcctcagcctcccatagtgctgggattataggcatgagccatgctcccggccaaagtgaatgttttgggtgaagtttatataaggatttgacttttgtatcattattaaagtttctgtcaggtaatacagtgttggccctctgttgaaataaaatgttacatatcgctgggtgtagtggctcatgcctttaatcccagtactttgggaggccaaggcaggaggattgcttgagctcagaagtttgagaccagcctgggcaacatagcaaaaccttgtcactataaaaaatacaaaaattagccaggcgtggtggtgcacgcctgtagtctcagctactcagtcggctgaggtgggaagatggcttcaagccgggagatggaggcttcagtgacctgtgacctgtgatcacaccacttaattcctcaaaacatttatgtcccagttccctccatttcagagccatgggcaacagagcgagaccctgtctcaaaaaaaaaattacatataagcccggtttaaagagaggataatatgcaaccaccctagttgaaacagagtgtatcacttctttctcaccctaaatttaatgcctagtttgaaaatcagtagacaataataaagttgataagctttaggttggtaggaaagctatgtaatctatatagtgtactaaatccttatatgtttttggtaaaaaaagactttaatagctaatttggacttcagaaaatgggttaatttcacgagtgcatatcacttttgactatattagtcaagcatattattaaagtttaaaaaactctaaaacttctgtactgtttttttcttaagtgctctcttccttatttctacattactacattcacatttctgctgtcaataagccctaatggagtgataaactttaagctagtagatactgcaccatgtcttgtggtggtgttttcttaatgaaatggaagctgtacttcctgtttgtttttaaatacttttgaaacagacagttcatgtaccccatcatttagagatgcagtttgaatttccatggaaaaaggtgccaattttggattgggaaaggagctgaagccccagtcaagactttgccatttggggtaatgcagcagattcctgtgtctgtatctttccagtgtgtgtgttaatccatagtgttctgagcaccagaagggtcatgtaaatctgaagttgttattaaaggtttttctatagtgaaa

SEQ ID NO: 186911 - DNA, 870 bp, Homo sapiens
  Payload ID: 16803
  Gene Symbol: SOAT1
  Gene Name: sterol O-acyltransferase 1
  ENST ID: ENST00000426956
  CDS Start-End: 91-870
gtattagcaagacatgaaaatctgtaggggcaccagaacctttaatcaagctcatgttttattgtaaaatattaggatgtagacaatacaatggtgggtgaagagaagatgtctctaagaaaccggctgtcaaagtccagggaaaatcctgaggaagatgaagaccagagaaaccctgcaaaggagtccctagagacacctagtaatggtcgaattgacataaaacagttgatagcaaagaagataaagttgacagcagaggcagaggaattgaagccattttttatgaaggaagttggcagtcactttgatgattttgtgaccaatctcattgaaaagtcagcatcattagataatggtgggtgcgctctcacaaccttttctgttcttgaaggagagaaaaacaaccatagagcgaaggatttgagagcacctccagaacaaggaaagatttttattgcaaggcgctctctcttagatgaactgcttgaagtggaccacatcagaacaatatatcacatgtttattgccctcctcattctctttatcctcagcacacttgtagtagattacattgatgaaggaaggctggtgcttgagttcagcctcctgtcttatgcttttggcaaatttcctaccgttgtttggacctggtggatcatgttcctgtctacattttcagttccctattttctgtttcaacattgggccactggctatagcaagagttctcatccgctgatccgttctctcttccatggctttcttttcatgatcttccagattggagttctaggttttggaccaacatatgttgtgttagcatatacactgccaccagcttcccggttcatcattatattcgagcag

SEQ ID NO: 186912 - DNA, 6794 bp, Homo sapiens
  Payload ID: 16803
  Gene Symbol: SOAT1
  Gene Name: sterol O-acyltransferase 1
  Uniprot ID: P35610
  ENST ID: ENST00000539888
  CDS Start-End: 301-1758
aataggatgctcagccggaggtggccctgcgcgtgacgcagcggtgctcggaggcagggggcgtaggggccgggctgtccggcgctttagcttagcaggcgacgttgcgggccctgggcgccaggagagcttcccggagtcgaccttcctgctggctgctctgtgaccgcttcccggctctgccctcttggccgaagtgcccgctgccgggcgcgggcctcaggtcgaattgacataaaacagttgatagcaaagaagataaagttgacagcagaggcagaggaattgaagccattttttatgaaggaagttggcagtcactttgatgattttgtgaccaatctcattgaaaagtcagcatcattagataatggtgggtgcgctctcacaaccttttctgttcttgaaggagagaaaaacaaccatagagcgaaggatttgagagcacctccagaacaaggaaagatttttattgcaaggcgctctctcttagatgaactgcttgaagtggaccacatcagaacaatatatcacatgtttattgccctcctcattctctttatcctcagcacacttgtagtagattacattgatgaaggaaggctggtgcttgagttcagcctcctgtcttatgcttttggcaaatttcctaccgttgtttggacctggtggatcatgttcctgtctacattttcagttccctattttctgtttcaacattgggccactggctatagcaagagttctcatccgctgatccgttctctcttccatggctttcttttcatgatcttccagattggagttctaggttttggaccaacatatgttgtgttagcatatacactgccaccagcttcccggttcatcattatattcgagcagattcgttttgtaatgaaggcccactcatttgtcagagagaacgtgcctcgggtactaaattcagctaaggagaaatcaagcactgttccaatacctacagtcaaccagtatttgtacttcttatttgctcctacccttatctaccgtgacagctatcccaggaatcccactgtaagatggggttatgtcgctatgaagtttgcacaggtctttggttgctttttctatgtgtactacatctttgaaaggctttgtgcccccttgtttcggaatatcaaacaggagcccttcagcgctcgtgttctggtcctatgtgtatttaactccatcttgccaggtgtgctgattctcttccttactttttttgcctttttgcactgctggctcaatgcctttgctgagatgttacgctttggtgacaggatgttctataaggattggtggaactccacgtcatactccaactattatagaacctggaatgtggtggtccatgactggctatattactatgcttacaaggactttctctggtttttctccaagagattcaaatctgctgccatgttagctgtctttgctgtatctgctgtagtacacgaatatgccttggctgtttgcttgagctttttctatcccgtgctcttcgtgctcttcatgttctttggaatggctttcaacttcattgtcaatgatagtcggaaaaagccgatttggaatgttctgatgtggacttctcttttcttgggcaatggagtcttactctgcttttattctcaagaatggtatgcacgtcagcactgtcctctgaaaaatcccacatttttggattatgtccggccacgttcctggacttgtcgttacgtgttttagaagcttggactttgtttcctccttgtcactgaagattgggtagctccctgatttggagccagctgtttccagttgttactgaagttatctgtgttatttggaccactccaggctttacagatgactcactccattcctaggtcacttgaagccaaactgttggaagttcactggagtcttgtacacttaagcagagcagaactttttttgtggggctgggtggggggagaagaccgactaacagctgaagtaatgacagattgttgctgggtcatatcagctttatcccttggtaattatatctgttttgtttcttgactctgtccaatcagagaataaacatcatagtttcttggccactgaattagccaaaacacttaggaagaaatcacttaaatacctctggcttagaaattttttcatgcacactgttggaatgtatgctaattgaacatgcaattggggaagaaaaaatgtagaatgatttttgctatttctagtagaaagaaaatgtctgttttccaaagataatgttatacatcctattttgtaatttttttgaaaaaagttcaatgttcagttttccttagtttttaccttgttttctctataggtcatgatttctgtgaagcaaaaagatgccttttaccatgaattcttgagtttacatcaataatattgtatattaaggggatcagaagtaggaaggaaaaaataagagatagcagaggaaaaagaaaaacatttcctcttataacttctgaagtaatttgtaaaaaagatttgtagagtcaatcatgtgtttaaattattttatcacaaacttaacatggaagatattcctttttaactttgtggtaacttctttgaagttatttagaaatatcctttggaacaattattttattgtctaataaatattgacttctcttgaattattttgcagactagtgagtctgtaccataagtattaatcacctccactcatattaaagtgatcattaagaatccagaagctggcttctgcatttgctcagttatacttttaatggtagtatgtttttaggtggaataaattaatatgtgattggtttcaaggaaatgtactctattatgtaatacttccattttataagatgcccatttctaatacaatgtgtgtaggaattatttgtatgtatgaggtatgattgtaaagattgagcattggaaggggtatcagagaccatgtagttcaactttccactcaaagtaagatttatgaattatttaaatgatagttgttacttggaacagccacttgagaggctctcttggtattgtttggaattgttttaaagtcagtttgagtctcacaagaaggtaagtagagtttcttaatagtcacaacttaatttgaaccacaagtatccagcttaatcacgtatcttactcacgataccactggtccagatgagtttaggtaattttcaaacattaaatccaacttcaacggaaacaaatacactcaagggaagttatttttaaaaaggtactctgcatgttcccgcagtaatgttctgcacaacagtattgtaattgtaatggaatcataacctgctaactagtttgctttaatatggcttgtaattcttgacatttttcttaaaattaaaacgaatttttattttgaatttataactgcattttaaatatattggggacagattgcgctgagacctggttatgagcaagccaatcttttgaatctagagaatggaattcttaggtttatatttctgttaagaaatactataaatatgactcttatgagaagactttgttgctctgtagtgtttctgaatactgtatttgttggattgatcaaggctatttttcaaaaagctctctgcttcctgtttgtttgtttgtttgtttttgagacagagtcttgctctgtcgccggggctggagtgcaatggcgtgaactcagctcactgcaacctctgcctccctggttcaagctattctcctgcctcagcctcctgagtagctgggattacagggccacgcctggctaatttttgtatttttagtagagatggggtttcaccctgttggtcaggctggtctcaaactcctgaccttgtgatctgcccacctcagcctcccaaagtgctgggaagacaggcgttagccaccgtgcccggcctctgtttcctgttattagtgattttcctgcccaagattgcaacaacaaatatgtagaactacagactgtttagaatgctgagactgttctaagaaactttcaaaaacagtagcacttcaaggaatggtcactttctatgaaagaaactggtttgatagccataatcttattgctagctgcttttagcaaaagtcttttcttgaaaccaccacctatactctttaaacaaataaaaactaaaatctcttgctaatgtttcaggaagatttattttttctattttgctattgtggcgaaaattattttcagttataggatacttttttccttctgaaaagtaataagcttaaagtttttgtttctgtaagatgtaatgatagtaactattattttgggcatattaaccaacagaacaattatgtagtatgtatatcactttctcattagatctctaacttgaccttctagtacctttatgtgtgaggataaatttgttagatccttttattctcaatcttggataatgatgcaaaatggaattttgttttgtttgttggtagattcacatactaaaactttgcaggtaaagttgcttgcctcatgttagaatttaattagaaaactgaggctgcctttttttttttttttttttttttttaagacagagtcttgttctgtcgcccaggccagttttttttttcttgtacagatggggttttaccatgttgctcaggctggtctcaaactcctggagtcaagggatctatttgcctcagcctctcaaagtgctgggattacaggtgtgagccacggctcctggctccttgctccagaatcagttttttaatggaagatagctcatactttgtttttgtttttaaagagacagggtctcactctgttgcccaggctggtagtagcgtgatcatagctcactgcagtctcaaactcctggactcaaatagtgctctggagtacctagaactacaagtgcctaccaccacacccagctaatttatttgtttttttttttttagagatggggggggtctccctatgttgcccaggctggtctcaaactcttcacctcaagcaaaactcccactgcagaaagctttgggattacaggcatgagccaccatgccaagcccatacttattgttaataaagtttcagtgacttgcttactaatcttatgcaaaatttcatgtaatttatgtaatactacataacaatgctacatatggtatgtatacatacactgtatacacacaaaggtctgttctgggtattttatgtatcttatctctaggctttatggctctgaaatggagggaactggacataaatgtttcaaggaataaagtgaatgttttgtttgtttgtttgttttgagacggagtctcagtcaccaggctggagtgcagtgctgtgatctcagctcactgcaacctctgcctcctgggttcaagcgattctcctgcctcagcctcccgagtagctggcattacaggtgcctgccaccatgtccagctaatttttgtgtttttagtagagatggggtttcaccatgatggtcaggctggtctcgaactcctgacctcatgatccgccagcctcagcctcccatagtgctgggattataggcatgagccatgctcccggccaaagtgaatgttttgggtgaagtttatataaggatttgacttttgtatcattattaaagtttctgtcaggtaatacagtgttggccctctgttgaaataaaatgttacatatcgctgggtgtagtggctcatgcctttaatcccagtactttgggaggccaaggcaggaggattgcttgagctcagaagtttgagaccagcctgggcaacatagcaaaaccttgtcactataaaaaatacaaaaattagccaggcgtggtggtgcacgcctgtagtctcagctactcagtcggctgaggtgggaagatggcttcaagccgggagatggaggcttcagtgacctgtgacctgtgatcacaccacttaattcctcaaaacatttatgtcccagttccctccatttcagagccatgggcaacagagcgagaccctgtctcaaaaaaaaaattacatataagcccggtttaaagagaggataatatgcaaccaccctagttgaaacagagtgtatcacttctttctcaccctaaatttaatgcctagtttgaaaatcagtagacaataataaagttgataagctttaggttggtaggaaagctatgtaatctatatagtgtactaaatccttatatgtttttggtaaaaaaagactttaatagctaatttggacttcagaaaatgggttaatttcacgagtgcatatcacttttgactatattagtcaagcatattattaaagtttaaaaaactctaaaacttctgtactgtttttttcttaagtgctctcttccttatttctacattactacattcacatttctgctgtcaataagccctaatggagtgataaactttaagctagtagatactgcaccatgtcttgtggtggtgttttcttaatgaaatggaagctgtacttcctgtttgtttttaaatacttttgaaacagacagttcatgtaccccatcatttagagatgcagtttgaatttccatggaaaaaggtgccaattttggattgggaaaggagctgaagccccagtcaagactttgccatttggggtaatgcagcagattcctgtgtctgtatctttccagtgtgtgtgttaatccatagtgttctgagcaccagaagggtcatgtaaatctgaagttgttattaaaggtttttctatagtg

SEQ ID NO: 186913 - DNA, 6861 bp, Homo sapiens
  Payload ID: 16803
  Gene Symbol: SOAT1
  Gene Name: sterol O-acyltransferase 1
  Uniprot ID: P35610
  ENST ID: ENST00000540564
  CDS Start-End: 347-1825
aataggatgctcagccggaggtggccctgcgcgtgacgcagcggtgctcggaggcagggggcgtaggggccgggctgtccggcgctttagcttagcaggcgacgttgcgggccctgggcgccaggagagcttcccggagtcgaccttcctgctggctgctctgtgaccgcttcccggctctgccctcttggccgaagtgcccgctgccgggcgcgggcctcagacaatacaatggtgggtgaagagaagatgtctctaagaaaccggctgtcaaagtccagggaaaatcctgaggaagatgaagaccagagaaaccctgcaaaggagtccctagagacacctagtaatggaattgaagccattttttatgaaggaagttggcagtcactttgatgattttgtgaccaatctcattgaaaagtcagcatcattagataatggtgggtgcgctctcacaaccttttctgttcttgaaggagagaaaaacaaccatagagcgaaggatttgagagcacctccagaacaaggaaagatttttattgcaaggcgctctctcttagatgaactgcttgaagtggaccacatcagaacaatatatcacatgtttattgccctcctcattctctttatcctcagcacacttgtagtagattacattgatgaaggaaggctggtgcttgagttcagcctcctgtcttatgcttttggcaaatttcctaccgttgtttggacctggtggatcatgttcctgtctacattttcagttccctattttctgtttcaacattgggccactggctatagcaagagttctcatccgctgatccgttctctcttccatggctttcttttcatgatcttccagattggagttctaggttttggaccaacatatgttgtgttagcatatacactgccaccagcttcccggttcatcattatattcgagcagattcgttttgtaatgaaggcccactcatttgtcagagagaacgtgcctcgggtactaaattcagctaaggagaaatcaagcactgttccaatacctacagtcaaccagtatttgtacttcttatttgctcctacccttatctaccgtgacagctatcccaggaatcccactgtaagatggggttatgtcgctatgaagtttgcacaggtctttggttgctttttctatgtgtactacatctttgaaaggctttgtgcccccttgtttcggaatatcaaacaggagcccttcagcgctcgtgttctggtcctatgtgtatttaactccatcttgccaggtgtgctgattctcttccttactttttttgcctttttgcactgctggctcaatgcctttgctgagatgttacgctttggtgacaggatgttctataaggattggtggaactccacgtcatactccaactattatagaacctggaatgtggtggtccatgactggctatattactatgcttacaaggactttctctggtttttctccaagagattcaaatctgctgccatgttagctgtctttgctgtatctgctgtagtacacgaatatgccttggctgtttgcttgagctttttctatcccgtgctcttcgtgctcttcatgttctttggaatggctttcaacttcattgtcaatgatagtcggaaaaagccgatttggaatgttctgatgtggacttctcttttcttgggcaatggagtcttactctgcttttattctcaagaatggtatgcacgtcagcactgtcctctgaaaaatcccacatttttggattatgtccggccacgttcctggacttgtcgttacgtgttttagaagcttggactttgtttcctccttgtcactgaagattgggtagctccctgatttggagccagctgtttccagttgttactgaagttatctgtgttatttggaccactccaggctttacagatgactcactccattcctaggtcacttgaagccaaactgttggaagttcactggagtcttgtacacttaagcagagcagaactttttttgtggggctgggtggggggagaagaccgactaacagctgaagtaatgacagattgttgctgggtcatatcagctttatcccttggtaattatatctgttttgtttcttgactctgtccaatcagagaataaacatcatagtttcttggccactgaattagccaaaacacttaggaagaaatcacttaaatacctctggcttagaaattttttcatgcacactgttggaatgtatgctaattgaacatgcaattggggaagaaaaaatgtagaatgatttttgctatttctagtagaaagaaaatgtctgttttccaaagataatgttatacatcctattttgtaatttttttgaaaaaagttcaatgttcagttttccttagtttttaccttgttttctctataggtcatgatttctgtgaagcaaaaagatgccttttaccatgaattcttgagtttacatcaataatattgtatattaaggggatcagaagtaggaaggaaaaaataagagatagcagaggaaaaagaaaaacatttcctcttataacttctgaagtaatttgtaaaaaagatttgtagagtcaatcatgtgtttaaattattttatcacaaacttaacatggaagatattcctttttaactttgtggtaacttctttgaagttatttagaaatatcctttggaacaattattttattgtctaataaatattgacttctcttgaattattttgcagactagtgagtctgtaccataagtattaatcacctccactcatattaaagtgatcattaagaatccagaagctggcttctgcatttgctcagttatacttttaatggtagtatgtttttaggtggaataaattaatatgtgattggtttcaaggaaatgtactctattatgtaatacttccattttataagatgcccatttctaatacaatgtgtgtaggaattatttgtatgtatgaggtatgattgtaaagattgagcattggaaggggtatcagagaccatgtagttcaactttccactcaaagtaagatttatgaattatttaaatgatagttgttacttggaacagccacttgagaggctctcttggtattgtttggaattgttttaaagtcagtttgagtctcacaagaaggtaagtagagtttcttaatagtcacaacttaatttgaaccacaagtatccagcttaatcacgtatcttactcacgataccactggtccagatgagtttaggtaattttcaaacattaaatccaacttcaacggaaacaaatacactcaagggaagttatttttaaaaaggtactctgcatgttcccgcagtaatgttctgcacaacagtattgtaattgtaatggaatcataacctgctaactagtttgctttaatatggcttgtaattcttgacatttttcttaaaattaaaacgaatttttattttgaatttataactgcattttaaatatattggggacagattgcgctgagacctggttatgagcaagccaatcttttgaatctagagaatggaattcttaggtttatatttctgttaagaaatactataaatatgactcttatgagaagactttgttgctctgtagtgtttctgaatactgtatttgttggattgatcaaggctatttttcaaaaagctctctgcttcctgtttgtttgtttgtttgtttttgagacagagtcttgctctgtcgccggggctggagtgcaatggcgtgaactcagctcactgcaacctctgcctccctggttcaagctattctcctgcctcagcctcctgagtagctgggattacagggccacgcctggctaatttttgtatttttagtagagatggggtttcaccctgttggtcaggctggtctcaaactcctgaccttgtgatctgcccacctcagcctcccaaagtgctgggaagacaggcgttagccaccgtgcccggcctctgtttcctgttattagtgattttcctgcccaagattgcaacaacaaatatgtagaactacagactgtttagaatgctgagactgttctaagaaactttcaaaaacagtagcacttcaaggaatggtcactttctatgaaagaaactggtttgatagccataatcttattgctagctgcttttagcaaaagtcttttcttgaaaccaccacctatactctttaaacaaataaaaactaaaatctcttgctaatgtttcaggaagatttattttttctattttgctattgtggcgaaaattattttcagttataggatacttttttccttctgaaaagtaataagcttaaagtttttgtttctgtaagatgtaatgatagtaactattattttgggcatattaaccaacagaacaattatgtagtatgtatatcactttctcattagatctctaacttgaccttctagtacctttatgtgtgaggataaatttgttagatccttttattctcaatcttggataatgatgcaaaatggaattttgttttgtttgttggtagattcacatactaaaactttgcaggtaaagttgcttgcctcatgttagaatttaattagaaaactgaggctgcctttttttttttttttttttttttttaagacagagtcttgttctgtcgcccaggccagttttttttttcttgtacagatggggttttaccatgttgctcaggctggtctcaaactcctggagtcaagggatctatttgcctcagcctctcaaagtgctgggattacaggtgtgagccacggctcctggctccttgctccagaatcagttttttaatggaagatagctcatactttgtttttgtttttaaagagacagggtctcactctgttgcccaggctggtagtagcgtgatcatagctcactgcagtctcaaactcctggactcaaatagtgctctggagtacctagaactacaagtgcctaccaccacacccagctaatttatttgtttttttttttttagagatggggggggtctccctatgttgcccaggctggtctcaaactcttcacctcaagcaaaactcccactgcagaaagctttgggattacaggcatgagccaccatgccaagcccatacttattgttaataaagtttcagtgacttgcttactaatcttatgcaaaatttcatgtaatttatgtaatactacataacaatgctacatatggtatgtatacatacactgtatacacacaaaggtctgttctgggtattttatgtatcttatctctaggctttatggctctgaaatggagggaactggacataaatgtttcaaggaataaagtgaatgttttgtttgtttgtttgttttgagacggagtctcagtcaccaggctggagtgcagtgctgtgatctcagctcactgcaacctctgcctcctgggttcaagcgattctcctgcctcagcctcccgagtagctggcattacaggtgcctgccaccatgtccagctaatttttgtgtttttagtagagatggggtttcaccatgatggtcaggctggtctcgaactcctgacctcatgatccgccagcctcagcctcccatagtgctgggattataggcatgagccatgctcccggccaaagtgaatgttttgggtgaagtttatataaggatttgacttttgtatcattattaaagtttctgtcaggtaatacagtgttggccctctgttgaaataaaatgttacatatcgctgggtgtagtggctcatgcctttaatcccagtactttgggaggccaaggcaggaggattgcttgagctcagaagtttgagaccagcctgggcaacatagcaaaaccttgtcactataaaaaatacaaaaattagccaggcgtggtggtgcacgcctgtagtctcagctactcagtcggctgaggtgggaagatggcttcaagccgggagatggaggcttcagtgacctgtgacctgtgatcacaccacttaattcctcaaaacatttatgtcccagttccctccatttcagagccatgggcaacagagcgagaccctgtctcaaaaaaaaaattacatataagcccggtttaaagagaggataatatgcaaccaccctagttgaaacagagtgtatcacttctttctcaccctaaatttaatgcctagtttgaaaatcagtagacaataataaagttgataagctttaggttggtaggaaagctatgtaatctatatagtgtactaaatccttatatgtttttggtaaaaaaagactttaatagctaatttggacttcagaaaatgggttaatttcacgagtgcatatcacttttgactatattagtcaagcatattattaaagtttaaaaaactctaaaacttctgtactgtttttttcttaagtgctctcttccttatttctacattactacattcacatttctgctgtcaataagccctaatggagtgataaactttaagctagtagatactgcaccatgtcttgtggtggtgttttcttaatgaaatggaagctgtacttcctgtttgtttttaaatacttttgaaacagacagttcatgtaccccatcatttagagatgcagtttgaatttccatggaaaaaggtgccaattttggattgggaaaggagctgaagccccagtcaagactttgccatttggggtaatgcagcagattcctgtgtctgtatctttccagtgtgtgtgttaatccatagtgttctgagcaccagaagggtcatgtaaatctgaagttgttattaaaggtttttctatagtg

SEQ ID NO: 186914 - DNA, 2044 bp, Homo sapiens
  Payload ID: 16804
  Gene Symbol: SOAT2
  Gene Name: sterol O-acyltransferase 2
  Uniprot ID: O75908
  ENST ID: ENST00000301466
  CDS Start-End: 61-1629
actgcgaaggaaggaggcaacacgggcaagggctgcctgctgcccgctggagaccgcaccatggagccaggcggggcccgtctgcgtctgcagaggacagaagggctgggaggggagcgggagcgccaaccctgtggagatggaaacactgagacgcacagagccccggacttggtacaatggacccgacacatggaggctgtgaaggcacaattgctggagcaagcgcagggacaactgagggagctgctggatcgggccatgcgggaggctatacaatcctacccatcacaagacaaacctctgcccccacctcccccaggttccttgagcaggacccaggagccatccctggggaaacagaaagttttcatcatccgcaagtccctgcttgatgagctgatggaggtgcagcatttccgcaccatctaccacatgttcatcgctggcctgtgtgtcttcatcatcagcaccctggccatcgacttcattgatgagggcaggctgctgctggagtttgacctactgatcttcagcttcggacagctgccattggcgctggtgacctgggtgcccatgtttctgtccaccctgttggcgccgtaccaggccctacggctgtgggccaggggcacctggacgcaggcgacgggcctgggctgtgcgctgctagccgcccacgccgtggtgctctgcgcgctgccggtccacgtggccgtggagcatcagctcccgccggcctcccgttgtgtcctggtcttcgagcaggttaggttcctgatgaaaagctactccttcctgagagaggctgtgcctgggacccttcgtgccagacgaggtgaggggatccaggcccccagtttctccagctacctctacttcctcttctgcccaacactcatctacagggagacttaccctaggacgccctatgtcaggtggaattatgtggccaagaactttgcccaggccctgggatgtgtgctctatgcctgcttcatcctgggccgcctctgtgttcctgtctttgccaacatgagccgagagcccttcagcacccgtgccctggtgctctctatcctgcatgccacgttgccaggcatcttcatgctgctgctcatcttctttgccttcctccattgctggctcaacgcctttgccgagatgctacgatttggagacaggatgttctaccgggactggtggaactcaacgtccttctccaactactaccgcacttggaacgtggtggtccatgactggctgtacagctacgtgtatcaggatgggctgcggctccttggtgcccgggcccgaggggtagccatgctgggtgtgttcctggtctccgcagtggcccatgagtatatcttctgcttcgtcctggggttcttctatcccgtcatgctgatactcttccttgtcattggaggaatgttgaacttcatgatgcatgaccagcgcaccggcccggcatggaacgtgctgatgtggaccatgctgtttctaggccagggaatccaggtcagcctgtactgccaggagtggtacgcacggcggcactgccccttaccccaggcaactttctgggggctggtgacacctcgatcttggtcctgccatacctagaggtcgggacagacgacgctacctgcccagacaccaccaagttctctgcctgcaaaacctgggaccaggactcctgtctgcattcccaaatttggctctgagtcgaggcaacctgcacacaagaccccaccaaggaatgtgcaaggactgagatctgcagacttgtgggtaactgatcacagacctcagcatgggggtgaccagggtgactcttcaatccctatccccatgggctgggtacaggatatcctcctaccccatgactgtcttagggagacttggggtaccttatggatttgatgaatgtgggggaactcagaggaactggggccaccaaggttggaaaagggtttggttcttgactttgtattccttccaatacagcaataaactttgtctccctttttattcattc

SEQ ID NO: 186915 - DNA, 1797 bp, Homo sapiens
  Payload ID: 16804
  Gene Symbol: SOAT2
  Gene Name: sterol O-acyltransferase 2
  Uniprot ID: O75908
  ENST ID: ENST00000542365
  CDS Start-End: 48-980
gaggcaacacgggcaagggctgcctgctgcccgctggagaccgcaccatggagccaggcggggcccgtctgcgtctgcagaggacagaagggctgggaggggagcgggagcgccaaccctgtggagatggaaacactgagacgcacagagccccggacttggtacaatggacccgacacatggaggctgtgaaggcacaattgctggagcaagcgcagggacaactgagggagctgctggatcgggccatgcgggaggctatacaatcctacccatcacaagacaaacctctgcccccacctcccccaggttccttgagcaggacccaggagccatccctggggaaacagaaagttttcatcatccgcaagtccctgcttgatgagctgatggaggtgcagcatttccgcaccatctaccacatgttcatcgctggcctgtgtgtcttcatcatcagcaccctggccatcgacttcattgatgagggcaggctgctgctggagtttgacctactgatcttcagcttcggacagctgccattggcgctggtgacctgggtgcccatgtttctgtccaccctgttggcgccgtaccaggccctacggctgtgggccaggggcacctggacgcaggcgacgggcctgggctgtgcgctgctagccgcccacgccgtggtgctctgcgcgctgccggtccacgtggccgtggagcatcagctcccgccggcctcccgttgtgtcctggtcttcgagcaggttaggttcctgatgaaaagctactccttcctgagagaggctgtgcctgggacccttcgtgccagacgaggtgaggggatccaggcccccagtttctccagctacctctacttcctcttctgcccaacactcatctacagggagacttaccctaggccctgggatgtgtgctctatgcctgcttcatcctgggccgcctctgtgttcctgtctttgccaacatgagccgagagcccttcagcacccgtgccctggtgctctctatcctgcatgccacgttgccaggcatcttcatgctgctgctcatcttctttgccttcctccattgctggctcaacgcctttgccgagatgctacgatttggagacaggatgttctaccgggactggtggaactcaacgtccttctccaactactaccgcacttggaacgtggtggtccatgactggctgtacagctacgtgtatcaggatgggctgcggctccttggtgcccgggcccgaggggtagccatgctgggtgtgttcctggtctccgcagtggcccatgagtatatcttctgcttcgtcctggggttcttctatcccgtcatgctgatactcttccttgtcattggaggaatgttgaacttcatgatgcatgaccagcgcaccggcccggcatggaacgtgctgatgtggaccatgctgtttctaggccagggaatccaggtcagcctgtactgccaggagtggtacgcacggcggcactgccccttaccccaggcaactttctgggggctggtgacacctcgatcttggtcctgccatacctagaggtcgggacagacgacgctacctgcccagacaccaccaagttctctgcctgcaaaacctgggaccaggactcctgtctgcattcccaaatttggctctgagtcgaggcaacctgcacacaagaccccaccaaggaatgtgcaaggactgagatctgcagacttgtgggtaactgatcacagacctcagcatgggggtgaccagggtgactcttcaatccctatccc

SEQ ID NO: 186916 - DNA, 570 bp, Homo sapiens
  Payload ID: 16804
  Gene Symbol: SOAT2
  Gene Name: sterol O-acyltransferase 2
  ENST ID: ENST00000551896
  CDS Start-End: 61-570
actgcgaaggaaggaggcaacacgggcaagggctgcctgctgcccgctggagaccgcaccatggagccaggcggggcccgtctgcgtctgcagaggacagaagggctgggaggggagcgggagcgccaaccctgtggagatggaaacactgagacgcacagagccccggacttggtacaatggacccgacacatggaggctgtgaaggcacaattgctggagcaagcgcagggacaactgagggagctgctggatcgggccatgcgggaggctatacaatcctacccatcacaagacaaacctctgcccccacctcccccaggttccttgagcagtgagctgatggaggtgcagcatttccgcaccatctaccacatgttcatcgctggcctgtgtgtcttcatcatcagcaccctggccatcgacttcattgatgagggcaggctgctgctggagtttgacctactgatcttcagcttcggacagctgccattggcgctggtgacctgggtgcccatgtttctgtccaccctgttggcgccgtaccaggccctacggctgtgggccagg

SEQ ID NO: 186917 - DNA, 4178 bp, Homo sapiens
  Payload ID: 16805
  Gene Symbol: SREBF1
  Gene Name: sterol regulatory element binding transcription factor 1
  Uniprot ID: P36956
  ENST ID: ENST00000261646
  CDS Start-End: 186-3629
gcggccgggggaacccagtttccgaggaacttttcgccggcgccgggccgcctctgaggccagggcaggacacgaacgcgcggagcggcggcggcgactgagagccggggccgcggcggcgctccctaggaagggccgtacgaggcggcgggcccggcgggcctcccggaggaggcggctgcgccatggacgagccacccttcagcgaggcggctttggagcaggcgctgggcgagccgtgcgatctggacgcggcgctgctgaccgacatcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccagctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctg

SEQ ID NO: 186918 - DNA, 4253 bp, Homo sapiens
  Payload ID: 16805
  Gene Symbol: SREBF1
  Gene Name: sterol regulatory element binding transcription factor 1
  Uniprot ID: P36956
  ENST ID: ENST00000355815
  CDS Start-End: 171-3704
cagtttccgaggaacttttcgccggcgccgggccgcctctgaggccagggcaggacacgaacgcgcggagcggcggcggcgactgagagccggggccgcggcggcgctccctaggaagggccgtacgaggcggcgggcccggcgggcctcccggaggaggcggctgcgccatggacgagccacccttcagcgaggcggctttggagcaggcgctgggcgagccgtgcgatctggacgcggcgctgctgaccgacatcgaaggtgaagtcggcgcggggaggggtagggccaacggcctggacgccccaagggcgggcgcagatcgcggagccatggattgcactttcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccagctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctg

SEQ ID NO: 186919 - DNA, 4653 bp, Homo sapiens
  Payload ID: 16805
  Gene Symbol: SREBF1
  Gene Name: sterol regulatory element binding transcription factor 1
  ENST ID: ENST00000395751
  CDS Start-End: 1379-2029
agagctcaggctctgaagtctgcagtcttgggcccgaccctgggctcagccccagcctagctgtggggcaagattgtgagccttgtggtgcccaccttgtccaggtattgtgatgcactcgcagcagcaggcattgctttagacagcacaggtgctcgcaaaatggctgtatgtccgggaacaccagctcctgtgggtggctttctgtcctggtggcattgcccacacatacagctgtgtgccaacaagggttgtgcaaataaggttgtgtttggatgtgtgtgatgccctgtttgggggtcagtctctgcctcactcacgcaccctcttctccttttcacagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggtaagggggatgtgtggcgggaggggacacccggggtggggcttccaggagcacaggaagaagcttctgctgtgatgtgagtagaggtctgtgcaggctttagaaactggggctccactcggctgcttgagatgccctgttactagcagtcctggtgtgcttgttgccggggtaggcgcaacctcgcactggaggcctggcttgaagccagtgcatttgcatcagagcccaggcagggactgtccataggaagccacatggggcaatgactcatccaaggccagtcggtgatagagacctgaagagcaggttgaaagtgggagagggaggtctgtgtctgcagccccatgctttatttctgcaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaagacagaataactgaggcctggagccacgtggggtcccacagtaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccagctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctg

SEQ ID NO: 186920 - DNA, 3696 bp, Homo sapiens
  Payload ID: 16805
  Gene Symbol: SREBF1
  Gene Name: sterol regulatory element binding transcription factor 1
  ENST ID: ENST00000395757
  CDS Start-End: 466-3147
gttactagcagtcctggtgtgcttgttgccggggtaggcgcaacctcgcactggaggcctggcttgaagccagtgcatttgcatcagagcccaggcagggactgtccataggaagccacatggggcaatgactcatccaaggccagtcggtgatagagacctgaagagcaggttgaaagtgggagagggaggtctgtgtctgcagccccatgctttatttctgcaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccagctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctg

SEQ ID NO: 186921 - DNA, 1058 bp, Homo sapiens
  Payload ID: 16805
  Gene Symbol: SREBF1
  Gene Name: sterol regulatory element binding transcription factor 1
  ENST ID: ENST00000423161
  CDS Start-End: 83-1058
cgccttgacaggtgaagtcggcgcggggaggggtagggccaacggcctggacgccccaagggcgggcgcagatcgcggagccatggattgcactttcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgg

SEQ ID NO: 186922 - DNA, 536 bp, Homo sapiens
  Payload ID: 16805
  Gene Symbol: SREBF1
  Gene Name: sterol regulatory element binding transcription factor 1
  ENST ID: ENST00000577897
  CDS Start-End: 339-536
cttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagc

SEQ ID NO: 186923 - DNA, 882 bp, Homo sapiens
  Payload ID: 16805
  Gene Symbol: SREBF1
  Gene Name: sterol regulatory element binding transcription factor 1
  ENST ID: ENST00000478616
  CDS Start-End: 1-492
ggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggtgagggggcagctgctgaccagggatgtgctgtctgctcagcagggaagggcgcacatgggatgtgataccaagggaggctgtgtgtgtgtcagacgggacagacaggcctggcgcagtggctcacacctagcactttgggaggctcagttgggaggacagcttgagcccaggagttggaggccgcagtgagcctgagtgacagggagagtccctgtctcaaaaaaaaaaaaagaccaagcatcttcttgatggttacctgatgacaattcctttcacaaggaatcagtggggtgactgtcatttgtgggatacatgactgcacgtgcgtgactcagtctgtggactttgtgtgtgggctgagactagggtggggagaggggaacccgccaggcccccgccaggtacctgtgtgccaggtacaggcggctggtgccgtggcttgtgtgtgggcaggg

SEQ ID NO: 186924 - DNA, 588 bp, Homo sapiens
  Payload ID: 16805
  Gene Symbol: SREBF1
  Gene Name: sterol regulatory element binding transcription factor 1
  ENST ID: ENST00000578469
  CDS Start-End: 1-95
gggccagccccacacggacacaccagctcctcgaccgcagtctgaggcggcgggcaggccccggtggcaaaggagctgatggatgtgctgactagtgagagtgcttgggccctcccccagcacctagggaaaggcttcccctccccctccggccacaaggtccctgggtggcacgggaggatggactgacttccaggacctgttgtgtgacaggagctacagcttgggtctccctgcaagaagtctggcacgtctcacctcccccatcccggcccctggtcatctcacagcaaagaagcctcctccctcccgacctgccgccacactggagagggggcacaggggcgggggaggtttcctgttctgtgaaaggccgactccctgactccattcatgcccccccccccagcccctcccttcattcccattccccaacctaaagcctggcccggctcccagctgaatctggtcggaatccacgggctgcagattttccaaaacaatcgttgtatctttattgacttttttttttttttttttctgaatgcaatgactgttttttactcttaaggaaaataaacatctttt

SEQ ID NO: 186925 - DNA, 473 bp, Homo sapiens
  Payload ID: 16805
  Gene Symbol: SREBF1
  Gene Name: sterol regulatory element binding transcription factor 1
  ENST ID: ENST00000486311
  CDS Start-End: 1-473
aaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcaca

SEQ ID NO: 186926 - DNA, 1230 bp, Homo sapiens
  Payload ID: 16805
  Gene Symbol: SREBF1
  Gene Name: sterol regulatory element binding transcription factor 1
  ENST ID: ENST00000485080
  CDS Start-End: 1-333
gccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggagctgatggatgtgctgactagtgagagtgcttgggccctcccccagcacctagggaaaggcttcccctccccctccggccacaaggagctacagcttgggtctccctgcaagaagtctggcacgtctcacctcccccatcccggcccctggtcatctcacagcaaagaagcctcctccctcccgacctgccgccacactggagagggggcacaggggcgggggaggtttcctgttctgtgaaaggccgactccctgactccattcatgcccccccccccagcccctcccttcattcccattccccaacctaaagcctggcccggctcccagctgaatctggtcggaatccacgggctgcagattttccaaaacaatcgttgtatctttattgacttttttttttttttttttctgaatgcaatgactgttttttactcttaaggaaaataaacatcttttagaaacagctcgatacacacaatcttcagtgtgaagcaatatactaataagaacactagtcgtcttaacatttacagtcttcatatatattatatatatgtatatgtatacatatatatacactatataacgaggccagatataatacacacgtttaccattttacagtcatatgtacaggaagttgctagggcggccctgggctgggggctgcgtcaggcctatcgaagcgtggacagagctgaggacacggacggacaggcggacggactggcagggactggcccgggccggtggtggctgcgtggacaagtggcgtcgcggtagccccttacccggcaaaggcttcctttctcccccgcctagtccacggagctaggagccgccctccgcctcttccagtactgtttcgacccccacccccaagcccagggctcccagctgcacgccacgaccga

SEQ ID NO: 186927 - DNA, 3026 bp, Homo sapiens
  Payload ID: 16805
  Gene Symbol: SREBF1
  Gene Name: sterol regulatory element binding transcription factor 1
  ENST ID: ENST00000395756
  CDS Start-End: 1-340
tctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggttgggccctgccacggtgcccccttccccactcccagccatatcctctgagcctcatgacagggccgggaagaccctaacagatcctacctcccatttcatagacagaataactgaggcctggagccacgtggggtcccacagtaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccagctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctg

SEQ ID NO: 186928 - DNA, 5240 bp, Homo sapiens
  Payload ID: 16806
  Gene Symbol: SREBF2
  Gene Name: sterol regulatory element binding transcription factor 2
  Uniprot ID: Q12772
  ENST ID: ENST00000361204
  CDS Start-End: 167-3592
ctttctgtgcggcgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccacccagca

SEQ ID NO: 186929 - DNA, 5699 bp, Homo sapiens
  Payload ID: 16806
  Gene Symbol: SREBF2
  Gene Name: sterol regulatory element binding transcription factor 2
  ENST ID: ENST00000424354
  CDS Start-End: 108-2162
ggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagtttacggaaaaaaatctggggcaactcacagcattgaggaagagttaaacatccacatttcaagaggaacaagaaccagaacactcctcagcagcaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagaccacctccacccccaccatcaaccctggcaactttgtcctgtaactaaaatagcctttagcacatggcataaccggagagcttttgacattcctctttggagattcatgtctgcgtcttgggggcattcggcactagtgatgggcagccctgcctgctgactccccggctgtttctaattggatctgagtattctaagagaaactgtaaaatgctccaagacagaaaggccccacgaggtcctatccttagagccaaggctgtagcatttcctatcaagcagacccttaaccggcgcacaggaaggagctgagaagagtaaggaaactgaggcacacgttggaatgactatcttgggtggcttcttagcagcagacgtgatggtgaagcctgtgtctctgacttccagcattgaatgaaggagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccacccag

SEQ ID NO: 186930 - DNA, 770 bp, Homo sapiens
  Payload ID: 16806
  Gene Symbol: SREBF2
  Gene Name: sterol regulatory element binding transcription factor 2
  ENST ID: ENST00000435061
  CDS Start-End: 1-770
cgtctgcaatcactgtggccatcagctggctccagggagacgatgcagctgtgcgctctcattttaccaaagtggaacgcatccccaaggccctggaagtgacagagagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggcagcctccagggccttggggcttcacccagggcacttgtctaccagccccacgaggtgcgtccagggctttcttgtcaccagttgggaaaagcaggccttttgcctctctctcctctcatcctgctcctgctgttcagccaggtttcctgcctggctcagggtcagagtacgggacaacagaggttgcttttcaggggtgttcctgcatgaagccaccgtgcgcctgatggcaggagccagccccacccgcacccaccagctgctggaacacagcctgcggcggcgcaccacgcagagcaccaagcac

SEQ ID NO: 186931 - DNA, 5365 bp, Homo sapiens
  Payload ID: 16806
  Gene Symbol: SREBF2
  Gene Name: sterol regulatory element binding transcription factor 2
  ENST ID: ENST00000612482
  CDS Start-End: 283-2247
ctggggcgggggaatcccgccccgccctttctgtgcggcgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagtttacggaaaaaaatctggggcaactcacagcattgaggaagagttaaacatccacatttcaagaggaacaagaaccagaacactcctcagcagcaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccacccagc

SEQ ID NO: 186932 - DNA, 2456 bp, Homo sapiens
  Payload ID: 16807
  Gene Symbol: SC5D
  Gene Name: sterol-C5-desaturase
  Uniprot ID: O75845
  ENST ID: ENST00000264027
  CDS Start-End: 375-1274
atgtttgtataaacaccgtaaacctgcctggtaccaccatgaatgacacaagagctagtttaaaaagaaagcaaagaaacaaacgcaaaacccgaaaccgcatcctccaccgcaaaggtactcggatggggcgcccgccctccccttagtcagaggacaaagggggcgtggccgagcgcgcggcgcccacgtgaccgcggagagctgcgcgcaggcccttcgcgcgatctgccgtcatatcagcttatggcgccggtcgctgattggctggccgctccagcctcccggcccgcttgctggctgcccagctgctaggacagtttgcagagcagtggcgtgcggagcggcggcggaccacctccaggggctaagtgatggatcttgtactccgtgttgcagattactatttttttacaccatacgtgtatccagccacatggccagaagatgacatcttccgacaagctattagtcttctgattgtaacaaatgttggtgcttacatcctttatttcttctgtgcaacactgagctattattttgtcttcgatcatgcattaatgaaacatccacaatttttaaagaatcaagtccgtcgagagattaagtttactgtccaggcattgccatggataagtattcttactgttgcactgttcttgctggagataagaggttacagcaaattacatgatgacctaggagagtttccatatggattgtttgaacttgtcgttagtataatatctttcctctttttcactgacatgttcatctactggattcacagaggccttcatcatagactggtatataagcgcctacataaacctcaccatatttggaagattcctactccatttgcaagtcatgcttttcaccctattgatggctttcttcagagtctaccttaccatatatacccttttatctttccattacacaaggtggtttatttaagtctgtacatcttggttaatatctggacaatttccattcatgacggtgattttcgtgtcccccaaatcttacagccatttattaatggctcagctcatcatacagaccaccatatgttctttgactataattatggacaatatttcactttgtgggataggattggcggctcattcaaaaatccttcatcctttgaggggaagggaccgctcagttatgtgaaggagatgacagagggaaagcgcagcagccattcaggaaatggctgtaagaatgaaaaattattcaatggagagtttacaaagactgaatagattattgcccagttattcttaagtaaggacaaagaaggaaatatcatcgtatttcttttttttaataaggaaaaaataatatccatacagtcaagatacatagtaaatggtatcatttggaaatcagcatcgtgggcactgctgaggaatgatcctagtggtaggtcagaagaagatgctgtgaacaccaggactttaatcttatgcttaaaatgccagatgttgttcgggggacaacttgtatctttctagcagcagatctgtagtttgtatagcctcaacaacaattttaaataagatggagaataaattattgaggggactaggctatatgcatttgccttcatccacccatgtttattaagaatcattgtgcttaataataccaagactaagcaccataaccaagaaatactaatgtaaagattgtttcttgtttcaggaatggttaattcttcaacgttggtatgataatgataacttgttttgacttgaataaagtactacatcagtgtggaaaaaaattctgatacattagcagctatgtaaatgacctaattgatagcaggtgtaataagactatcgtcttcctacacataggaggctcattctctggacacactatcacctattacattttactgattaacaaataaattggaatttaaaaatatcgatatcaccatgatttaatccagatctgggattatgtagctaaacattgtgatgattattatttaaaaccattatttaataagagtaaaaatatgtgaatctggatatatttaaaaaaagaaatttgatgcccagataatatattaggcactactgattttttagttaaattgatgcactacacttttgatgtttgaagttacaaacctgtaatttttttgtaaaggaaataattgccaaatacctaggcccattgctgacgattagttctaaaatcttattcctcctcttctcccctcacttttccctacttcctctgcaaaaagatttaacaaatacattcataaggaaatgtgtgttgtaacaaatatattgcaaaaacatagtttgtaaaggcattctataagctatttatgtaaaatcaataaaagttgatcataattaaactgtatcagttgagtattatagcagcacaaagtattctttgtacagattttgtgccaattt

SEQ ID NO: 186933 - DNA, 2258 bp, Homo sapiens
  Payload ID: 16807
  Gene Symbol: SC5D
  Gene Name: sterol-C5-desaturase
  Uniprot ID: O75845
  ENST ID: ENST00000392789
  CDS Start-End: 238-1137
tacacctgagcgggctgggccggggggcgatggaataaaagaagatggagagacttcagcgcctgggactcgggtgggcgaggcggaaggtgtcctcgcagcacggcttttctccgcgccgcggttggttagcgagtgccctctgggtgctaggcgttgggcggatggtaggatcgcggtagcatacggatccgagtcctgcgccgagtgagaggagaggctggcaggggctaagtgatggatcttgtactccgtgttgcagattactatttttttacaccatacgtgtatccagccacatggccagaagatgacatcttccgacaagctattagtcttctgattgtaacaaatgttggtgcttacatcctttatttcttctgtgcaacactgagctattattttgtcttcgatcatgcattaatgaaacatccacaatttttaaagaatcaagtccgtcgagagattaagtttactgtccaggcattgccatggataagtattcttactgttgcactgttcttgctggagataagaggttacagcaaattacatgatgacctaggagagtttccatatggattgtttgaacttgtcgttagtataatatctttcctctttttcactgacatgttcatctactggattcacagaggccttcatcatagactggtatataagcgcctacataaacctcaccatatttggaagattcctactccatttgcaagtcatgcttttcaccctattgatggctttcttcagagtctaccttaccatatatacccttttatctttccattacacaaggtggtttatttaagtctgtacatcttggttaatatctggacaatttccattcatgacggtgattttcgtgtcccccaaatcttacagccatttattaatggctcagctcatcatacagaccaccatatgttctttgactataattatggacaatatttcactttgtgggataggattggcggctcattcaaaaatccttcatcctttgaggggaagggaccgctcagttatgtgaaggagatgacagagggaaagcgcagcagccattcaggaaatggctgtaagaatgaaaaattattcaatggagagtttacaaagactgaatagattattgcccagttattcttaagtaaggacaaagaaggaaatatcatcgtatttcttttttttaataaggaaaaaataatatccatacagtcaagatacatagtaaatggtatcatttggaaatcagcatcgtgggcactgctgaggaatgatcctagtggtaggtcagaagaagatgctgtgaacaccaggactttaatcttatgcttaaaatgccagatgttgttcgggggacaacttgtatctttctagcagcagatctgtagtttgtatagcctcaacaacaattttaaataagatggagaataaattattgaggggactaggctatatgcatttgccttcatccacccatgtttattaagaatcattgtgcttaataataccaagactaagcaccataaccaagaaatactaatgtaaagattgtttcttgtttcaggaatggttaattcttcaacgttggtatgataatgataacttgttttgacttgaataaagtactacatcagtgtggaaaaaaattctgatacattagcagctatgtaaatgacctaattgatagcaggtgtaataagactatcgtcttcctacacataggaggctcattctctggacacactatcacctattacattttactgattaacaaataaattggaatttaaaaatatcgatatcaccatgatttaatccagatctgggattatgtagctaaacattgtgatgattattatttaaaaccattatttaataagagtaaaaatatgtgaatctggatatatttaaaaaaagaaatttgatgcccagataatatattaggcactactgattttttagttaaattgatgcactacacttttgatgtttgaagttacaaacctgtaatttttttgtaaaggaaataattgccaaatacctaggcccattgctgacgattagttctaaaatcttattcctcctcttctcccctcacttttccctacttcctctgcaaaaagatttaacaaatacattcataaggaaatgtgtgttgtaacaaatatattgcaaaaacatagtttgtaaaggcattctataagctatttatgtaaaatcaataaaagttgatcataattaaa

SEQ ID NO: 186934 - DNA, 1861 bp, Homo sapiens
  Payload ID: 16807
  Gene Symbol: SC5D
  Gene Name: sterol-C5-desaturase
  ENST ID: ENST00000534230
  CDS Start-End: 57-743
agtttgcagagcagtggcgtgcggagcggcggcggaccacctccaggggctaagtgatggatcttgtactccgtgttgcagattactatttttttacaccatacgtgtatccagccacatggccagaagatgacatcttccgacaagctattagtcttctgattgtaacaaatgttggtgcttacatcctttatttcttctgtgcaacactgagctattattttgtcttcgatcatgcattaatgaaacatccacaatttttaaagaatcaagtccgtcgagagattaagtttactgtccaggcattgccatggataagtattcttactgttgcactgttcttgctggagataagaggttacagcaaattacatgatgacctaggagagtttccatatggattgtttgaacttgtcgttagtataatatctttcctctttttcactgacatgttcatctactggattcacagaggccttcatcatagactggtatataagcgcctacataaacctcaccatatttggaagattcctactccatttgcaagtcatgcttttcaccctattgatggctttcttcagagtctaccttaccatatatacccttttatctttccattacacaaggtggtttatttaagtctgtacatcttggttaatatctggacaatttccattcatgacggaaatggctgtaagaatgaaaaattattcaatggagagtttacaaagactgaatagattattgcccagttattcttaagtaaggacaaagaaggaaatatcatcgtatttcttttttttaataaggaaaaaataatatccatacagtcaagatacatagtaaatggtatcatttggaaatcagcatcgtgggcactgctgaggaatgatcctagtggtaggtcagaagaagatgctgtgaacaccaggactttaatcttatgcttaaaatgccagatgttgttcgggggacaacttgtatctttctagcagcagatctgtagtttgtatagcctcaacaacaattttaaataagatggagaataaattattgaggggactaggctatatgcatttgccttcatccacccatgtttattaagaatcattgtgcttaataataccaagactaagcaccataaccaagaaatactaatgtaaagattgtttcttgtttcaggaatggttaattcttcaacgttggtatgataatgataacttgttttgacttgaataaagtactacatcagtgtggaaaaaaattctgatacattagcagctatgtaaatgacctaattgatagcaggtgtaataagactatcgtcttcctacacataggaggctcattctctggacacactatcacctattacattttactgattaacaaataaattggaatttaaaaatatcgatatcaccatgatttaatccagatctgggattatgtagctaaacattgtgatgattattatttaaaaccattatttaataagagtaaaaatatgtgaatctggatatatttaaaaaaagaaatttgatgcccagataatatattaggcactactgattttttagttaaattgatgcactacacttttgatgtttgaagttacaaacctgtaatttttttgtaaaggaaataattgccaaatacctaggcccattgctgacgattagttctaaaatcttattcctcctcttctcccctcacttttccctacttcctctgcaaaaagatttaacaaatacattcataaggaaatgtgtgttgtaacaaatatattgcaaaaacatagtttgtaaaggcattctataagctatttatgtaaaatcaataaaagttgatcataatt

SEQ ID NO: 186935 - DNA, 589 bp, Homo sapiens
  Payload ID: 16807
  Gene Symbol: SC5D
  Gene Name: sterol-C5-desaturase
  ENST ID: ENST00000527762
  CDS Start-End: 57-589
agtttgcagagcagtggcgtgcggagcggcggcggaccacctccaggggctaagtgatggatcttgtactccgtgttgcagattactatttttttacaccatacgtgtatccagccacatggccagaagatgacatcttccgacaagctattagtcttctgattgtaacaaatgttggtgcttacatcctttatttcttctgtgcaacactgagctattattttgtcttcgatcatgcattaatgaaacatccacaatttttaaagtattggaaatttcactttcagaatcaagtccgtcgagagattaagtttactgtccaggcattgccatggataagtattcttactgttgcactgttcttgctggagataagaggttacagcaaattacatgatgacctaggagagtttccatatggattgtttgaacttgtcgttagtataatatctttcctctttttcactgacatgttcatctactggattcacagaggccttcatcatagactggtatataagcgcctacataaacctcaccatatttggaagattcctactccatttgcaagtcatgcttttcaccctat

SEQ ID NO: 186936 - DNA, 751 bp, Homo sapiens
  Payload ID: 16808
  Gene Symbol: STRA13
  Gene Name: stimulated by retinoic acid 13
  Uniprot ID: A8MT69
  ENST ID: ENST00000306704
  CDS Start-End: 58-249
ctcattggctggaggcgcggggcggggttccggtgggcgcgcgttgaggctgcggtcatggagggagcaggagctggatccggcttccggaaggagctggtgagcaggctgctgcacctgcacttcaaggatgacaagaccaaagaagcagcagtccgcggcgtgcggcaggcccaggcagaagacgcgctccgtgtggacgtggaccagctggagaaggtgcttccgcagctgctcctggacttctagggatctcagccgtggctgaggccacccccagaggagcccctggtccacagaagcaggccttgtgtttccagcggcctctgataagaggcagggaaggacctgaaggatttggagttgattcaaacaagatctctgggagtctccagcctgtgcagaaggggcaggactgcagtgcactgcgggccttggagtgtccagtggggacactggtgtgggaaggggcagcacctggggagtccctgcctctcctccctgggacaatagtgtgcatgccacccggggtcctacaggcaggtgctgggaaaggcctggccagcaggtagcctgtgtgtttgacaaacagcagctggcagcgctgcctcctgcccacattcctgccacccgacatcaaagctggcgtgtgacctttccagccatgcgatattccccttggaagatgcttccccaggctataaatttgttctcacaaagcaacatcaataaatcaaaactgtctctccca

SEQ ID NO: 186937 - DNA, 805 bp, Homo sapiens
  Payload ID: 16808
  Gene Symbol: STRA13
  Gene Name: stimulated by retinoic acid 13
  Uniprot ID: A8MT69
  ENST ID: ENST00000392359
  CDS Start-End: 58-303
ctcattggctggaggcgcggggcggggttccggtgggcgcgcgttgaggctgcggtcatggagggagcaggagctggatccggcttccggaaggagctggtgagcaggctgctgcacctgcacttcaaggatgacaagaccaaagtgagcggggacgcgctgcagctcatggtggagttgctgaaggtcttcgttgtggaagcagcagtccgcggcgtgcggcaggcccaggcagaagacgcgctccgtgtggacgtggaccagctggagaaggtgcttccgcagctgctcctggacttctagggatctcagccgtggctgaggccacccccagaggagcccctggtccacagaagcaggccttgtgtttccagcggcctctgataagaggcagggaaggacctgaaggatttggagttgattcaaacaagatctctgggagtctccagcctgtgcagaaggggcaggactgcagtgcactgcgggccttggagtgtccagtggggacactggtgtgggaaggggcagcacctggggagtccctgcctctcctccctgggacaatagtgtgcatgccacccggggtcctacaggcaggtgctgggaaaggcctggccagcaggtagcctgtgtgtttgacaaacagcagctggcagcgctgcctcctgcccacattcctgccacccgacatcaaagctggcgtgtgacctttccagccatgcgatattccccttggaagatgcttccccaggctataaatttgttctcacaaagcaacatcaataaatcaaaactgtctctccca

SEQ ID NO: 186938 - DNA, 710 bp, Homo sapiens
  Payload ID: 16808
  Gene Symbol: STRA13
  Gene Name: stimulated by retinoic acid 13
  Uniprot ID: A8MT69
  ENST ID: ENST00000580435
  CDS Start-End: 32-208
gttccggtgggcgcgcgttgaggctgcggtcatggagggagcaggagctggatccggcttccggaaggagctggtgagcaggctgctgcacctgcacttcaaggatgacaagaccaaagaagcagcagtccgcggcgtgcggcaggcccaggcagaagacgcgctccgtgtggacgtggaccagctggagaagctcctggacttctagggatctcagccgtggctgaggccacccccagaggagcccctggtccacagaagcaggccttgtgtttccagcggcctctgataagaggcagggaaggacctgaaggatttggagttgattcaaacaagatctctgggagtctccagcctgtgcagaaggggcaggactgcagtgcactgcgggccttggagtgtccagtggggacactggtgtgggaaggggcagcacctggggagtccctgcctctcctccctgggacaatagtgtgcatgccacccggggtcctacaggcaggtgctgggaaaggcctggccagcaggtagcctgtgtgtttgacaaacagcagctggcagcgctgcctcctgcccacattcctgccacccgacatcaaagctggcgtgtgacctttccagccatgcgatattccccttggaagatgcttccccaggctataaatttgttctcacaaagcaacatcaataaatcaaaactgtctctccca

SEQ ID NO: 186939 - DNA, 730 bp, Homo sapiens
  Payload ID: 16808
  Gene Symbol: STRA13
  Gene Name: stimulated by retinoic acid 13
  ENST ID: ENST00000584600
  CDS Start-End: 1-228
gagggagcaggagctggatccggcttccggaaggagctggtgagcaggctgctgcacctgcacttcaaggatgacaagaccaaagtgagcggggacgcgctgcagctcatggtggagttgctgaaggtcttcgttgtggaagcagcagtccgcggcgtgcggcaggcccaggcagaagacgcgctccgtgtggacgtggaccagctggagaagctcctggacttctagggatctcagccgtggctgaggccacccccagaggagcccctggtccacagaagcaggccttgtgtttccagcggcctctgataagaggcagggaaggacctgaaggatttggagttgattcaaacaagatctctgggagtctccagcctgtgcagaaggggcaggactgcagtgcactgcgggccttggagtgtccagtggggacactggtgtgggaaggggcagcacctggggagtccctgcctctcctccctgggacaatagtgtgcatgccacccggggtcctacaggcaggtgctgggaaaggcctggccagcaggtagcctgtgtgtttgacaaacagcagctggcagcgctgcctcctgcccacattcctgccacccgacatcaaagctggcgtgtgacctttccagccatgcgatattccccttggaagatgcttccccaggctataaatttgttctcacaaagcaacatcaataaatcaaaactgtctctccca

SEQ ID NO: 186940 - DNA, 702 bp, Homo sapiens
  Payload ID: 16808
  Gene Symbol: STRA13
  Gene Name: stimulated by retinoic acid 13
  ENST ID: ENST00000579520
  CDS Start-End: 1-199
gcccctgccaggcaccaagccggctctgcacgcggggaaccaggagctggtgagcaggctgctgcacctgcacttcaaggatgacaagaccaaagaagcagcagtccgcggcgtgcggcaggcccaggcagaagacgcgctccgtgtggacgtggaccagctggagaaggtgcttccgcagctgctcctggacttctagggatctcagccgtggctgaggccacccccagaggagcccctggtccacagaagcaggccttgtgtttccagcggcctctgataagaggcagggaaggacctgaaggatttggagttgattcaaacaagatctctgggagtctccagcctgtgcagaaggggcaggactgcagtgcactgcgggccttggagtgtccagtggggacactggtgtgggaaggggcagcacctggggagtccctgcctctcctccctgggacaatagtgtgcatgccacccggggtcctacaggcaggtgctgggaaaggcctggccagcaggtagcctgtgtgtttgacaaacagcagctggcagcgctgcctcctgcccacattcctgccacccgacatcaaagctggcgtgtgacctttccagccatgcgatattccccttggaagatgcttccccaggctataaatttgttctcacaaagcaacatcaataaatcaaaactgtctctcccag

SEQ ID NO: 186941 - DNA, 799 bp, Homo sapiens
  Payload ID: 16808
  Gene Symbol: STRA13
  Gene Name: stimulated by retinoic acid 13
  ENST ID: ENST00000584347
  CDS Start-End: 19-414
cgcgttgaggctgcggtcatggagggagcaggagctggatccggcttccggaaggagctggtgagcaggctgctgcacctgcacttcaaggatgacaagaccaaagtgagcggggacgcgctgcagctcatggtggagttgctgaaggtcttcgttgtgggtgagcccagggcccacgctccctccgggcacagcatccggaattttgcgtttttccagcgggaaaaccaagacgtgttttcccgtttcccacaagggcctaaacttgggtctcctgagcctgtttgtcagaagcagcagtccgcggcgtgcggcaggcccaggcagaagacgcgctccgtgtggacgtggaccagctggagaaggtgcttccgcagctgctcctggacttctagggatctcagccgtggctgaggccacccccagaggagcccctggtccacagaagcaggccttgtgtttccagcggcctctgataagaggcagggaaggacctgaaggatttggagttgattcaaacaagatctctgggagtctccagcctgtgcagaaggggcaggactgcagtgcactgcgggccttggagtgtccagtggggacactggtgtgggaaggggcagcacctggggagtccctgcctctcctccctgggacaatagtgtgcatgccacccggggtcctacaggcaggtgctgggaaaggcctggccagcaggtagcctgtgtgtttgacaaacagcagctggcagcgctgcctcctgcccacattcctgccacccgacatcaaagctggcgtgtga

SEQ ID NO: 186942 - DNA, 2864 bp, Homo sapiens
  Payload ID: 16809
  Gene Symbol: STRA6
  Gene Name: stimulated by retinoic acid 6
  Uniprot ID: Q9BX79
  ENST ID: ENST00000323940
  CDS Start-End: 247-2250
agatcaaacaccttttaaagcaggtgctggggacacttctcagggccaactgccgagaccacacaaccagccacccctctaggatcccagcccagctggtgctgggctcagaggagaaggccccgtgttgggagcaccctgcttgcctggagggacaagtttccgggagagatcaataaaggaaaggaaagagacaaggaagggagaggtcaggagagcgcttgattggaggagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctctcctcccagcatcacaccagccatgcagccagcaggtcctccggatcactgtggttgggtggaggtctgtctgcactgggagcctcaggagggctctgctccacccacttggctatgggagagccagcaggggttctggagaaagaaactggtgggttagggccttggtccaggagccagttgagccagggcagccacatccaggcgtctccctaccctggctctgccatcagccttgaagggcctcgatgaagccttctctggaaccactccagcccagctccacctcagccttggccttcacgctgtggaagcagccaaggcacttcctcaccccctcagcgccacggacctctctggggagtggccggaaagctcccgggcctctggcctgcagggcagcccaagtcatgactcagaccaggtcccacactgagctgcccacactcgagagccagatatttttgtagtttttatgcctttggctattatgaaagaggttagtgtgttccctgcaataaacttgttcctgagaaa

SEQ ID NO: 186943 - DNA, 2800 bp, Homo sapiens
  Payload ID: 16809
  Gene Symbol: STRA6
  Gene Name: stimulated by retinoic acid 6
  Uniprot ID: Q9BX79
  ENST ID: ENST00000395105
  CDS Start-End: 183-2186
gtatttccatcaccgaggcccaaaggggccagaaaggggcaggctgaggctgggggaggggctcaagggagcccagctgggagggcccaggcaggcagtgcggagctggccgtgggctgcctaccctttcatctctgcaactccttcctccctgggcctcccttctggagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctctcctcccagcatcacaccagccatgcagccagcaggtcctccggatcactgtggttgggtggaggtctgtctgcactgggagcctcaggagggctctgctccacccacttggctatgggagagccagcaggggttctggagaaagaaactggtgggttagggccttggtccaggagccagttgagccagggcagccacatccaggcgtctccctaccctggctctgccatcagccttgaagggcctcgatgaagccttctctggaaccactccagcccagctccacctcagccttggccttcacgctgtggaagcagccaaggcacttcctcaccccctcagcgccacggacctctctggggagtggccggaaagctcccgggcctctggcctgcagggcagcccaagtcatgactcagaccaggtcccacactgagctgcccacactcgagagccagatatttttgtagtttttatgcctttggctattatgaaagaggttagtgtgttccctgcaataaacttgttcctgagaaa

SEQ ID NO: 186944 - DNA, 2750 bp, Homo sapiens
  Payload ID: 16809
  Gene Symbol: STRA6
  Gene Name: stimulated by retinoic acid 6
  ENST ID: ENST00000416286
  CDS Start-End: 157-2136
atgtgcccagttgcttggctgctccaccaggctctgaaggcacaaacccctgagacggtgtccaagcccagggccctgtagactctgcggatcccgagaccagcgccactcatcctgcagcactggggacagacagagcaggagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctctcctcccagcatcacaccagccatgcagccagcaggtcctccggatcactgtggttgggtggaggtctgtctgcactgggagcctcaggagggctctgctccacccacttggctatgggagagccagcaggggttctggagaaagaaactggtgggttagggccttggtccaggagccagttgagccagggcagccacatccaggcgtctccctaccctggctctgccatcagccttgaagggcctcgatgaagccttctctggaaccactccagcccagctccacctcagccttggccttcacgctgtggaagcagccaaggcacttcctcaccccctcagcgccacggacctctctggggagtggccggaaagctcccgggcctctggcctgcagggcagcccaagtcatgactcagaccaggtcccacactgagctgcccacactcgagagccagatatttttgtagtttttatgcctttggctattatgaaagaggttagtgtgttccctgcaataaacttgttcctgagaaa

SEQ ID NO: 186945 - DNA, 1889 bp, Homo sapiens
  Payload ID: 16809
  Gene Symbol: STRA6
  Gene Name: stimulated by retinoic acid 6
  Uniprot ID: Q9BX79
  ENST ID: ENST00000432245
  CDS Start-End: 195-674
ccgagaccacacaaccagccacccctctaggatcccagcccagctggtgctgggctcagaggagaaggccccgtgttgggagcaccctgcttgcctggagggacaagtttccgggagagatcaataaaggaaaggaaagagacaaggaagggagaggtcaggagagcgcttgattggaggagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggtaacttgcccaagatcacagagttgagactagtcagagcctggatttgaacctagtgttcttgcccactgaacgtgctgaagggcttggaagctggagaccgaagagaggcctgggtgggctcactgcaggccccatgtctgcccctccagcatgggtctctctgcttgtttcaccttccaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaaggtaaccgctgatcacaatggcctagggcagaggggcgcacagagcaacctactcaaaccacagtgcctcctttgagctctgattctatgatgggccgccctgcagccttccattgtgcatgggattccatgccttcaaacatgtgccccttccaagcttggctgctctgcaggagaggcagggaacaaggtggctgggcccagccctcaggaactttaagtctaggaggtggcggagaaggggaagtgggcagagtagggggaagagaaagcctgaaatggcccccacccccaatgcctgtgttagtgatcccccagcttccctttggtcaggctggagagggaatgggagtgaagcttgatggaggccggcaagtgcgaagtcagggatggtctaagagggctgagaggagaattccggaacctcaggaccttgctcactggctgctggctggggctgtgaagctgtccagtctagaactcaaagagtgatggtacaggctttagagccagacaacctgagtgtgaatccagcttcaccacttcattcattcactcacccattcattcaacaacatatttgaagcacatactttgtaccagggacatttccaggcactggactacagctatgaacaagacaaacagtccctagcctcccaagagccgtcacttcagaagggcagacatgacacgcaaacaaaatgatgccaggtggtaccaagtgccttggggaaacagtgccacctttctgagaccgtttctccatccgtccatggagctgataacaccagtccctcagggtggaggtgaagactaagaggttgctttgagagggggaacttggtggctttttttcaccacctagaacctggcacatactaagctctcaataaaagtatattgaaccaacaaa

SEQ ID NO: 186946 - DNA, 2732 bp, Homo sapiens
  Payload ID: 16809
  Gene Symbol: STRA6
  Gene Name: stimulated by retinoic acid 6
  Uniprot ID: Q9BX79
  ENST ID: ENST00000449139
  CDS Start-End: 115-2118
caaacccctgagacggtgtccaagcccagggccctgtagactctgcggatcccgagaccagcgccactcatcctgcagcactggggacagacagagcaggagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctctcctcccagcatcacaccagccatgcagccagcaggtcctccggatcactgtggttgggtggaggtctgtctgcactgggagcctcaggagggctctgctccacccacttggctatgggagagccagcaggggttctggagaaagaaactggtgggttagggccttggtccaggagccagttgagccagggcagccacatccaggcgtctccctaccctggctctgccatcagccttgaagggcctcgatgaagccttctctggaaccactccagcccagctccacctcagccttggccttcacgctgtggaagcagccaaggcacttcctcaccccctcagcgccacggacctctctggggagtggccggaaagctcccgggcctctggcctgcagggcagcccaagtcatgactcagaccaggtcccacactgagctgcccacactcgagagccagatatttttgtagtttttatgcctttggctattatgaaagaggttagtgtgttccctgcaataaacttgttcctgagaaa

SEQ ID NO: 186947 - DNA, 2776 bp, Homo sapiens
  Payload ID: 16809
  Gene Symbol: STRA6
  Gene Name: stimulated by retinoic acid 6
  Uniprot ID: Q9BX79
  ENST ID: ENST00000423167
  CDS Start-End: 186-2162
cacaaccagccacccctctaggatcccagcccagctggtgctgggctcagaggagaaggccccgtgttgggagcaccctgcttgcctggagggacaagtttccgggagagatcaataaaggaaaggaaagagacaaggaagggagaggtcaggagagcgcttgattggaggagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctctcctcccagcatcacaccagccatgcagccagcaggtcctccggatcactgtggttgggtggaggtctgtctgcactgggagcctcaggagggctctgctccacccacttggctatgggagagccagcaggggttctggagaaagaaactggtgggttagggccttggtccaggagccagttgagccagggcagccacatccaggcgtctccctaccctggctctgccatcagccttgaagggcctcgatgaagccttctctggaaccactccagcccagctccacctcagccttggccttcacgctgtggaagcagccaaggcacttcctcaccccctcagcgccacggacctctctggggagtggccggaaagctcccgggcctctggcctgcagggcagcccaagtcatgactcagaccaggtcccacactgagctgcccacactcgagagccagatatttttgtagtttttatgcctttggctattatgaaagaggttagtgtgttccctgcaataaacttgttcctgagaaa

SEQ ID NO: 186948 - DNA, 2631 bp, Homo sapiens
  Payload ID: 16809
  Gene Symbol: STRA6
  Gene Name: stimulated by retinoic acid 6
  Uniprot ID: Q9BX79
  ENST ID: ENST00000535552
  CDS Start-End: 252-2366
gtgctcaggtgaggggggatgcagccgactgtccagcagcgttggaggttgcaggcatgtacttggggtgaagagcaggactccagaaccccagcctgtctgtgagaagtgagaaatagaagagaaagctccgagggggcctttttcacttcccctgggaatagatcatacctggaattccagccctgaagccctgtgatgactccccttagctgtggtcagggccctcagcccagctgggcagcagcaggatgcagatccggttattaagagccgagctggtggttcccctctggcaattcatcaggcagtggccccctgggagtgatggatggggacaaatggaggagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctctcctcccagcatcacaccagccatgcagccagcaggtcctccggatcactgtggttgggtggaggtctgtctgcactgggagcctcaggagggctctgctccacccacttggctatgggagagccagcaggggttctggagaaagaaactggtgggttagggccttggtccaggagccagttgagcca

SEQ ID NO: 186949 - DNA, 2565 bp, Homo sapiens
  Payload ID: 16809
  Gene Symbol: STRA6
  Gene Name: stimulated by retinoic acid 6
  Uniprot ID: Q9BX79
  ENST ID: ENST00000563965
  CDS Start-End: 340-2460
aaaggggccagaaaggggcaggctgaggctgggggaggggctcaagggagcccagctgggagggcccaggcaggcagtgcggagctggccgtgggctgcctaccctttcatctctgcaactccttcctccctgggcctcccttctggtgtgtctgtgggtctgtctaggtgggcttgggaaaggggaaggaaggggcgtctctttaggcagctcagactggacaagccttctttgaaaatggtcctttgaacacacgcctgctggtggttggtcagacagatgcgccagcgggagccccggggccccaaggggacagctatctctgcaggaccagtgcgatgggcgggaagggaggaggggacacgagaggccctgtcctcttcccgtgccagcttgctcaggccctcagtcccagacgggcttttcccagagagctaaaagagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctctcctcccagcatcacaccagccatgcag

SEQ ID NO: 186950 - DNA, 449 bp, Homo sapiens
  Payload ID: 16809
  Gene Symbol: STRA6
  Gene Name: stimulated by retinoic acid 6
  ENST ID: ENST00000571341
  CDS Start-End: 184-449
agtcccagacgggcttttcccagagagctaaaagtaagaaagtaaccttcaggattaaagagaaatgtttctttgtttgggttttccgtctttctttctttttttttctcttttaagcctcttttcacatctgtagtggctttttttttctctcgcctggggtcaaaggagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccag

SEQ ID NO: 186951 - DNA, 566 bp, Homo sapiens
  Payload ID: 16809
  Gene Symbol: STRA6
  Gene Name: stimulated by retinoic acid 6
  ENST ID: ENST00000573391
  CDS Start-End: 70-333
ctgcagatgtggcgggcaggggcttgggagctctggggcaggcgctgaaggcaggagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcagtgagtccaacccaagttgaacctggcttgcaagctgctgccagcctgggcagtgggacctgtgttccccactggggctggtgaaggggggccctggaagatcctgggtggggggagctatctgggagttctcccagcttggaggcccaaaccaggatgcaagtccaaccttccagatgtctgtcaccccttgaccagtccccaagatgtcacatgagtgtgcactgggcagatccttgtgctgctgctcctggccatgctggtgaggcgccgccagctctggcctgactgtgtgcgtggcaggcccggcctgccca

SEQ ID NO: 186952 - DNA, 2455 bp, Homo sapiens
  Payload ID: 16809
  Gene Symbol: STRA6
  Gene Name: stimulated by retinoic acid 6
  Uniprot ID: Q9BX79
  ENST ID: ENST00000574278
  CDS Start-End: 329-2377
atgttatgatgatgctgttggtgaggggggcatgagaattgcaggaagggcacatcagatggtgcttctgaccctcccacatggcaggggaggtaggaggtagagagacaggaggtggagagtcacccatactcttcctgccgtgagcacggcagccgacgacactgccttccagcccactgtgtggagtcagacttggtctggtgccagaattaagcacgtatgtgtgcgaagggcagttggatgtgtgtgtgagtgtgctgtgccactgagggcacaccccaagctcacgggcccgcatgaggttgactctctcggctgcttattcatggactctcaaggggactgggctgcacaggagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctct

SEQ ID NO: 186953 - DNA, 797 bp, Homo sapiens
  Payload ID: 16809
  Gene Symbol: STRA6
  Gene Name: stimulated by retinoic acid 6
  ENST ID: ENST00000572785
  CDS Start-End: 1-797
ggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacagggctcctggtgcagcagatcatcttcttcctgggaaccacggccctggccttcctggtgctcatgcctgtgctccatggcaggaacctcctgctcttccgttccctggagtcctcgtgaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcaca

SEQ ID NO: 186954 - DNA, 2151 bp, Homo sapiens
  Payload ID: 16809
  Gene Symbol: STRA6
  Gene Name: stimulated by retinoic acid 6
  ENST ID: ENST00000569936
  CDS Start-End: 106-1539
gttgctgtaatgctggtctcctgtctgtgtgcggcactgcagatgtggcgggcaggggcttgggagctctggggcaggcgctgaaggcaggagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagaatggctgcagtggaggactggctcctgctccccagaatccttgtcatcaagagggacaactaccagcttgggacagcgggaagaccctggcctggccttggtcatttagggtcctgctggcccttttcctgggccccttgggagggaggagggctcccgggcctgagtggtgctgttcaccatactccttcctttgaggactacaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttggtgagcctcccttgcccgccacacccagccttggcctgggcctcccctcagacactggcctcagttggggagaagagtgctcagcaagtactgccctcagagtttgtctgggaatgctctggggcagcagcaagaaggagggacccccctgccttccctgcccttaagaagcttattcaggatgggggtacaggagccctcgggaaattgagtgtgtaccctccacatggagatgaaccctgggtgccaccaagtattcacatgggggtggacccaggtctggaggtgtcaaattcaaaatggtacattcctggctgggctcagtggctcacacctgtaatcccagcactttgggaggctgaggcaggtggatcacgaagtcaggagatgaagaccagcctggccaacatggtgagaccccgtctctactaaaaatacaaaaattagccgggtatggtggtgtgcacctgcagttccagctattcgggaggatgaggcaggagaatcgcttgaacccaggaggtggaggttgcagtgagccgagattgcaccactgcgctccagcttaagaaagggctgtgtcacatttggctacctacaaagggctcctggtgca

SEQ ID NO: 186955 - DNA, 2843 bp, Homo sapiens
  Payload ID: 16809
  Gene Symbol: STRA6
  Gene Name: stimulated by retinoic acid 6
  Uniprot ID: Q9BX79
  ENST ID: ENST00000616000
  CDS Start-End: 229-2232
aaaaagggtttaccaatgagacacatgttgcctccttcatggaaaccctaggagaagaaacggacagattccccttccctgcctccgccccagcccagccccagcggtccgtctcactcggttgttgctgtaatgctggtctcctgtctgtgtgcggcactgcagatgtggcgggcaggggcttgggagctctggggcaggcgctgaaggcaggagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctctcctcccagcatcacaccagccatgcagccagcaggtcctccggatcactgtggttgggtggaggtctgtctgcactgggagcctcaggagggctctgctccacccacttggctatgggagagccagcaggggttctggagaaagaaactggtgggttagggccttggtccaggagccagttgagccagggcagccacatccaggcgtctccctaccctggctctgccatcagccttgaagggcctcgatgaagccttctctggaaccactccagcccagctccacctcagccttggccttcacgctgtggaagcagccaaggcacttcctcaccccctcagcgccacggacctctctggggagtggccggaaagctcccgggcctctggcctgcagggcagcccaagtcatgactcagaccaggtcccacactgagctgcccacactcgagagccagatatttttgtagtttttatgcctttggctattatgaaagaggttagtgtgttccctgcaataaacttgttcctgag

SEQ ID NO: 186956 - DNA, 993 bp, Homo sapiens
  Payload ID: 16810
  Gene Symbol: STRA8
  Gene Name: stimulated by retinoic acid 8
  Uniprot ID: Q7Z7C7
  ENST ID: ENST00000275764
  CDS Start-End: 1-993
atggggaagattgatgtggacaagatcctctttttcaatcaagaaatcaggctgtggcagcttataatggcaacccctgaagaaaacagcaatccccatgacagagcaacaccccagctgccagcacagctgcaggagcttgagcatcgggtggcccggagacggctgtcccaggcccgccaccgagccaccctggcagcgctcttcaacaacctcaggaagacagtgtactctcagtctgatctcatagcctcaaagtggcaggttctgaataaggcaaagagtcatattccagaactggagcaaaccctggataatttgctgaagctgaaagcatccttcaacctggaagatgggcatgcaagcagcttagaggaggtcaagaaagaatatgccagcatgtattctggaaatgacagttttcctcagaatggttcctccccttggtatctcaacttttacaaacagacgatggaccttctgactggcagcgggatcattaccccgcaggaggcggcgctgcccatcgtctccgcggccatctcccacctgtggcagaacctctcggaggagaggaaggccagcctccggcaggcctgggcgcagaagcaccgcggccctgcgaccctggcggaggcctgccgagagccggcctgtgccgagggcagcgtgaaggacagcggcgtggacagccagggggccagctgctcgctggtctccacgcccgaggagatcctttttgaggatgcctttgatgtggcaagcttcctggacaaaagtgaggttccgagtacatctagctccagttcagtgcttgccagctgcaacccagaaaacccagaggagaagtttcagctctatatgcagatcatcaacttttttaaaggccttagctgtgcaaacactcaagtaaagcaggaagcatcctttcccgttgatgaagagatgatcatgttgcagtgcacagagacctttgacgatgaagatttgtaa

SEQ ID NO: 186957 - DNA, 4420 bp, Homo sapiens
  Payload ID: 16811
  Gene Symbol: SCRG1
  Gene Name: stimulator of chondrogenesis 1
  Uniprot ID: O75711
  ENST ID: ENST00000296506
  CDS Start-End: 484-780
ctttcctcttctctctctctctctctctcacacacagacacacaaacacacacacacacacacacacacacttttcttaagggaaaaatcactctgtgttcttttaaaatccctcaggttttatgttttattgctaccagagtctgcctccctgaggttcttgtatagactagttatttccctctgtaaagaagctgttctattcgttctcgcctggtttggaacaaactgaacacttccaaaggaggcagtccttgcagccttgtctccttccactcccctcctccccacagtcctggctggagcagcgagtctgtcgatcccaggccagagacaaggcagacaaaggttcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaatctaatttttctctgtggacattgttggcattggttaaaaattttgcctagaaaatgtaatctatgaggtgttcattatactcagttaaagagttctgtcccccagatgaagagccataggcatggctcaaggattgaaaatactttcagtccttagttgacagttattaaccacatattgaaagaaccaggtataagctgagattcttggaagggagctagaaattttctagtaagaaggaaaaagggaccagcctgggcaacatagtgagaccccctctttacaaaaaaattaaaaaattagcaggttgtgggtgcccacatctgtagttctagttactcaagagggtcatttgaatctagaatttcgagtctgcagtgagctatgattgcactactgcactctagcctgggtgacagagcaagaccctgtctcgaaaaaaaaaaaaaaaaaaaaaaaaggaaaagggaacaatatttgagggtatattatgtatgctaataactttaagtacatttcaggctgggactggtgactaatgcctgtaatcctagcattttgggaggccaaggcgggaagatcacttgagtccaggagtttgagaccagcctgggcaacatagtgagatcctgtctttacaaaaaaaatttaaaaattagctgcatggcggcatgcacctgtagtcccagctatttgggaggctgaggtaggaggatcactcgagcccagaaattcaaggctgcagtgagctaagatgatgccactgaactccaccatggaaccacagagtgagactctgtctcaaacaaacaaacaaaaaccaagaactttaagcacatttcattttactctcttaaaaaacaacaacaaaagccttcaaggtaaatattctcagccccatttttcagctgctaactcaagtttaagatatttgctaaaaatcaaggcagattttcaagagttccaattccaaagcccatatgccacacacagatgtatccttaaaaccatgatacatttcctaaagtatccatttttaagaataacaaaacacacattaaaagaaacataatggatgagaatttaaaagtatcatacattttaaaagtaaataaaacagggaacttcaaaggtattttctgattgttagaggagacagctttggattatgccccataacttaagaggtatgtgactcatattgccatcagaggtaatgtcagaaagtctttcatgttataaaaatgtattcaaagcctgctaagtgccagccattattaagatctgggcatacagtaatgaataaaatggacttatcttcttggaacttgtgctctaacaaaggtgtgattgctataaacaagtaattatttataaatgtgaagcctgctacagagaagtatagggtgccatacaaagtattgtggggaaatgtttgagagacaccataccacacaggcaatctgggagatatcattttatgaataaaagtgacattatttcattaaaatatatccttggaggtccctgatctgtttctggagaccacacccagaacagtatctggtatctaatctgtgtttagtaagtgttactgggctgaaagaccacacccaaaacagtgtctggtatctaatctgtgtaaataagtgttactgggctggaccaaacaattttgaggtagtcacaattcagtgtcttaaagtgtatataaacacggctgggtgcggtggctcacgcctgtaatcccagcactttgggaggcggaggcgggcttatcacgaggtcaggagatcaagaccatcctggctaatacggtgaaacctcgtctctactaaaaatacaaaaaaaaaaaaaaaaaaaattagctgggcgtggtggcaggcgcctctagtcccagctatttgggaggctgaggcaggagaatggcgtgaacccaggaggtggagcttgcagtgagctgagatcgtgccactgcactccagcctgggcgacagagtgagactccgtccccccaaaaaaaaagtgtatataaacacaagtcagaacatgttttcgaacagtgtaagctcctataaaatacatgaagtgaaattgtaaaataatatagataggtaggtagatggataatattagttgttttatcaagatagcatgtgatttgattggcctttctttcttcactgaattgactggtaatgaaatcagcctaactcaataatgaaagtttcatatccattctggaacaatgcatagaataggtaaatttaaaaaaactatcagcaaaccagttttattttctacttggtaggaactctccttgagggggaaaaagcattaaagatccagtgtctccatttacaaatgacacatcagcataaggacatatgtgagacaacaacggctttttagtaaacgttcccttactactgcaatcaaagcctggtaagaaaaattgtatctaacaaagctaaatatttaataaataaaattttataaattattcatcataatgtctttctgaaaatatgaaattcagttatttcttttagaaatgaatgcattatacaagtacacagccttctttatattacaaaataaatgtaaaaacatacattcacacaacttaccttatataactatttctctaacttggtcaatgcatttttaaaaacaatagatttttttttttttttgaaactgagtctcactctgtcacccaggccagagtacagtggcacaatcttgactcactgcaacctctgcctcccaggttcaagtgatacttgtgcttcaacctcctgagtagctgggactacaggcacttgtcaccatgctcagctaatttttgtattttttagtagaaatgaggttttgccatgttggacaggctggtctccaactcctggcctcaaatgatctgcctgccttggcctcccaaagtgttaggattacaggcatgagtttttccaatagattttagttataagacaactaagcttttattaaaattttattattcttctaaacaccatcttgcagcaactgaatgagataggtactgatattatccttgttctatggacaaaaaagctaaggtttaaagatattaagtagtttgtctaagtttacattatcagtgagcaattgagccagattttgaatatggccagtcttacactagcatctagagtcttaaccactatgttgtttaacagcattacctaatgcattatttcctttacagaaaggcaaacttttacatggataggacacacaattgtacatttcagatagctcatatatgctaaaagcttactgaacaagtatttctgtattgttatctttgactttctatatcattgttcttactgtgaatcccacgttactgagcacaaagttgacagtaatacatattaatagctcacctctttttaattaaaattcatcttttcttcatcgtaa

SEQ ID NO: 186958 - DNA, 1642 bp, Homo sapiens
  Payload ID: 16811
  Gene Symbol: SCRG1
  Gene Name: stimulator of chondrogenesis 1
  ENST ID: ENST00000512188
  CDS Start-End: 869-1147
gtagtgagggggaagttgcagacctatgtaactttggaaatgagtagagtctgtcaaactaaaggtaaaagacaccgtatataaacactgtactccagctgataaaattgtttaccatgagaaaacaccattcagctgctttaagtttctgactgtccagttaagaactgtttcaagccaaatatgaacagaagatggacggaggaaacacagtaaaagagagacgactctgtggctcacagagagcaggctaagagcacagttttgtcttggtttccagtttgtgctccactacttatcagctgtgtgatcttggccaagtgcttaatttttttgaaccccagttcccccatctggaaactacctcatgggaggtggcatcagttcaccctcttacacaacagctacttggtgattctgctgtctcttcaagggccttactgacgattcctcagtagaacctgttttcctgagtctcacttcagcaacataaagctaagtttggtcctggctggagcagcgagtctgtcgatcccaggccagagacaaggcagacaaaggttcatttgtaaagaagctccttccagcacctcctctcttctccttttgcccaaactcacccagtgagtgtgagcatttaagaagcatcctctgccaagaccaaaaggaaagaagaaaaaggctatgaaaagctctcccaaatgctggtccttttctccagtgatgatgatttactgtgtccaggaaaagaaggagaatgatgcaagactgaatattaatatcatcttctggcatgctctaaaagcctgatcacttttagggaggatgtggattttgtttttctatggatgaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaatgtcatcatattttcatccttctaagaaatctgtgaaatagaaaaggtagatataaccatcttaccaaggaaaggtgcagagttgaagtgaccagtactatcccacataactagctaatatcaacactgggattagaacccacgtgttctgattaagaacagatttttcttctaccaagccagctggttctcaaagtgtggttcccagaacagcagcttcagcatcacctgagtttttaaaattgcatatccatccttggactcctccccagacctactgaatcagaaactctggagagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaatctaa

SEQ ID NO: 186959 - DNA, 1472 bp, Homo sapiens
  Payload ID: 16812
  Gene Symbol: STUB1
  Gene Name: STIP1 homology and U-box containing protein 1, E3 ubiquitin protein ligase
  Uniprot ID: Q9UNE7
  ENST ID: ENST00000219548
  CDS Start-End: 251-1162
tggagcgttcctcccagcccccgacgtcgcgggcccagtgtccccgtccaggctggttgggcgcacgcgcggccccactcgcccccacgcgtgcgtccccgctggtcccgcccccggccggaagttccggcggcggagctgggccgggcccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccacgagggtgatgaggacgacagccacgtccgggcccagcaggcctgcattgaggccaagcacgacaagtacatggcggacatggacgagcttttttctcaggtggatgagaagaggaagaagcgagacatccccgactacctgtgtggcaagatcagctttgagctgatgcgggagccgtgcatcacgcccagtggcatcacctacgaccgcaaggacatcgaggagcacctgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactctggactgtttcccctctcagcatcgcttttgctgggccgtgatcgtccccctttgtgggctggaaaagcaggtgagggtgggctgggctgaggccattgccgccactatctgtgtaataaaatccgtgagcacgaggtgggacgtgctggtgtgtgaccggcagtcctgccagctgttttggctagcc

SEQ ID NO: 186960 - DNA, 743 bp, Homo sapiens
  Payload ID: 16812
  Gene Symbol: STUB1
  Gene Name: STIP1 homology and U-box containing protein 1, E3 ubiquitin protein ligase
  ENST ID: ENST00000567173
  CDS Start-End: 103-743
cccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccacgagggtgatgaggacgacagccacgtccgggcccagcaggcctgcattgaggccaagcacgacaagtacatggcggacatggacgagcttttttctcaggtggatgagaagaggaagaagcgagacatccccgactacctgtgtgg

SEQ ID NO: 186961 - DNA, 875 bp, Homo sapiens
  Payload ID: 16812
  Gene Symbol: STUB1
  Gene Name: STIP1 homology and U-box containing protein 1, E3 ubiquitin protein ligase
  Uniprot ID: Q9UNE7
  ENST ID: ENST00000564370
  CDS Start-End: 173-868
tgagaaacctagtttcttgattctagccagagcgcagaagctgggacgggccgtgggtcagagtgggcacgctgagcctacgccctcatgcggctggcccggccttggtccctagacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccacgagggtgatgaggacgacagccacgtccgggcccagcaggcctgcattgaggccaagcacgacaagtacatggcggacatggacgagcttttttctcaggtggatgagaagaggaagaagcgagacatccccgactacctgtgtggcaagatcagctttgagctgatgcgggagccgtgcatcacgcccagtggcatcacctacgaccgcaaggacatcgaggagcacctgcagcgtgtgggtcattttgaccccgtgacccggagccccctgacccaggaacagctcatccccaacttggctatgaaggaggttattgacgcattcatctctgagaatggctgggtggaggactactgaggttccc

SEQ ID NO: 186962 - DNA, 729 bp, Homo sapiens
  Payload ID: 16812
  Gene Symbol: STUB1
  Gene Name: STIP1 homology and U-box containing protein 1, E3 ubiquitin protein ligase
  ENST ID: ENST00000564316
  CDS Start-End: 1-472
catccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccacgagggtgatgaggacgacagccacgtccgggcccagcaggcctgcattgaggccaagcacgtggatgagaagaggaagaagcgagacatccccgactacctgtgtggcaagatcagctttgagctgatgcgggagccgtgcatcacgcccagtggcatcacctacgaccgcaaggacatcgaggagcacctgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactctggactgtttcccctctcagcatcgcttttgctgggccgtgatcgtccccctttgtgggctggaaaagcaggtgagggtgggctgggctgaggccattgccgccactatctgtgtaataaaatccgtgagcacga

SEQ ID NO: 186963 - DNA, 1560 bp, Homo sapiens
  Payload ID: 16812
  Gene Symbol: STUB1
  Gene Name: STIP1 homology and U-box containing protein 1, E3 ubiquitin protein ligase
  Uniprot ID: Q9UNE7
  ENST ID: ENST00000565677
  CDS Start-End: 608-1303
caggccagggcctacgcgaacgcccacccttaagagcgcggggacagggaactggagcgttcctcccagcccccgacgtcgcgggcccagtgtccccgtccaggctggttgggcgcacgcgcggccccactcgcccccacgcgtgcgtccccgctggtcccgcccccggccggaagttccggcggcggagctgggccgggcccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcccagagcgcagaagctgggacgggccgtgggtcagagtgggcacgctgagcctacgccctcatgcggctggcccggccttggtccctagacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccacgagggtgatgaggacgacagccacgtccgggcccagcaggcctgcattgaggccaagcacgacaagtacatggcggacatggacgagcttttttctcaggtggatgagaagaggaagaagcgagacatccccgactacctgtgtggcaagatcagctttgagctgatgcgggagccgtgcatcacgcccagtggcatcacctacgaccgcaaggacatcgaggagcacctgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactctggactgtttcccctctcagcatcgcttttgctgggccgtgatcgtccccctttgtgggctggaaaagcaggtgagggtgggctgggctgaggccattgccgccactatctgtgtaataaaatccgtgagcacga

SEQ ID NO: 186964 - DNA, 684 bp, Homo sapiens
  Payload ID: 16812
  Gene Symbol: STUB1
  Gene Name: STIP1 homology and U-box containing protein 1, E3 ubiquitin protein ligase
  ENST ID: ENST00000566408
  CDS Start-End: 1-557
aggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccacgagggtgatgaggacgacagccacgtccgggcccagcaggcctgcattgaggccaagcacgacaagtacatggcggacatggacgagcttttttctcaggtggatgagaagaggaagaagcgagacatccccgactacctgtgtggcaagatcagctttgagctgatgcgggagccgtgcatcacgcccagtggcatcacctacgaccgcaaggacatcgaggagcacctgcaggtgaggcctgcggctgggggagcagggccagtggcatggtcctgggccccatgactgccctctgcccttcttgtcactgcagcgtgtgggtcattttgaccccgtgacccggagccccctgacccaggaacagctcatccccaacttggctatgaaggaggttattgacgcattcatctct

SEQ ID NO: 186965 - DNA, 337 bp, Homo sapiens
  Payload ID: 16812
  Gene Symbol: STUB1
  Gene Name: STIP1 homology and U-box containing protein 1, E3 ubiquitin protein ligase
  ENST ID: ENST00000565813
  CDS Start-End: 1-74
tcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactctggactgtttcccctctcagcatcgcttttgctgggccgtgatcgtccccctttgtgggctggaaaagcaggtgagggtggagatgaagacgctggtgtcaaggttgagcgtagcatgccaccagcggtcggggaagtaca

SEQ ID NO: 186966 - DNA, 3010 bp, Homo sapiens
  Payload ID: 16813
  Gene Symbol: STOM
  Gene Name: stomatin
  Uniprot ID: P27105
  ENST ID: ENST00000286713
  CDS Start-End: 19-885
gactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggtttggagagtcttaattaaggaaatttccctaatgttcatttattttctaaatccagaccgtgtttcagaataatccttacttgagagtagccattttcttgcctgtacttgtcagaactagaggaaatagccaagactaatgaaaaagattactctaacccttaaaagacttttaaattcactactagagtggtcattttaaaaatacatccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctctggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcctagctgagtttattagaggtatggagcagtgcaacttaaactcaagttgcacttacattttgaattttaaaatgatggttttatctgttgtgtgaagtggttcacccttgaggaccaggagcctccatatcctgactgaaaaccttttctgagacttagagtaacagtgcttttggttccttgagttctcctgtctccagataccaaatgaccttgacttttctgccttgtgaattcgtagtccaatcagctgaaattaaatcacttgggagggacgcatagaaggagctctaggaacacagtgccagtgcagaagtttctccaggtggcctccctttccaacaatgtacataataaagtgtatgcactttcactaa

SEQ ID NO: 186967 - DNA, 870 bp, Homo sapiens
  Payload ID: 16813
  Gene Symbol: STOM
  Gene Name: stomatin
  Uniprot ID: P27105
  ENST ID: ENST00000347359
  CDS Start-End: 67-438
agggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagag

SEQ ID NO: 186968 - DNA, 1257 bp, Homo sapiens
  Payload ID: 16813
  Gene Symbol: STOM
  Gene Name: stomatin
  ENST ID: ENST00000538954
  CDS Start-End: 118-624
acctcgattgggggcggggcggcaatctgggtcttgtgcctctggctcctcagggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcctagctgagtttattagaggtatggagcagtgcaacttaaactcaagttgcacttacattttgaattttaaaatgatggttttatctgttgtgtgaagtggttcacccttgaggaccaggagcctccatatcctgactgaaaaccttttctgagacttagagtaacagtgcttttggttccttgagttctcctgtctccagataccaaatgaccttgacttttctgccttgtgaattcgtagtccaatcagctgaaattaaatcacttgggagggacgcatagaaggagctctaggaacacagtgccagtgcagaagtttctccaggtggcctccctttccaacaatgtacataataaagtgtatgcactttcactaatatttttggggtgagagtctgtttcggcctgtattgaatgtctgtggatttccgttttcagaagtagtacattagatcctccggttctg

SEQ ID NO: 186969 - DNA, 2169 bp, Homo sapiens
  Payload ID: 16814
  Gene Symbol: STOML1
  Gene Name: stomatin (EPB72)-like 1
  Uniprot ID: Q9UBI4
  ENST ID: ENST00000316900
  CDS Start-End: 383-1450
gcgccgccgcgggtggccgcgcgggtgaagccggaagcagcagccaggagggcggggccgcgtagggcccactggccagggagggcgccgcgcggaggcgcggggcgtgtctcctgtcaaaagccatgctcggcaggtctgggtaccgggcgctgcccctgggtgattttgaccgcttccagcagtcgagcttcggctttctgggctcgcagaagggctgcttgtccccggagcggggcggcgtggggacaggggccggctaaggcatcatcttcataaggactcctggaaagcacacttctggggctgatggtataggaggaatgtgttttgccagcagtattcagtgcatgtttacagatgcccaggtgctcctggctccatgccagatgtaccccagagctggccctcctgcctctgtcatggcctcatcagtttcctggggttcttgctgctgttggtcaccttccccatttctggctggtttgccctgaagattgtgcccacctacgagcggatgattgtgttccgcctgggccggatccgcaccccccagggacctggcatggttctgctcttgcccttcattgactcctttcagagggtggatctgaggacacgagccttcaacgtccctccctgcaagctggcctctaaggacggggctgtgctgtccgtgggagccgatgtccagtttcgcatctgggacccggtgctgtcggtgatgactgtgaaagacctgaacacagccacacgcatgacagcccagaacgccatgaccaaggccctgctcaagaggccgctgcgggagatccagatggagaagctcaagatcagcgaccagcttctgctggagatcaacgatgtgaccagggcctgggggctggaggtagaccgcgtggagctggcagtggaggccgtgctccagccgccccaggacagcccagctgggcccaacctggacagcaccctccagcagctggccctgcacttcctgggaggaagcatgaactcaatggcaggaggtgccccgtccccggggccagacaccgtggagatggtgagtgaagttgagccacctgcccctcaagttggtgccaggtccagtccgaagcagcctctggcggaggggctactgactgctctacagcccttcctgtctgaggccctggtcagccaagtcggggcctgctaccagttcaatgtcgtcctgcccagcggcacccaaagcgcctacttcctggacctcactacaggacgaggaagagtgggacacggggtgcctgatggcatccctgatgtggtggtggagatggccgaggcagacctgcgggccctgctatgcagagagctgcggcccctgggggcctacatgagtggacggctgaaggtgaagggcgacctggctatggccatgaagctggaggctgtcctcagggccttgaagtagcagccttggctgactttccagagcccagtcccaagcctggcaccaagcctgaggggcctcttggaggaggaggtgttcatctgcaccacagagagttgaggccctaacaaatttcaggcccagccaagagcccatgaatggaggctgcaggaggctgagtccggctgccatgcacgtctcccctacagtggttctctggacaaggctttgtccatcccggtccccagctgagtgcccagcgctgagctgggtgcacggtgtgattccaggaggagagccaggcctgccctgccctgctggcttcctgactggagagacaggacccacagaaacagcctgacagcagctggtttggtccttgtgtgagggaccaagcatgtggcccaggctctaagctctgcggggattggagagggatggggagggaagggaaggcagctccaagaagaggtccctgtggcgaagttacctggggatcctggctggcccaccttcctggctgcagtccaggcccgtgctggcgggattgggcatgggaaggagcagggcctgctgcttccctggcgctgctcccaaagatttctgactcatctgccagctctgtcctgcatgcctggcgagctggggcccagggcagcatgaaggagagccctgcgttctgtgcttcttaccagaggtttgcaagcctcagacaaataaatgtggtgtttacaatgtat

SEQ ID NO: 186970 - DNA, 1891 bp, Homo sapiens
  Payload ID: 16814
  Gene Symbol: STOML1
  Gene Name: stomatin (EPB72)-like 1
  Uniprot ID: Q9UBI4
  ENST ID: ENST00000316911
  CDS Start-End: 126-1172
gcgccgccgcgggtggccgcgcgggtgaagccggaagcagcagccaggagggcggggccgcgtagggcccactggccagggagggcgccgcgcggaggcgcggggcgtgtctcctgtcaaaagccatgctcggcaggtctgggtaccgggcgctgcccctgggtgattttgaccgcttccagcagtcgagcttcggctttctgggctcgcagaagggctgcttgtccccggagcggggcggcgtggggacaggggccgatgtaccccagagctggccctcctgcctctgtcatggcctcatcagtttcctggggttcttgctgctgttggtcaccttccccatttctggctggtttgccctgaagctggcctctaaggacggggctgtgctgtccgtgggagccgatgtccagtttcgcatctgggacccggtgctgtcggtgatgactgtgaaagacctgaacacagccacacgcatgacagcccagaacgccatgaccaaggccctgctcaagaggccgctgcgggagatccagatggagaagctcaagatcagcgaccagcttctgctggagatcaacgatgtgaccagggcctgggggctggaggtagaccgcgtggagctggcagtggaggccgtgctccagccgccccaggacagcccagctgggcccaacctggacagcaccctccagcagctggccctgcacttcctgggaggaagcatgaactcaatggcaggaggtgccccgtccccggggccagcagacaccgtggagatggtgagtgaagttgagccacctgcccctcaagttggtgccaggtccagtccgaagcagcctctggcggaggggctactgactgctctacagcccttcctgtctgaggccctggtcagccaagtcggggcctgctaccagttcaatgtcgtcctgcccagcggcacccaaagcgcctacttcctggacctcactacaggacgaggaagagtgggacacggggtgcctgatggcatccctgatgtggtggtggagatggccgaggcagacctgcgggccctgctatgcagagagctgcggcccctgggggcctacatgagtggacggctgaaggtgaagggcgacctggctatggccatgaagctggaggctgtcctcagggccttgaagtagcagccttggctgactttccagagcccagtcccaagcctggcaccaagcctgaggggcctcttggaggaggaggtgttcatctgcaccacagagagttgaggccctaacaaatttcaggcccagccaagagcccatgaatggaggctgcaggaggctgagtccggctgccatgcacgtctcccctacagtggttctctggacaaggctttgtccatcccggtccccagctgagtgcccagcgctgagctgggtgcacggtgtgattccaggaggagagccaggcctgccctgccctgctggcttcctgactggagagacaggacccacagaaacagcctgacagcagctggtttggtccttgtgtgagggaccaagcatgtggcccaggctctaagctctgcggggattggagagggatggggagggaagggaaggcagctccaagaagaggtccctgtggcgaagttacctggggatcctggctggcccaccttcctggctgcagtccaggcccgtgctggcgggattgggcatgggaaggagcagggcctgctgcttccctggcgctgctcccaaagatttctgactcatctgccagctctgtcctgcatgcctggcgagctggggcccagggcagcatgaaggagagccctgcgttctgtgcttcttaccagaggtttgcaagcctcagacaaataaatgtggtgtttacaatgtat

SEQ ID NO: 186971 - DNA, 984 bp, Homo sapiens
  Payload ID: 16814
  Gene Symbol: STOML1
  Gene Name: stomatin (EPB72)-like 1
  Uniprot ID: Q9UBI4
  ENST ID: ENST00000359750
  CDS Start-End: 1-984
atgctcggcaggtctgggtaccgggcgctgcccctgggtgattttgaccgcttccagcagtcgagcttcggctttctgggctcgcagaagggctgcttgtccccggagcggggcggcgtggggacaggggccgatgtaccccagagctggccctcctgcctctgtcatggcctcatcagtttcctggggttcttgctgctgttggtcaccttccccatttctggctggtttgccctgaagattgtgcccacctacgagcggatgattgtgttccgcctgggccggatccgcaccccccagggacctggcatggttctgctcttgcccttcattgactcctttcagagggtggatctgaggacacgagccttcaacgtccctccctgcaagctggcctctaaggacggggctgtgctgtccgtgggagccgatgtccagtttcgcatctgggacccggtgctgtcggtgatgactgtgaaagacctgaacacagccacacgcatgacagcccagaacgccatgaccaaggccctgctcaagaggccgctgcgggagatccagatggagaagctcaagatcagcgaccagcttctgctggagatcaacgatgtgaccagggcctgggggctggaggtagaccgcgtggagctggcagtggaggccgtgctccagccgccccaggacagcccagctgggcccaacctggacagcaccctccagcagctggccctgcacttcctgggaggaagcatgaactcaatggcaggaggtgccccgtccccggggccaggacgaggaagagtgggacacggggtgcctgatggcatccctgatgtggtggtggagatggccgaggcagacctgcgggccctgctatgcagagagctgcggcccctgggggcctacatgagtggacggctgaaggtgaagggcgacctggctatggccatgaagctggaggctgtcctcagggccttgaagtag

SEQ ID NO: 186972 - DNA, 6336 bp, Homo sapiens
  Payload ID: 16814
  Gene Symbol: STOML1
  Gene Name: stomatin (EPB72)-like 1
  Uniprot ID: Q9UBI4
  ENST ID: ENST00000541638
  CDS Start-End: 126-1322
gcgccgccgcgggtggccgcgcgggtgaagccggaagcagcagccaggagggcggggccgcgtagggcccactggccagggagggcgccgcgcggaggcgcggggcgtgtctcctgtcaaaagccatgctcggcaggtctgggtaccgggcgctgcccctgggtgattttgaccgcttccagcagtcgagcttcggctttctgggctcgcagaagggctgcttgtccccggagcggggcggcgtggggacaggggccgatgtaccccagagctggccctcctgcctctgtcatggcctcatcagtttcctggggttcttgctgctgttggtcaccttccccatttctggctggtttgccctgaagattgtgcccacctacgagcggatgattgtgttccgcctgggccggatccgcaccccccagggacctggcatggttctgctcttgcccttcattgactcctttcagagggtggatctgaggacacgagccttcaacgtccctccctgcaagctggcctctaaggacggggctgtgctgtccgtgggagccgatgtccagtttcgcatctgggacccggtgctgtcggtgatgactgtgaaagacctgaacacagccacacgcatgacagcccagaacgccatgaccaaggccctgctcaagaggccgctgcgggagatccagatggagaagctcaagatcagcgaccagcttctgctggagatcaacgatgtgaccagggcctgggggctggaggtagaccgcgtggagctggcagtggaggccgtgctccagccgccccaggacagcccagctgggcccaacctggacagcaccctccagcagctggccctgcacttcctgggaggaagcatgaactcaatggcaggaggtgccccgtccccggggccagcagacaccgtggagatggtgagtgaagttgagccacctgcccctcaagttggtgccaggtccagtccgaagcagcctctggcggaggggctactgactgctctacagcccttcctgtctgaggccctggtcagccaagtcggggcctgctaccagttcaatgtcgtcctgcccagcggcacccaaagcgcctacttcctggacctcactacaggacgaggaagagtgggacacggggtgcctgatggcatccctgatgtggtggtggagatggccgaggcagacctgcgggccctgctatgcagagagctgcggcccctgggggcctacatgagtggacggctgaaggtgaagggcgacctggctatggccatgaagctggaggctgtcctcagggccttgaagtagcagccttggctgactttccagagcccagtcccaagcctggcaccaagcctgaggggcctcttggaggaggaggtgttcatctgcaccacagagagttgaggccctaacaaatttcaggcccagccaagagcccatgaatggaggctgcaggaggctgagtccggctgccatgcacgtctcccctacagtggttctctggacaaggctttgtccatcccggtccccagctgagtgcccagcgctgagctgggtgcacggtgtgattccaggaggagagccaggcctgccctgccctgctggcttcctgactggagagacaggacccacagaaacagcctgacagcagctggtttggtccttgtgtgagggaccaagcatgtggcccaggctctaagctctgcggggattggagagggatggggagggaagggaaggcagctccaagaagaggtccctgtggcgaagttacctggggatcctggctggcccaccttcctggctgcagtccaggcccgtgctggcgggattgggcatgggaaggagcagggcctgctgcttccctggcgctgctcccaaagatttctgactcatctgccagctctgtcctgcatgcctggcgagctggggcccagggcagcatgaaggagagccctgcgttctgtgcttcttaccagaggtttgcaagcctcagacaaataaatgtggtgtttacaatgtataaaagagaagaagccaagcggggctcctgggggcatggggtgggctaggagggtccacaaggtccatgctgccagcccaggcagggattgacatcctggtggctgacacagacagaccctcacaatatttgaagctccttctcctgagtgtctcaaagcccctggaagcaagggtggggctgggtggggagttctgttcctctttgtagtgggatacaggttcaccaggaaaggaaggcatgagtgtgccagagtgtcctgcaaacactgaggggcaggtggggtggtcatatcccattcaagagaggagttggggccaccgtcagcttcccctcctggtacactctgtcactgcttctccgctcgctgacgggaaggaaacagtcattgaggtctggccccaggcccagcccagccctgctttctgctccagtactctcgcccaaaccccaggggccccagagaagggggcctctgacttcttgagtcctaagaaaggaatcttactccttggagagacttctgggaaaaacaaaaccacaaaaatcaaagcctccccttaagaacagcccccagcctgtcctgtggcaccgcaacttccctctcccccaaggggtctctgcccttcctgggtgcctggctctgtcttgtttgctgtctgtccctgcctttgccagacactgccttgtcccgcctcctggaggtcctccacattgcctgaggcacctccctaaagcccagcacagacccctctgtcactgccatggccattgaggttcaggtttccagggccccttcctagagtcccaggctgctgcacctgctgttgcccctttgcctacttggaggcctctcatgggccctcccagggctttctagctgaggctgtctgttccaaagcctgccctccaatccccgcagccacactgtggccaccctttgaggcccagtgagacttgtcctctgtgcccttgcctggctctctgcacccattccacattgtgtgtttctgctccttgcatatatggctgccctccctgctggactgggagcttcctgcatcagcattcacctgtggattccttccattgctattacacagtatatgaagggctgcccaggaaaccccaggcatcttcaccatgaaagctggcacggccccttggctggggtagggctggagggtagggaagacaggaaaaatgagatcacaacttaggggaaacccaaactcttctttgtgagcatgggaagatcaacataacgtttaggggaaaccgaaacttttctggatgtctgtgtaggtggagagtaaggcctgcccctgccatgaatccccaccctgtggaggggagctcgatccttggccagcactccaggactacagaggactgagcagaccctgcagtccacaggggaggaaggacaagggccacctaaagggtcggtgtgaagagggaggaggagggtgtgtgtcaatcagagaaggctttcctgaggaggtgatgtcctccacatcccagctaccaagtaggtggacaataagaagagatggggaaaatcattcagcagaggagaagtccctgcaagggcacagctggaagaggcagtcaggcaactgggcttcggggaactagaacctgaagtaccagacaggttgtgtgcgggcatttgaggggcagggtatagaaatagtaaccattactgtgtgccaaatatgtccttataccggactagacacttcttattatatttttcttcaagataacctggtgaataatgataatagtttaagtatcctagttaatatattaatatataatgtgttattttgatgttattgaaaagtattttatttttttttgaaacaagagtcttactctgttgcccatgttagagtacagtacaatctcagctcactgcaacctctacctcccggattcaagtgattctcctgcctcagacacctgagtagccaggattataggcgcataccaccacacctggttaatttttgtatttttagtagagatgggatttcaccatgttgaccaggctggtctcgaactcctgacctcaagtgatctgcctgcctaggcctcccaaagtgctgggattataggtgtgagccaccgcacctggccttatttttaagcatttaaaaaaaattttttagaccgtcttgctctatcacccaggctggagtgcagtggcatgatcatagctcactgtagccttgaactctggggctcaaacgatcctcttgcctcagcttcctgagtagctgggaccacaggttgtgccaccacaaccggctaatttttaaaatctcttttgtagagataaggatgtctccccatgttgctcaggctggtcttgaactcctgggctcgcaggatcctcccaccacagcctcccaaagtgctgggattacaggtgtgagccactgtacccagccaatatttaaattttggttggctaaacatttaaaaagataggaaagcatattatgaaaattctccctccacacatatttcccatgccttcccccatcccctgcgattagtttcttggtaattcttcctgaaggttttgttttttaaaaaaaaatatatgcaagaaaatccaaatatgtatcttctgggtttttgttgttcctgtttttatacaaatggcaacatagaaacacaatgttgcctttttcacttaacattacccactgaggatctttccatgttaccacagacagcctttccctgtgctttcttgtacttacataggattccacagtatggatgtatcataaattattcaacctgtcgtggaccgatagacattttgattatttcttgtgttttgctattttaaatacttttgcaatgaataacctttaacatgtgctatttgtggtagagtttatctataagataaaatcctagaagtggaattgctaaatcaaagcatttataatttagtaaatattgccagaataccttctctggggattataccaatttacactcccattgtcagtggtgtttttttctcatagtcatgtcaatacactgtgttattaaacttttgggtcttttgacattctggaaagtgaaaatttgtatctcagtgtaatttttttgtttattgttcaagttatttttttgttttttgtttgtttgttttgagacagggtctcactctgtctcccaggctggagtgcagtgcagtgattgtggctcactgcagcctcaacctcccaggcttaaaggatcaccatgcctggctttttttttttttttttttttgtagagacagggccttctcaagctggtctctaactcctggcctcaagtgatcctcccacctggccctggcccgctaactgctaggattacaggcatgagccatctagcccagcctgtttattgtccaattgtttattgctttgtaagtcttggatttctagctccagcaaagaacagggtttggtttggtttggtttctcttcccctagcatttacatattttttaaaggtgtaatttacatacaacaaacacccttttaaaatgtattatttggctggcttgcgcctctaatcccagcactttgggaggccgaggcaggtggatcacctgaggtcaggagtttgagaccagcctgaccgatatggtgaaaccccatctctactaaaaatacaaaatttagccaggcatggtggtacacggctgtagtcccagctactcgggaggctgagacaggagaattgcttgaacccaggaggtggaagttgcagtgagttgagatcatgccactgcactttagcctgggcaacagagtgagactccatctcaaaattaaataaataaagataaaataaaaagtgtcatctgaggtgctttgacaaatgtgaacacctgagtaaccaccaccccctacaatcaaatacaaaacattcccatccactcacaaagttctccacgtcacttcccgtcagtgcttgccacctccagctttgagcagccactgacctttccataaccgctgatcacatttcacttttctagcatttcatatgaatgaaatgagtgcacagtactcttctgtgtctagctttttccccctcactgtaatggttttgagagtaatacatgttattctgtgtatctgtagtttgttgtattgccaacacattccattgtctagatagaggcacaatgtattcattcatccattgatgaacatttgagtagttttcaggtttggttattaaataaagctcctccagacatctgtgtac

SEQ ID NO: 186973 - DNA, 539 bp, Homo sapiens
  Payload ID: 16814
  Gene Symbol: STOML1
  Gene Name: stomatin (EPB72)-like 1
  ENST ID: ENST00000562453
  CDS Start-End: 265-539
aaaagccatgctcggcaggtctgggtaccgggcgctgcccctgggtgattttgaccgcttccagcagtcgagcttcggctttctgggctcgcagaagggctgcttgtccccggagcggggcggcgtggggacaggggccggctaaggcatcatcttcataaggactcctggaaagcacacttctggggctgatggtataggaggaatgtgttttgccagcagtattcagtgcatgtttacagatgcccaggtgctcctggctccatgccagatgtaccccagagctggccctcctgcctctgtcatggcctcatcagtttcctggggttcttgctgctgttggtcaccttccccatttctggctggtttgccctgaagattgtgcccacctacgagcggatgattgtgttccgcctgggccggatccgcaccccccagggacctggcatggttctgctcttgcccttcattgactcctttcagagggtggatctgaggacacgagccttcaacgtccctccctgcaagctggcctctaa

SEQ ID NO: 186974 - DNA, 614 bp, Homo sapiens
  Payload ID: 16814
  Gene Symbol: STOML1
  Gene Name: stomatin (EPB72)-like 1
  ENST ID: ENST00000565240
  CDS Start-End: 202-614
atttgtcctcggctcttatcagccctttaggcctgggaagacgtttcaggtttctatttcgcatagaagaaaccgaggtctaggcagaggaggccaccagcaccctaaaggcacctgctgcagggaaatggaagaattttcgccctagggggcacctctagaagcccgggaactaggcatctcctggatgtgcaggccaaaatgacagatgtaccccagagctggccctcctgcctctgtcatggcctcatcagtttcctggggttcttgctgctgttggtcaccttccccatttctggctggtttgccctgaagattgtgcccacctacgagcggatgattgtgttccgcctgggccggatccgcaccccccagggacctggcatggttctgctcttgcccttcattgactcctttcagagggtggatctgaggacacgagccttcaacgtccctccctgcaagctggcctctaaggacggggctgtgctgtccgtgggagccgatgtccagtttcgcatctgggacccggtgctgtcggtgatgactgtgaaagacctgaacacagccacacgcatgacagcccagaacgccatgaccaaggccctgctcaa

SEQ ID NO: 186975 - DNA, 1849 bp, Homo sapiens
  Payload ID: 16814
  Gene Symbol: STOML1
  Gene Name: stomatin (EPB72)-like 1
  Uniprot ID: Q9UBI4
  ENST ID: ENST00000564777
  CDS Start-End: 75-1118
gcggggccgcgtagggcccactggccagggagggcgccgcgcggaggcgcggggcgtgtctcctgtcaaaagccatgctcggcaggtctgggtaccgggcgctgcccctgggtgattttgaccgcttccagcagtcgagcttcggctttctgggctcgcagaagggctgcttgtccccggagcggggcggcgtggggacaggggccgatgtaccccagagctggccctcctgcctctgtcatggcctcatcagtttcctggggttcttgctgctgttggtcaccttccccatttctggctggtttgccctgaagctggcctctaaggacggggctgtgctgtccgtgggagccgatgtccagtttcgcatctgggacccggtgctgtcggtgatgactgtgaaagacctgaacacagccacacgcatgacagcccagaacgccatgaccaaggccctgctcaagaggccgctgcgggagatccagatggagaagctcaagatcagcgaccagcttctgctggagatcaacgatgtgaccagggcctgggggctggaggtagaccgcgtggagctggcagtggaggccgtgctccagccgccccaggacagcccagctgggcccaacctggacagcaccctccagcagctggccctgcacttcctgggaggaagcatgaactcaatggcaggaggtgccccgtccccggggccagacaccgtggagatggtgagtgaagttgagccacctgcccctcaagttggtgccaggtccagtccgaagcagcctctggcggaggggctactgactgctctacagcccttcctgtctgaggccctggtcagccaagtcggggcctgctaccagttcaatgtcgtcctgcccagcggcacccaaagcgcctacttcctggacctcactacaggacgaggaagagtgggacacggggtgcctgatggcatccctgatgtggtggtggagatggccgaggcagacctgcgggccctgctatgcagagagctgcggcccctgggggcctacatgagtggacggctgaaggtgaagggcgacctggctatggccatgaagctggaggctgtcctcagggccttgaagtagcagccttggctgactttccagagcccagtcccaagcctggcaccaagcctgaggggcctcttggaggaggaggtgttcatctgcaccacagagagttgaggccctaacaaatttcaggcccagccaagagcccatgaatggaggctgcaggaggctgagtccggctgccatgcacgtctcccctacagtggttctctggacaaggctttgtccatcccggtccccagctgagtgcccagcgctgagctgggtgcacggtgtgattccaggaggagagccaggcctgccctgccctgctggcttcctgactggagagacaggacccacagaaacagcctgacagcagctggtttggtccttgtgtgagggaccaagcatgtggcccaggctctaagctctgcggggattggagagggatggggagggaagggaaggcagctccaagaagaggtccctgtggcgaagttacctggggatcctggctggcccaccttcctggctgcagtccaggcccgtgctggcgggattgggcatgggaaggagcagggcctgctgcttccctggcgctgctcccaaagatttctgactcatctgccagctctgtcctgcatgcctggcgagctggggcccagggcagcatgaaggagagccctgcgttctgtgcttcttaccagaggtttgcaagcctcagacaaataaatgtggtgtttacaatgtataaaagagaagaa

SEQ ID NO: 186976 - DNA, 1833 bp, Homo sapiens
  Payload ID: 16814
  Gene Symbol: STOML1
  Gene Name: stomatin (EPB72)-like 1
  ENST ID: ENST00000561656
  CDS Start-End: 201-1133
tgggttttaaagacacgcccagagcggggaggaggtagaggcggagagctgcagacctaccgctgacttacgatgtaccccagagctggccctcctgcctctgtcatggcctcatcagtttcctggggttcttgctgctgttggtcaccttccccatttctggctggtttgccctgaagattgtgcccacctacgagcggatgattgtgttccgcctgggccggatccgcaccccccagggacctggcatggttctgctcttgcccttcattgactcctttcagagggtggatctgaggacacgagccttcaacgtccctccctgcaagctggcctctaaggacggggctgtgctgtccgtgggagccgatgtccagtttcgcatctgggacccggtgctgtcggtgatgactgtgaaagacctgaacacagccacacgcatgacagcccagaacgccatgaccaaggccctgctcaagaggccgctgcgggagatccagatggagaagctcaagatcagcgaccagcttctgctggagatcaacgatgtgaccagggcctgggggctggaggtagaccgcgtggagctggcagtggaggccgtgctccagccgccccaggacagcccagctgggcccaacctggacagcaccctccagcagctggccctgcacttcctgggaggaagcatgaactcaatggcaggaggtgccccgtccccggggccagacaccgtggagatggtgagtgaagttgagccacctgcccctcaagttggtgccaggtccagtccgaagcagcctctggcggaggggctactgactgctctacagcccttcctgtctgaggccctggtcagccaagtcggggcctgctaccagttcaatgtcgtcctgcccagcggcacccaaagcgcctacttcctggacctcactacaggacgaggaagagtgggacacggggtgcctgatggcatccctgatgtggtggtggagatggccgaggcagacctgcgggccctgctatgcagagagctgcggcccctgggggcctacatgagtggacggctgaaggtgaagggcgacctggctatggccatgaagctggaggctgtcctcagggccttgaagtagcagccttggctgactttccagagcccagtcccaagcctggcaccaagcctgaggggcctcttggaggaggaggtgttcatctgcaccacagagagttgaggccctaacaaatttcaggcccagccaagagcccatgaatggaggctgcaggaggctgagtccggctgccatgcacgtctcccctacagtggttctctggacaaggctttgtccatcccggtccccagctgagtgcccagcgctgagctgggtgcacggtgtgattccaggaggagagccaggcctgccctgccctgctggcttcctgactggagagacaggacccacagaaacagcctgacagcagctggtttggtccttgtgtgagggaccaagcatgtggcccaggctctaagctctgcggggattggagagggatggggagggaagggaaggcagctccaagaagaggtccctgtggcgaagttacctggggatcctggctggcccaccttcctggctgcagtccaggcccgtgctggcgggattgggcatgggaaggagcagggcctgctgcttccctggcgctgctcccaaagatttctgactcatctgccagctctgtcctgcatgcctggcgagctggggcccagggcagcatgaaggagagccctgcgttctgtgcttcttaccagaggtttgcaagcctcagacaaataaa

SEQ ID NO: 186977 - DNA, 512 bp, Homo sapiens
  Payload ID: 16814
  Gene Symbol: STOML1
  Gene Name: stomatin (EPB72)-like 1
  ENST ID: ENST00000566081
  CDS Start-End: 235-512
ccggaagcagcagccaggagggcggggccgcgtagggcccactggccagggagggcgccgcgcggaggcgcggggcgtgtctcctgtcaaaagccatgctcggcagatgtaccccagagctggccctcctgcctctgtcatggcctcatcagtttcctggggttcttgctgctgttggtcaccttccccatttctggctggtttgccctgaagattgtgcccacctacgagcggatgattgtgttccgcctgggccggatccgcaccccccagggacctggcatggttctgctcttgcccttcattgactcctttcagagggtggatctgaggacacgagccttcaacgtccctccctgcaagctggcctctaaggacggggctgtgctgtccgtgggagccgatgtccagtttcgcatctgggacccggtgctgtcggtgatgactgtgaaagacctgaacacagccacacgcatgacagcccagaacgccatgaccaaggccctgctcaa

SEQ ID NO: 186978 - DNA, 1278 bp, Homo sapiens
  Payload ID: 16815
  Gene Symbol: STOML2
  Gene Name: stomatin (EPB72)-like 2
  Uniprot ID: Q9UJZ1
  ENST ID: ENST00000356493
  CDS Start-End: 64-1134
ggcttctgggagcgaccgctccgctcgtctcgttggttccggaggtcgctgcggcggtgggaaatgctggcgcgcgcggcgcggggcactggggcccttttgctgaggggctctctactggcttctggccgcgctccgcgccgcgcctcctctggattgccccgaaacaccgtggtactgttcgtgccgcagcaggaggcctgggtggtggagcgaatgggccgattccaccggatcctggagcctggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccgggaacgggagtccctgaatgccagcattgtggatgccatcaaccaagctgctgactgctggggtatccgctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacataatggagatgcagcagcttcactgactgtggccgagcagtatgtcagcgcgttctccaaactggccaaggactccaacactatcctactgccctccaaccctggcgatgtcaccagcatggtggctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctgggaacaaggaagcagattttcctgattctggctctagcttccctgccaagattttggtttttatttttttatttgaactttagtcgtgtaataaactcaccagtggcaaaccagaaa

SEQ ID NO: 186979 - DNA, 1296 bp, Homo sapiens
  Payload ID: 16815
  Gene Symbol: STOML2
  Gene Name: stomatin (EPB72)-like 2
  Uniprot ID: Q9UJZ1
  ENST ID: ENST00000452248
  CDS Start-End: 102-1037
tccgggggagcggaactgcaagaggaaaggctcgggtaggcttctgggagcgaccgctccgctcgtctcgttggttccggaggtcgctgcggcggtgggaaatgctggcgcgcgcggcgcggggcactggggcccttttgctgaggggctctctactggcttctggccgcgctccgcgccgcgcctcctctggattgccccgaaacaccgtggtactgttcgtgccgcagcaggaggcctgggtggtggagcgaatgggccgattccaccggatcctggagcctggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccgggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacataatggagatgcagcagcttcactgactgtggccgagcagtatgtcagcgcgttctccaaactggccaaggactccaacactatcctactgccctccaaccctggcgatgtcaccagcatggtggctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctgggaacaaggaagcagattttcctgattctggctctagcttccctgccaagattttggtttttatttttttatttgaactttagtcgtgtaataaactcaccagtggcaaaccagaaactgtcctctttgattggggaatgaagttgggaaagtcactagcattttccttggatccagtcctgtcagcatgatgcctccatgaataagagtgaacttcttgtaaagtgaaact

SEQ ID NO: 186980 - DNA, 904 bp, Homo sapiens
  Payload ID: 16815
  Gene Symbol: STOML2
  Gene Name: stomatin (EPB72)-like 2
  ENST ID: ENST00000488050
  CDS Start-End: 57-362
gctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacatgtgagaggcccctgggtgggaatggggacaggaattgacagtggaaggggttctcttatctacgcttgaggagagttccgcctctgtgggctctgttgagccagattacatggtcctttttattgtgaactgctttcttcattccccatcccccccttcttctccgtatcggtgatctctgatttttatccccctgtgatcacagaatggagatgcagcagcttcactgactgtggccgagcagtatgtcagcgcgttctccaaactggccaaggactccaacactatcctactgccctccaaccctggcgatgtcaccagcatggtggctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctgggaacaaggaagcagattttcctgattctggctctagcttccctgccaagattttggtttttatttttttatttgaactttagtcgtgtaataaactcaccagtggcaaacc

SEQ ID NO: 186981 - DNA, 1293 bp, Homo sapiens
  Payload ID: 16815
  Gene Symbol: STOML2
  Gene Name: stomatin (EPB72)-like 2
  ENST ID: ENST00000619795
  CDS Start-End: 102-1034
tccgggggagcggaactgcaagaggaaaggctcgggtaggcttctgggagcgaccgctccgctcgtctcgttggttccggaggtcgctgcggcggtgggaaatgctggcgcgcgcggcgcggggcactggggcccttttgctgaggggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccgggaacgggagtccctgaatgccagcattgtggatgccatcaaccaagctgctgactgctggggtatccgctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacataatggagatgcagcagcttcactgactgtggccgagcagtatgtcagcgcgttctccaaactggccaaggactccaacactatcctactgccctccaaccctggcgatgtcaccagcatggtggctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctgggaacaaggaagcagattttcctgattctggctctagcttccctgccaagattttggtttttatttttttatttgaactttagtcgtgtaataaactcaccagtggcaaaccagaaactgtcctctttgattggggaatgaagttgggaaagtcactagcattttccttggatccagtcctgtcagcatgatgcctccatgaataagagtgaacttcttgtaaagtgaaact

SEQ ID NO: 186982 - DNA, 2121 bp, Homo sapiens
  Payload ID: 16816
  Gene Symbol: STOML3
  Gene Name: stomatin (EPB72)-like 3
  Uniprot ID: Q8TAV4
  ENST ID: ENST00000379631
  CDS Start-End: 346-1221
tatacaaggtgcatagaagtgttttatgaaatataaatgctatagaaaattacacagcaatattttacaggaagcaataccaccagatggtcatattctttcaagttttttctgtgaacaaaggcagtctgaactcataaaagaaatctttttgtttatgttatcaggcttccctcaccagggtaactaccccttagggagttcactaaagagaaggaatgtctttcactctctcatactttctcctctcccctctcccaagcacatctgagttgctgcctgttcttcacacttagctccaaacccatgaaaaattgccaagtataaaagcttctcaagaatgagatggattctagggtgtcttcacctgagaagcaagataaagagaatttcgtgggtgtcaacaataaacggcttggtgtatgtggctggatcctgttttccctctctttcctgttggtgatcattaccttccccatctccatatggatgtgcttgaagatcattaaggagtatgaacgtgctgttgtattccgtctgggacgcatccaagctgacaaagccaaggggccaggtttgatcctggtcctgccatgcatagatgtgtttgtcaaagttgacctccgaacagttacttgcaacattcctccacaagagatcctcaccagagactccgtaactactcaggtagatggagttgtctattacagaatctatagtgctgtctcagcagtggctaatgtcaacgatgtccatcaagcaacatttctgctggctcaaaccactctgagaaatgtcttagggacacagaccttgtcccagatcttagctggacgagaagagatcgcccatagcatccagactttacttgatgatgccaccgaactgtgggggatccgggtggcccgagtggaaatcaaagatgttcggattcccgtgcagttgcagagatccatggcagccgaggctgaggccacccgggaagcgagagccaaggtccttgcagctgaaggagaaatgaatgcttccaaatccctgaagtcagcctccatggtgctggctgagtctcccatagctctccagctgcgctacctgcagaccttgagcacggtagccaccgagaagaattctacgattgtgtttcctctgcccatgaatatactagagggcattggtggcgtcagctatgataaccacaagaagcttccaaataaagcctgaggtcctcttgcggtagtcagctattgcatagagagtggtgtctattcctatggagaagccagtagttagaaacggtgagaattccaacactgttcatgtaacagtaactccatagatggaagagcattggcaggaaaaagctctagaggctatacagagaagaaaaaaagagcaaaaatgagacctgtatattacttttatttttaggaccataatcaactttgtaatattcttatataattaattagtggtggtctccgactttatagcaggaactttctggtagtatgagaagaaatcattgggtgactatgactaatgtttcagaattactttttaattgttttaaaaagcactccagataatttatagagtaacataggcctcatatttacactatatgttcgctttataattccgaagttgttatttgctaaatctccaatggttgcaatcaaaccccacaatgctgaaaacagagattgattttgatgttaagaacaaaagaagtatggaaacttccaggctcaaacatgtcccccgtgccacaaggcaaactgcgatgagctcacagtccaggtctcttgctgtgtgtcctgcagggagtggccaactctccaccttccagcaccattatcagagggtgggaaaaggcacatgaaagtggccagctcctgtcaatttatttgcttacaagggagaatgcttggaaaggttgcattggttgaaaccactgaggagcatcaccctggggatttcatgttttcactctgttcttagtcccaggagccacaggtaatcgagaatgtttgtgaactctatccacatcccctcccccacctgccaaataacctgttcaaaacaaagaaggcatagaatataaatgaatttcaaaagtta

SEQ ID NO: 186983 - DNA, 1997 bp, Homo sapiens
  Payload ID: 16816
  Gene Symbol: STOML3
  Gene Name: stomatin (EPB72)-like 3
  Uniprot ID: Q8TAV4
  ENST ID: ENST00000423210
  CDS Start-End: 250-1098
aaagagaaggaatgtctttcactctctcatactttctcctctcccctctcccaagcacatctgagttgctgcctgttcttcacacttagctccaaacccatgaaaaattgccaagtataaaagcttctcaagaatgagatggattctagggtgtcttcacctgagaagcaagataaagagaatttcgtggcacgtctattacctaatggagctgagcctcatgtgcacgtgtaatgatgcaagggcttgatgaactccagaggcgagcttgtaggtgtcaacaataaacggcttggtgtatgtggctggatcctgttttccctctctttcctgttggtgatcattaccttccccatctccatatggatgtgcttgaagatcattaaggagtatgaacgtgctgttgtattccgtctgggacgcatccaagctgacaaagccaaggggccaggtttgatcctggtcctgccatgcatagatgtgtttgtcaaagttgacctccgaacagttacttgcaacattcctccacaagagatcctcaccagagactccgtaactactcaggtagatggagttgtctattacagaatctatagtgctgtctcagcagtggctaatgtcaacgatgtccatcaagcaacatttctgctggctcaaaccactctgagaaatgtcttagggacacagaccttgtcccagatcttagctggacgagaagagatcgcccatagcatccagactttacttgatgatgccaccgaactgtgggggatccgggtggcccgagtggaaatcaaagatgttcggattcccgtgcagttgcagagatccatggcagccgaggctgaggccacccgggaagcgagagccaaggtccttgcagctgaaggagaaatgaatgcttccaaatccctgaagtcagcctccatggtgctggctgagtctcccatagctctccagctgcgctacctgcagaccttgagcacggtagccaccgagaagaattctacgattgtgtttcctctgcccatgaatatactagagggcattggtggcgtcagctatgataaccacaagaagcttccaaataaagcctgaggtcctcttgcggtagtcagctattgcatagagagtggtgtctattcctatggagaagccagtagttagaaacggtgagaattccaacactgttcatgtaacagtaactccatagatggaagagcattggcaggaaaaagctctagaggctatacagagaagaaaaaaagagcaaaaatgagacctgtatattacttttatttttaggaccataatcaactttgtaatattcttatataattaattagtggtggtctccgactttatagcaggaactttctggtagtatgagaagaaatcattgggtgactatgactaatgtttcagaattactttttaattgttttaaaaagcactccagataatttatagagtaacataggcctcatatttacactatatgttcgctttataattccgaagttgttatttgctaaatctccaatggttgcaatcaaaccccacaatgctgaaaacagagattgattttgatgttaagaacaaaagaagtatggaaacttccaggctcaaacatgtcccccgtgccacaaggcaaactgcgatgagctcacagtccaggtctcttgctgtgtgtcctgcagggagtggccaactctccaccttccagcaccattatcagagggtgggaaaaggcacatgaaagtggccagctcctgtcaatttatttgcttacaagggagaatgcttggaaaggttgcattggttgaaaccactgaggagcatcaccctggggatttcatgttttcactctgttcttagtcccaggagccacaggtaatcgagaatgtttgtgaactctatccacatcccctcccccacctgccaaataacctgttcaaaacaaagaaggcatagaatataaatgaatttcaaaagtt

SEQ ID NO: 186984 - DNA, 3534 bp, Homo sapiens
  Payload ID: 16817
  Gene Symbol: STON1-GTF2A1L
  Gene Name: STON1-GTF2A1L readthrough
  ENST ID: ENST00000394751
  CDS Start-End: 28-3435
tgacaagaccacaatctgatcccaaagatgtgctccacaaatccaggcaaatgggtcacctttgatgatgatcctgctgttcaatcttctcaaaagtcaaagaattttcctctggagaatcaaggtgtctgtagaccaaatggactgaagctgaaccttcctggcctcagggaatttcccagtggatcttcctccaccagcagcactcctctctcctcccccattgtagatttttatttcagtccaggacctccaagtaactctcctctttctacacctaccaaagacttcccaggttttcctggcatccccaaagcagggactcatgtgctttatcctattccagaatcatcttcagacagcccactcgcaatatcaggaggagaatcttccttactgcctaccagaccaacatgtttatcccatgccttgttacccagtgaccactcatgtacacatccaactcccaaagtaggtcttccagatgaagttaatcctcaacaggctgaaagcctaggattccaaagtgatgatctcccccagtttcagtattttcgagaggactgtgctttttcaagtccattttggaaagatgaaggcagtgattcccatttcacccttgacccaccaggaagcaaaaagatgttctcatcaagaaacaaggagatgcctattgaccaaaaaagcctaaataagtgttcactcaactatatctgtgagaagcttgaacatctccagtcagctgagaaccaagactcacttagaagtttgtctatgcactgtctatgtgctgaagaaaatgcctcttcctttgtcccccacacactcttcaggagtcagccaaaatccggatggtctttcatgctgagaattcctgagaagaagaatatgatgtcttcccggcaatggggaccaatttttctgaaagttttgcctggaggaattttgcagatgtattatgaacagggattagaaaaaccatttaaagagatacagcttgatccatattgtaggctttctgaacccaaggttgagaacttcagtgtagcaggaaaaatccacactgtgaagattgaacatgtgtcttacacagaaaaaaggaaataccattctaagacagaagtagttcatgaacctgacatagagcagatgctgaagttggggtccacatcgtaccatgacttccttgactttctgactactgtggaggaggagctgatgaagttgccagctgtttcaaaaccaaaaaagaactacgaggagcaagaaatttccttggaaattgtggacaacttttggggtaaagtcacaaaagaaggaaaatttgttgaaagtgctgtgataactcaaatttattgcctctgctttgtgaatgggaacctggaatgctttttaaccttgaatgaccttgagttgccgaagcgagatgaatcctattatgagaaggactcagaaaaaaaggggattgatattcttgactaccattttcataagtgtgtgaatgtacaagaatttgagcaatcaagaatcattaagtttgtacctctggatgcctgccggtttgagctgatgcgtttcaagactttgtataatggggataatcttcccttttccttgaagtctgtagtggttgtccagggagcatacgtggaacttcaggcttttgtcaacatggcctcattggcgcagaggtcatcctatgctggttccttaaggtcctgtgacaatataaggatacactttcctgtcccatcgcagtggatcaaggccctttggaccatgaacctccagaggcagaagtctctgaaagctaaaatgaaccgccgagcatgtctggggagtttacaggaacttgaatctgaacctgtcattcaagtcactgtggggtcagcaaaatatgagagtgcctaccaggcagtggtatggaagatagatcggcttccagacaaaaattcaagtctagatcatccccattgtctgtcatacaaattagagcttggatcagaccaagaaattccctctgattggtatccatttgctactgttcagttttccgtgcctgacacctgtgcctcaaggacagaggtcaggtctctgggagtggagagtgatgtccagccacagaaacatgttcagcagcgagcttgctacaacatccagcctaaactctacagatctgtaattgaagatgtaattgaaggagttcggaatctatttgctgaagaaggtatagaggaacaagttttaaaagacttgaagcagctctgggaaaccaaggttttgcagtctaaagcaacagaagacttcttcagaaatagcatccaatcacctctgtttactcttcagttgccgcacagcttgcaccaaacattgcaatcgtcaacaggtcacctttataaagtcaatgtaccaattatggtgacagagacttctggaagagcaggtattcttcagcatccaattcagcaagtatttcaacagcttggccagccttcagtaatacaaactagtgttccacaattgaatccatggtctcttcaagcaactactgaaaaatcacagagaattgaaaccgtgctacagcaacccgcaattctaccttctgggccagtagataggaaacacttagaaaatgccaccagtgatatacttgtatctcctggaaatgagcataaaatcgtgcctgaagctttgttgtgtcatcaggaaagttctcactatatcagtcttccaggtgttgtattttctccacaggtctctcaaacaaattctaatgtggagtcagtgctcagtggttcagctagcatggctcaaaatctgcatgatgagtccctctccacaagccctcatggggctctccaccagcacgtgactgatattcagcttcatattcttaaaaataggatgtatggatgtgattctgtaaagcaaccaagaaatatagaggaacccagcaacatacctgtatcagagaaggattctaattctcaggtggatttaagcattcgggttactgatgatgatattggtgaaataattcaagtagatggaagcggtgatacatcttccaatgaagaaataggaagtacaagagatgcagatgagaatgaatttctagggaatattgacgggggagatctgaaggtacctgaagaagaagctgacagtatttcaaatgaggattcagccacaaacagtagtgataatgaagaccctcaagtaaacattgtagaagaggaccctttaaattctggagatgatgttagtgaacaggatgtgccagacctgtttgacacggataatgttattgtctgtcagtatgataagattcatcgaagcaagaacaaatggaaattctatttgaaagatggtgttatgtgttttggagggagagactatgtatttgcaaaagccattggtgatgcagagtggtaaaccttgtgagctcagtacatctattttgtgaacatcagttggattatattgcatattgtgaattcatttttattttgaatatagtccagcacagagctg

SEQ ID NO: 186985 - DNA, 3824 bp, Homo sapiens
  Payload ID: 16817
  Gene Symbol: STON1-GTF2A1L
  Gene Name: STON1-GTF2A1L readthrough
  ENST ID: ENST00000394754
  CDS Start-End: 115-3663
ggactttgggactggacagacctggtcacagtctaggttctacatcttactggtcgagcaactttagagtcaacctatttgatttcttgacaagaccacaatctgatcccaaagatgtgctccacaaatccaggcaaatgggtcacctttgatgatgatcctgctgttcaatcttctcaaaagtcaaagaattttcctctggagaatcaaggtgtctgtagaccaaatggactgaagctgaaccttcctggcctcagggaatttcccagtggatcttcctccaccagcagcactcctctctcctcccccattgtagatttttatttcagtccaggacctccaagtaactctcctctttctacacctaccaaagacttcccaggttttcctggcatccccaaagcagggactcatgtgctttatcctattccagaatcatcttcagacagcccactcgcaatatcaggaggagaatcttccttactgcctaccagaccaacatgtttatcccatgccttgttacccagtgaccactcatgtacacatccaactcccaaagtaggtcttccagatgaagttaatcctcaacaggctgaaagcctaggattccaaagtgatgatctcccccagtttcagtattttcgagaggactgtgctttttcaagtccattttggaaagatgaaggcagtgattcccatttcacccttgacccaccaggaagcaaaaagatgttctcatcaagaaacaaggagatgcctattgaccaaaaaagcctaaataagtgttcactcaactatatctgtgagaagcttgaacatctccagtcagctgagaaccaagactcacttagaagtttgtctatgcactgtctatgtgctgaagaaaatgcctcttcctttgtcccccacacactcttcaggagtcagccaaaatccggatggtctttcatgctgagaattcctgagaagaagaatatgatgtcttcccggcaatggggaccaatttttctgaaagttttgcctggaggaattttgcagatgtattatgaacagggattagaaaaaccatttaaagagatacagcttgatccatattgtaggctttctgaacccaaggttgagaacttcagtgtagcaggaaaaatccacactgtgaagattgaacatgtgtcttacacagaaaaaaggaaataccattctaagacagaagtagttcatgaacctgacatagagcagatgctgaagttggggtccacatcgtaccatgacttccttgactttctgactactgtggaggaggagctgatgaagttgccagctgtttcaaaaccaaaaaagaactacgaggagcaagaaatttccttggaaattgtggacaacttttggggtaaagtcacaaaagaaggaaaatttgttgaaagtgctgtgataactcaaatttattgcctctgctttgtgaatgggaacctggaatgctttttaaccttgaatgaccttgagttgccgaagcgagatgaatcctattatgagaaggactcagaaaaaaaggggattgatattcttgactaccattttcataagtgtgtgaatgtacaagaatttgagcaatcaagaatcattaagtttgtacctctggatgcctgccggtttgagctgatgcgtttcaagactttgtataatggggataatcttcccttttccttgaagtctgtagtggttgtccagggagcatacgtggaacttcaggcttttgtcaacatggcctcattggcgcagaggtcatcctatgctggttccttaaggtcctgtgacaatataaggatacactttcctgtcccatcgcagtggatcaaggccctttggaccatgaacctccagaggcagaagtctctgaaagctaaaatgaaccgccgagcatgtctggggagtttacaggaacttgaatctgaacctgtcattcaagtcactgtggggtcagcaaaatatgagagtgcctaccaggcagtggtatggaagatagatcggcttccagacaaaaattcaagtctagatcatccccattgtctgtcatacaaattagagcttggatcagaccaagaaattccctctgattggtatccatttgctactgttcagttttccgtgcctgacacctgtgcctcaaggacagaggtcaggtctctgggagtggagagtgatgtccagccacagaaacatgttcagcagcgagcttgctacaacatccagcctaaactctacagatctgtaattgaagatgtaattgaaggagttcggaatctatttgctgaagaaggtatagaggaacaagttttaaaagacttgaagcagctctgggaaaccaaggttttgcagtctaaagcaacagaagacttcttcagaaatagcatccaatcacctctgtttactcttcagttgccgcacagcttgcaccaaacattgcaatcgtcaacagcatcattagttattcctgctggtagaactcttccaagttttaccacagcagaactgggcacttcaaactccagtgcaaactttacttttcctggttatcccattcatgtaccagcaggtgtgacactacagactgtatctggtcacctttataaagtcaatgtaccaattatggtgacagagacttctggaagagcaggtattcttcagcatccaattcagcaagtatttcaacagcttggccagccttcagtaatacaaactagtgttccacaattgaatccatggtctcttcaagcaactactgaaaaatcacagagaattgaaaccgtgctacagcaacccgcaattctaccttctgggccagtagataggaaacacttagaaaatgccaccagtgatatacttgtatctcctggaaatgagcataaaatcgtgcctgaagctttgttgtgtcatcaggaaagttctcactatatcagtcttccaggtgttgtattttctccacaggtctctcaaacaaattctaatgtggagtcagtgctcagtggttcagctagcatggctcaaaatctgcatgatgagtccctctccacaagccctcatggggctctccaccagcacgtgactgatattcagcttcatattcttaaaaataggatgtatggatgtgattctgtaaagcaaccaagaaatatagaggaacccagcaacatacctgtatcagagaaggattctaattctcaggtggatttaagcattcgggttactgatgatgatattggtgaaataattcaagtagatggaagcggtgatacatcttccaatgaagaaataggaagtacaagagatgcagatgagaatgaatttctagggaatattgacgggggagatctgaaggtacctgaagaagaagctgacagtatttcaaatgaggattcagccacaaacagtagtgataatgaagaccctcaagtaaacattgtagaagaggaccctttaaattctggagatgatgttagtgaacaggatgtgccagacctgtttgacacggataatgttattgtctgtcagtatgataagattcatcgaagcaagaacaaatggaaattctatttgaaagatggtgttatgtgttttggagggagagactatgtatttgcaaaagccattggtgatgcagagtggtaaaccttgtgagctcagtacatctattttgtgaacatcagttggattatattgcatattgtgaattcatttttattttgaatatagtccagcacagagctgttcaaatttttagttcactgtatggaatttaataaaattataattcagatgcagatacaatt

SEQ ID NO: 186986 - DNA, 3821 bp, Homo sapiens
  Payload ID: 16817
  Gene Symbol: STON1-GTF2A1L
  Gene Name: STON1-GTF2A1L readthrough
  ENST ID: ENST00000405008
  CDS Start-End: 112-3660
agaagatgcgctggagggaagagaacggagcgtcggacaccagaaaaactttgggggattcgggagtcaacctatttgatttcttgacaagaccacaatctgatcccaaagatgtgctccacaaatccaggcaaatgggtcacctttgatgatgatcctgctgttcaatcttctcaaaagtcaaagaattttcctctggagaatcaaggtgtctgtagaccaaatggactgaagctgaaccttcctggcctcagggaatttcccagtggatcttcctccaccagcagcactcctctctcctcccccattgtagatttttatttcagtccaggacctccaagtaactctcctctttctacacctaccaaagacttcccaggttttcctggcatccccaaagcagggactcatgtgctttatcctattccagaatcatcttcagacagcccactcgcaatatcaggaggagaatcttccttactgcctaccagaccaacatgtttatcccatgccttgttacccagtgaccactcatgtacacatccaactcccaaagtaggtcttccagatgaagttaatcctcaacaggctgaaagcctaggattccaaagtgatgatctcccccagtttcagtattttcgagaggactgtgctttttcaagtccattttggaaagatgaaggcagtgattcccatttcacccttgacccaccaggaagcaaaaagatgttctcatcaagaaacaaggagatgcctattgaccaaaaaagcctaaataagtgttcactcaactatatctgtgagaagcttgaacatctccagtcagctgagaaccaagactcacttagaagtttgtctatgcactgtctatgtgctgaagaaaatgcctcttcctttgtcccccacacactcttcaggagtcagccaaaatccggatggtctttcatgctgagaattcctgagaagaagaatatgatgtcttcccggcaatggggaccaatttttctgaaagttttgcctggaggaattttgcagatgtattatgaacagggattagaaaaaccatttaaagagatacagcttgatccatattgtaggctttctgaacccaaggttgagaacttcagtgtagcaggaaaaatccacactgtgaagattgaacatgtgtcttacacagaaaaaaggaaataccattctaagacagaagtagttcatgaacctgacatagagcagatgctgaagttggggtccacatcgtaccatgacttccttgactttctgactactgtggaggaggagctgatgaagttgccagctgtttcaaaaccaaaaaagaactacgaggagcaagaaatttccttggaaattgtggacaacttttggggtaaagtcacaaaagaaggaaaatttgttgaaagtgctgtgataactcaaatttattgcctctgctttgtgaatgggaacctggaatgctttttaaccttgaatgaccttgagttgccgaagcgagatgaatcctattatgagaaggactcagaaaaaaaggggattgatattcttgactaccattttcataagtgtgtgaatgtacaagaatttgagcaatcaagaatcattaagtttgtacctctggatgcctgccggtttgagctgatgcgtttcaagactttgtataatggggataatcttcccttttccttgaagtctgtagtggttgtccagggagcatacgtggaacttcaggcttttgtcaacatggcctcattggcgcagaggtcatcctatgctggttccttaaggtcctgtgacaatataaggatacactttcctgtcccatcgcagtggatcaaggccctttggaccatgaacctccagaggcagaagtctctgaaagctaaaatgaaccgccgagcatgtctggggagtttacaggaacttgaatctgaacctgtcattcaagtcactgtggggtcagcaaaatatgagagtgcctaccaggcagtggtatggaagatagatcggcttccagacaaaaattcaagtctagatcatccccattgtctgtcatacaaattagagcttggatcagaccaagaaattccctctgattggtatccatttgctactgttcagttttccgtgcctgacacctgtgcctcaaggacagaggtcaggtctctgggagtggagagtgatgtccagccacagaaacatgttcagcagcgagcttgctacaacatccagcctaaactctacagatctgtaattgaagatgtaattgaaggagttcggaatctatttgctgaagaaggtatagaggaacaagttttaaaagacttgaagcagctctgggaaaccaaggttttgcagtctaaagcaacagaagacttcttcagaaatagcatccaatcacctctgtttactcttcagttgccgcacagcttgcaccaaacattgcaatcgtcaacagcatcattagttattcctgctggtagaactcttccaagttttaccacagcagaactgggcacttcaaactccagtgcaaactttacttttcctggttatcccattcatgtaccagcaggtgtgacactacagactgtatctggtcacctttataaagtcaatgtaccaattatggtgacagagacttctggaagagcaggtattcttcagcatccaattcagcaagtatttcaacagcttggccagccttcagtaatacaaactagtgttccacaattgaatccatggtctcttcaagcaactactgaaaaatcacagagaattgaaaccgtgctacagcaacccgcaattctaccttctgggccagtagataggaaacacttagaaaatgccaccagtgatatacttgtatctcctggaaatgagcataaaatcgtgcctgaagctttgttgtgtcatcaggaaagttctcactatatcagtcttccaggtgttgtattttctccacaggtctctcaaacaaattctaatgtggagtcagtgctcagtggttcagctagcatggctcaaaatctgcatgatgagtccctctccacaagccctcatggggctctccaccagcacgtgactgatattcagcttcatattcttaaaaataggatgtatggatgtgattctgtaaagcaaccaagaaatatagaggaacccagcaacatacctgtatcagagaaggattctaattctcaggtggatttaagcattcgggttactgatgatgatattggtgaaataattcaagtagatggaagcggtgatacatcttccaatgaagaaataggaagtacaagagatgcagatgagaatgaatttctagggaatattgacgggggagatctgaaggtacctgaagaagaagctgacagtatttcaaatgaggattcagccacaaacagtagtgataatgaagaccctcaagtaaacattgtagaagaggaccctttaaattctggagatgatgttagtgaacaggatgtgccagacctgtttgacacggataatgttattgtctgtcagtatgataagattcatcgaagcaagaacaaatggaaattctatttgaaagatggtgttatgtgttttggagggagagactatgtatttgcaaaagccattggtgatgcagagtggtaaaccttgtgagctcagtacatctattttgtgaacatcagttggattatattgcatattgtgaattcatttttattttgaatatagtccagcacagagctgttcaaatttttagttcactgtatggaatttaataaaattataattcagatgcagatacaatt

SEQ ID NO: 186987 - DNA, 3790 bp, Homo sapiens
  Payload ID: 16817
  Gene Symbol: STON1-GTF2A1L
  Gene Name: STON1-GTF2A1L readthrough
  ENST ID: ENST00000402114
  CDS Start-End: 112-3588
agaagatgcgctggagggaagagaacggagcgtcggacaccagaaaaactttgggggattcgggagtcaacctatttgatttcttgacaagaccacaatctgatcccaaagatgtgctccacaaatccaggcaaatgggtcacctttgatgatgatcctgctgttcaatcttctcaaaagtcaaagaattttcctctggagaatcaaggtgtctgtagaccaaatggactgaagctgaaccttcctggcctcagggaatttcccagtggatcttcctccaccagcagcactcctctctcctcccccattgtagatttttatttcagtccaggacctccaagtaactctcctctttctacacctaccaaagacttcccaggttttcctggcatccccaaagcagggactcatgtgctttatcctattccagaatcatcttcagacagcccactcgcaatatcaggaggagaatcttccttactgcctaccagaccaacatgtttatcccatgccttgttacccagtgaccactcatgtacacatccaactcccaaagtaggtcttccagatgaagttaatcctcaacaggctgaaagcctaggattccaaagtgatgatctcccccagtttcagtattttcgagaggactgtgctttttcaagtccattttggaaagatgaaggcagtgattcccatttcacccttgacccaccaggaagcaaaaagatgttctcatcaagaaacaaggagatgcctattgaccaaaaaagcctaaataagtgttcactcaactatatctgtgagaagcttgaacatctccagtcagctgagaaccaagactcacttagaagtttgtctatgcactgtctatgtgctgaagaaaatgcctcttcctttgtcccccacacactcttcaggagtcagccaaaatccggatggtctttcatgctgagaattcctgagaagaagaatatgatgtcttcccggcaatggggaccaatttttctgaaagttttgcctggaggaattttgcagatgtattatgaacagggattagaaaaaccatttaaagagatacagcttgatccatattgtaggctttctgaacccaaggttgagaacttcagtgtagcaggaaaaatccacactgtgaagattgaacatgtgtcttacacagaaaaaaggaaataccattctaagacagaagtagttcatgaacctgacatagagcagatgctgaagttggggtccacatcgtaccatgacttccttgactttctgactactgtggaggaggagctgatgaagttgccagctgtttcaaaaccaaaaaagaactacgaggagcaagaaatttccttggaaattgtggacaacttttggggtaaagtcacaaaagaaggaaaatttgttgaaagtgctgtgataactcaaatttattgcctctgctttgtgaatgggaacctggaatgctttttaaccttgaatgaccttgagttgccgaagcgagatgaatcctattatgagaaggactcagaaaaaaaggggattgatattcttgactaccattttcataagtgtgtgaatgtacaagaatttgagcaatcaagaatcattaagtttgtacctctggatgcctgccggtttgagctgatgcgtttcaagactttgtataatggggataatcttcccttttccttgaagtctgtagtggttgtccagggagcatacgtggaacttcaggcttttgtcaacatggcctcattggcgcagaggtcatcctatgctggttccttaaggtcctgtgacaatataaggatacactttcctgtcccatcgcagtggatcaaggccctttggaccatgaacctccagaggcagaagtctctgaaagctaaaatgaaccgccgagcatgtctggggagtttacaggaacttgaatctgaacctgtcattcaagtcactgtggggtcagcaaaatatgagagtgcctaccaggcagtggtatggaagatagatcggcttccagacaaaaattcaagtctagatcatccccattgtctgtcatacaaattagagcttggatcagaccaagaaattccctctgattggtatccatttgctactgttcagttttccgtgcctgacacctgtgcctcaaggacagaggtcaggtctctgggagtggagagtgatgtccagccacagaaacatgttcagcagcgagcttgctacaacatccagcctaaactctacagatctgtaattgaagatgtaattgaaggagttcggaatctatttgctgaagaaggtatagaggaacaagttttaaaagacttgaagcagctctgggaaaccaaggttttgcagtctaaagcaacagaagacttcttcagaaatagcatccaatcacctctgtttactcttcagttgccgcacagcttgcaccaaacattgcaatcgtcaacagcatcattagttattcctgctggtagaactcttccaagttttaccacagcagaactgggcacttcaaactccagtgcaaactttacttttcctggttatcccattcatgtaccagcaggtgtgacactacagactgtatctggtcacctttataaagtcaatgtaccaattatggtgacagagacttctggaagagcaggtattcttcagcatccaattcagcaagtatttcaacagcttggccagccttcagtaatacaaactagtgttccacaattgaatccatggtctcttcaagcaactactgaaaaatcacagagaattgaaaccgtgctacagcaacccgcaattctaccttctgggccagtagataggaaacacttagaaaatgccaccagtgatatacttgtatctcctggaaatgagcataaaatcgtgcctgaagctttgttgtgtcatcaggaaagttctcactatatcagtcttccaggtgttgtattttctccacaggtctctcaaacaaattctaatgtggagtcagtgctcagtggttcagctagcatggctcaaaatctgcatgatgagtccctctccacaagccctcatggggctctccaccagcacgtgactgatattcagcttcatattcttaaaaataggatgtatggatgtgattctgtaaagcaaccaagaaatatagaggaacccagcaacatacctgtatcagagaaggattctaattctcaggtggatttaagcattcgggttactgatgatgatattggtgaaataattcaagtagatggaagcggtgatacatcttccaatgaagaaataggaagtacaagagatgcagatgagaatgaatttctagggaatattgacgggggagatctgaaggtacctgaagaagaagctgacagtatttcaaatgaggattcagccacaaacagtagtgataatgaagaccctcaagtaaacattgtagaagaggaccctttaaattctggagatgatgttagtgaacaggatgtgccagacctgtttgacacggataatgttattgtctgtcagtatgataagcagggagataccagggttcgtcatgggcagcaatgactacgatggacaagaagatagaggccctaatcctaattttctgagcaccatggaagccccctggattctagggagaccttgaggagaaagaagactcctgtaaatgcctgacattgaaattcctgcaagtctaggagcatgtgaactcaaaatggaaattaatttgatttaataaaaataaagaagaagaattgttttggca

SEQ ID NO: 186988 - DNA, 5614 bp, Homo sapiens
  Payload ID: 16818
  Gene Symbol: STON1
  Gene Name: stonin 1
  Uniprot ID: Q9Y6Q2
  ENST ID: ENST00000406226
  CDS Start-End: 196-2403
ggccagaatcggagccccaaccgcgctgccgctcggaccttagcctgtgcctgcagcccggagtcccctcctgccctggaaggcaaggagccaggccacggggccacagccgcgggggccaccacactggcccaaatatttcctgcagagtcaacctatttgatttcttgacaagaccacaatctgatcccaaagatgtgctccacaaatccaggcaaatgggtcacctttgatgatgatcctgctgttcaatcttctcaaaagtcaaagaattttcctctggagaatcaaggtgtctgtagaccaaatggactgaagctgaaccttcctggcctcagggaatttcccagtggatcttcctccaccagcagcactcctctctcctcccccattgtagatttttatttcagtccaggacctccaagtaactctcctctttctacacctaccaaagacttcccaggttttcctggcatccccaaagcagggactcatgtgctttatcctattccagaatcatcttcagacagcccactcgcaatatcaggaggagaatcttccttactgcctaccagaccaacatgtttatcccatgccttgttacccagtgaccactcatgtacacatccaactcccaaagtaggtcttccagatgaagttaatcctcaacaggctgaaagcctaggattccaaagtgatgatctcccccagtttcagtattttcgagaggactgtgctttttcaagtccattttggaaagatgaaggcagtgattcccatttcacccttgacccaccaggaagcaaaaagatgttctcatcaagaaacaaggagatgcctattgaccaaaaaagcctaaataagtgttcactcaactatatctgtgagaagcttgaacatctccagtcagctgagaaccaagactcacttagaagtttgtctatgcactgtctatgtgctgaagaaaatgcctcttcctttgtcccccacacactcttcaggagtcagccaaaatccggatggtctttcatgctgagaattcctgagaagaagaatatgatgtcttcccggcaatggggaccaatttttctgaaagttttgcctggaggaattttgcagatgtattatgaacagggattagaaaaaccatttaaagagatacagcttgatccatattgtaggctttctgaacccaaggttgagaacttcagtgtagcaggaaaaatccacactgtgaagattgaacatgtgtcttacacagaaaaaaggaaataccattctaagacagaagtagttcatgaacctgacatagagcagatgctgaagttggggtccacatcgtaccatgacttccttgactttctgactactgtggaggaggagctgatgaagttgccagctgtttcaaaaccaaaaaagaactacgaggagcaagaaatttccttggaaattgtggacaacttttggggtaaagtcacaaaagaaggaaaatttgttgaaagtgctgtgataactcaaatttattgcctctgctttgtgaatgggaacctggaatgctttttaaccttgaatgaccttgagttgccgaagcgagatgaatcctattatgagaaggactcagaaaaaaaggggattgatattcttgactaccattttcataagtgtgtgaatgtacaagaatttgagcaatcaagaatcattaagtttgtacctctggatgcctgccggtttgagctgatgcgtttcaagactttgtataatggggataatcttcccttttccttgaagtctgtagtggttgtccagggagcatacgtggaacttcaggcttttgtcaacatggcctcattggcgcagaggtcatcctatgctggttccttaaggtcctgtgacaatataaggatacactttcctgtcccatcgcagtggatcaaggccctttggaccatgaacctccagaggcagaagtctctgaaagctaaaatgaaccgccgagcatgtctggggagtttacaggaacttgaatctgaacctgtcattcaagtcactgtggggtcagcaaaatatgagagtgcctaccaggcagtggtatggaagatagatcggcttccagacaaaaattcaagtctagatcatccccattgtctgtcatacaaattagagcttggatcagaccaagaaattccctctgattggtatccatttgctactgttcagttttccgtgcctgacacctgtgcctcaaggacagaggtcaggtctctgggagtggagagtgatgtccagccacagaaacatgttcagcagcgagcttgctacaacatccaggttgaaatagaaaagaagtggattaaaatcgatggagaagacccagataaaattggtgactgcataactcagtaggagtagcaagagtttatgatgacagcccacttgtcaaatatgtaattcaccgaaaccacaccaagtcctgctactgtagagtggaaatgacttctgaatagcggttttaggacaggtctgatggctgtgtttagagaagtttagacctaaaaccgaacaatctgtattttttgcttttcatgtgtttttgtcctaggggttcgatctaaaatgtttctataattcgtgtgatgttttgcttcctattgaaactcaaaggcactgttactcgttgtgtgaccccgcagccagtatgatttttgattactcagtggctgactgttttgctctctggattactgaggtgccgtcttcatttcttcccatctcttcttgctgcttagtgtctgtactagagggtaagggaatcaaaggagacataaaccaaaatagttaattttccctctttcttgcctctgaaatgtggctaggtgtagaatgatgttgaaaccacaggctaaaatgtagatctggaagtatctgtgcttttgaattacttatttacctgtcctcttaccgttggtaaataataattggctatatttggtacctgtctctctcctactgtattgtcattttcaaaatgtgtttgttttctggcgcgtgctgcaaagaagctatttctgttgtcctacatattttagtataaatcactaagacatatttcctttcacttggcaggattcctttcaaaatggaatctgagtattagacactagttaacatatttgtgtatattaaatatgaatttttaaaatttataaatactattttccaaaagtacagactctaaggacatattttgataaagtattatttgtaatgaacacaagcctctcttgagtagaagtctaaatcacattatgattattttatactagttctgctatcatgctgttttatgctaattctgcttattttagagtatttttcattaaaaggtgagcaaagtgaaagatacttggtattttacccagatttctaagtggcaacatttttattcttcagagtcaggtaaatgactataatagtttggtttctaatgaaaagtcaatagcattagcagttataattctgtttataatttcctttcagcatttacagtgaaaagtgagaattttaaaatttatgaaatctatattccaggtattgtttttagtctgaaaaacaaactcccccatgtggtattaatataccttcaatttatgttgagtcttaaacataattaggagatatttttctctatttgctagatttgttttgagtcaaaactgatttagtgttcttccaaacaacatttatgtgttggcctacagagtttatttcatgtgttttttttaatatttaatattatattacattcattgaaatctgttcaaaaacagattaagacaaacatttatgatggtctgtatcaatcagcagattttattgcttttcattattttactgtaaaggcaaagaatgcaataggtgatggttggttgaaaggaattgttattgctgtttttattttttactttttttgagacagagtctcactctgttgcccagcctggagtgcagtgtgtcatcttggctcactgcaacctccgcctcctgggttcaagggattctcctgcctcagcctccaactagctgggattacaggcacaagccaccatgcctggctaaaattcttttgtatttttactacagacggagtttccccatgttggccgggctagtctcgaactcctgacctcaggtgatccaccagcctcggcctcccaaagttctgggattaaatgcgtgagccaccatgcccggccgctattgctctttttaacttcatttgatgccttgcttataatatcatatgcttgaggctcactgttgatgtagagtagggcaaatctgtgtgtgtatgtcattaaaaaaattctaccatctttctttatcatctggtgtgggcgcactctacagtgacttcagtctgctcagaacgaatgtggaggccggccgaaactgatgctgcccacagtcccagtgaagttaggtgggttaattactgccattcctttctaagtgtgttttatggcatcctgcccacaaagaactcacagtctgattaggatgaacttaatgactatttacacctcaaaatatattcagcaaagggttcacttagttgcccctcatgcttcacaggttgactagtatctgtgggtacctccctgcccaggttattcactcacaagccaccgggccttcaggacatctcaagattcagtcttgacaatataatagcaaaagctggactaaagcccaaatggattgtctgtggcaatgcagaagctgatagcattaacagcagggtgttacagcataattgttaattcgcacatctattaggatccttaaatattcattacttaatgttaaattaacattctgtgtagggaggggaggcttattcaattcttctgacctcagaactggcagaaggtcagatgtgactacagaactctaggtgaaaaatcaggtagggttcaaattaagtagaactgcccttgccggaatagtgatcttcaaaaaacccttgcttttaggggagggaagcggggaaggaaaggaatgagggaggaaatattcctttctagcattcattttgcttagatcactccattgtgagtttgaccattttggagtcaaatgagcagacttccaaggagttgaccagtttgtgactagtctggtcacctttccagttacaggatcatattaactgtgtaaatgaattcatgggtagatgatttgtgcagatctgaatttaagaacatttcctttttctgtgggaatcacaagagtttatccactaaaaaaagatatgtaaaaaagatactttccagcacataaataaaggctggaattttacaacctgatgtatatattagacagttctaggatgttagttcccttcattccagagctatgcttgtgatacagccccttttcttataaagtcagttagaaggacttccttaacaatgactattataatgtcttacttaaaatacagttttgtattctgtcaatgcaaatataagacaggttgagccttaatcatgtaacaaaatattttgtagattacatattgatttttcaaaaattaaaaatgtatttcaaacta

SEQ ID NO: 186989 - DNA, 5511 bp, Homo sapiens
  Payload ID: 16818
  Gene Symbol: STON1
  Gene Name: stonin 1
  Uniprot ID: Q9Y6Q2
  ENST ID: ENST00000404752
  CDS Start-End: 94-2301
ggtgtggctggctgcggccagaatcggagccccaaccgcgctgccgagtcaacctatttgatttcttgacaagaccacaatctgatcccaaagatgtgctccacaaatccaggcaaatgggtcacctttgatgatgatcctgctgttcaatcttctcaaaagtcaaagaattttcctctggagaatcaaggtgtctgtagaccaaatggactgaagctgaaccttcctggcctcagggaatttcccagtggatcttcctccaccagcagcactcctctctcctcccccattgtagatttttatttcagtccaggacctccaagtaactctcctctttctacacctaccaaagacttcccaggttttcctggcatccccaaagcagggactcatgtgctttatcctattccagaatcatcttcagacagcccactcgcaatatcaggaggagaatcttccttactgcctaccagaccaacatgtttatcccatgccttgttacccagtgaccactcatgtacacatccaactcccaaagtaggtcttccagatgaagttaatcctcaacaggctgaaagcctaggattccaaagtgatgatctcccccagtttcagtattttcgagaggactgtgctttttcaagtccattttggaaagatgaaggcagtgattcccatttcacccttgacccaccaggaagcaaaaagatgttctcatcaagaaacaaggagatgcctattgaccaaaaaagcctaaataagtgttcactcaactatatctgtgagaagcttgaacatctccagtcagctgagaaccaagactcacttagaagtttgtctatgcactgtctatgtgctgaagaaaatgcctcttcctttgtcccccacacactcttcaggagtcagccaaaatccggatggtctttcatgctgagaattcctgagaagaagaatatgatgtcttcccggcaatggggaccaatttttctgaaagttttgcctggaggaattttgcagatgtattatgaacagggattagaaaaaccatttaaagagatacagcttgatccatattgtaggctttctgaacccaaggttgagaacttcagtgtagcaggaaaaatccacactgtgaagattgaacatgtgtcttacacagaaaaaaggaaataccattctaagacagaagtagttcatgaacctgacatagagcagatgctgaagttggggtccacatcgtaccatgacttccttgactttctgactactgtggaggaggagctgatgaagttgccagctgtttcaaaaccaaaaaagaactacgaggagcaagaaatttccttggaaattgtggacaacttttggggtaaagtcacaaaagaaggaaaatttgttgaaagtgctgtgataactcaaatttattgcctctgctttgtgaatgggaacctggaatgctttttaaccttgaatgaccttgagttgccgaagcgagatgaatcctattatgagaaggactcagaaaaaaaggggattgatattcttgactaccattttcataagtgtgtgaatgtacaagaatttgagcaatcaagaatcattaagtttgtacctctggatgcctgccggtttgagctgatgcgtttcaagactttgtataatggggataatcttcccttttccttgaagtctgtagtggttgtccagggagcatacgtggaacttcaggcttttgtcaacatggcctcattggcgcagaggtcatcctatgctggttccttaaggtcctgtgacaatataaggatacactttcctgtcccatcgcagtggatcaaggccctttggaccatgaacctccagaggcagaagtctctgaaagctaaaatgaaccgccgagcatgtctggggagtttacaggaacttgaatctgaacctgtcattcaagtcactgtggggtcagcaaaatatgagagtgcctaccaggcagtggtatggaagatagatcggcttccagacaaaaattcaagtctagatcatccccattgtctgtcatacaaattagagcttggatcagaccaagaaattccctctgattggtatccatttgctactgttcagttttccgtgcctgacacctgtgcctcaaggacagaggtcaggtctctgggagtggagagtgatgtccagccacagaaacatgttcagcagcgagcttgctacaacatccaggttgaaatagaaaagaagtggattaaaatcgatggagaagacccagataaaattggtgactgcataactcagtaggagtagcaagagtttatgatgacagcccacttgtcaaatatgtaattcaccgaaaccacaccaagtcctgctactgtagagtggaaatgacttctgaatagcggttttaggacaggtctgatggctgtgtttagagaagtttagacctaaaaccgaacaatctgtattttttgcttttcatgtgtttttgtcctaggggttcgatctaaaatgtttctataattcgtgtgatgttttgcttcctattgaaactcaaaggcactgttactcgttgtgtgaccccgcagccagtatgatttttgattactcagtggctgactgttttgctctctggattactgaggtgccgtcttcatttcttcccatctcttcttgctgcttagtgtctgtactagagggtaagggaatcaaaggagacataaaccaaaatagttaattttccctctttcttgcctctgaaatgtggctaggtgtagaatgatgttgaaaccacaggctaaaatgtagatctggaagtatctgtgcttttgaattacttatttacctgtcctcttaccgttggtaaataataattggctatatttggtacctgtctctctcctactgtattgtcattttcaaaatgtgtttgttttctggcgcgtgctgcaaagaagctatttctgttgtcctacatattttagtataaatcactaagacatatttcctttcacttggcaggattcctttcaaaatggaatctgagtattagacactagttaacatatttgtgtatattaaatatgaatttttaaaatttataaatactattttccaaaagtacagactctaaggacatattttgataaagtattatttgtaatgaacacaagcctctcttgagtagaagtctaaatcacattatgattattttatactagttctgctatcatgctgttttatgctaattctgcttattttagagtatttttcattaaaaggtgagcaaagtgaaagatacttggtattttacccagatttctaagtggcaacatttttattcttcagagtcaggtaaatgactataatagtttggtttctaatgaaaagtcaatagcattagcagttataattctgtttataatttcctttcagcatttacagtgaaaagtgagaattttaaaatttatgaaatctatattccaggtattgtttttagtctgaaaaacaaactcccccatgtggtattaatataccttcaatttatgttgagtcttaaacataattaggagatatttttctctatttgctagatttgttttgagtcaaaactgatttagtgttcttccaaacaacatttatgtgttggcctacagagtttatttcatgtgttttttttaatatttaatattatattacattcattgaaatctgttcaaaaacagattaagacaaacatttatgatggtctgtatcaatcagcagattttattgcttttcattattttactgtaaaggcaaagaatgcaataggtgatggttggttgaaaggaattgttattgctgtttttattttttactttttttgagacagagtctcactctgttgcccagcctggagtgcagtgtgtcatcttggctcactgcaacctccgcctcctgggttcaagggattctcctgcctcagcctccaactagctgggattacaggcacaagccaccatgcctggctaaaattcttttgtatttttactacagacggagtttccccatgttggccgggctagtctcgaactcctgacctcaggtgatccaccagcctcggcctcccaaagttctgggattaaatgcgtgagccaccatgcccggccgctattgctctttttaacttcatttgatgccttgcttataatatcatatgcttgaggctcactgttgatgtagagtagggcaaatctgtgtgtgtatgtcattaaaaaaattctaccatctttctttatcatctggtgtgggcgcactctacagtgacttcagtctgctcagaacgaatgtggaggccggccgaaactgatgctgcccacagtcccagtgaagttaggtgggttaattactgccattcctttctaagtgtgttttatggcatcctgcccacaaagaactcacagtctgattaggatgaacttaatgactatttacacctcaaaatatattcagcaaagggttcacttagttgcccctcatgcttcacaggttgactagtatctgtgggtacctccctgcccaggttattcactcacaagccaccgggccttcaggacatctcaagattcagtcttgacaatataatagcaaaagctggactaaagcccaaatggattgtctgtggcaatgcagaagctgatagcattaacagcagggtgttacagcataattgttaattcgcacatctattaggatccttaaatattcattacttaatgttaaattaacattctgtgtagggaggggaggcttattcaattcttctgacctcagaactggcagaaggtcagatgtgactacagaactctaggtgaaaaatcaggtagggttcaaattaagtagaactgcccttgccggaatagtgatcttcaaaaaacccttgcttttaggggagggaagcggggaaggaaaggaatgagggaggaaatattcctttctagcattcattttgcttagatcactccattgtgagtttgaccattttggagtcaaatgagcagacttccaaggagttgaccagtttgtgactagtctggtcacctttccagttacaggatcatattaactgtgtaaatgaattcatgggtagatgatttgtgcagatctgaatttaagaacatttcctttttctgtgggaatcacaagagtttatccactaaaaaaagatatgtaaaaaagatactttccagcacataaataaaggctggaattttacaacctgatgtatatattagacagttctaggatgttagttcccttcattccagagctatgcttgtgatacagccccttttcttataaagtcagttagaaggacttccttaacaatgactattataatgtcttacttaaaatacagttttgtattctgtcaatgcaaatataagacaggttgagccttaatcatgtaacaaaatattttgtagattacatattgatttttcaaaaattaaaaatgtatttcaaact

SEQ ID NO: 186990 - DNA, 1006 bp, Homo sapiens
  Payload ID: 16818
  Gene Symbol: STON1
  Gene Name: stonin 1
  ENST ID: ENST00000444932
  CDS Start-End: 1-282
aggtcatcctatgctggttccttaaggtcctgtgacaatataaggatacactttcctgtcccatcgcagtggatcaaggccctttggaccatgaacctccagaggcagaagtctctgaaagctaaaatgaaccgccgagcatgtctggggagtttacaggaacttgaatctgaacctgtcattcaagtcactgtggggtcagcaaaatatgagagtgcctaccaggcagtggtatggaagatagatcggcttccagacaaaaattcaattttccgtgcctgacacctgtgcctcaaggacagaggtcaggtctctgggagtggagagtgatgtccagccacagaaacatgttcagcagcgagcttgctacaacatccaggttgaaatagaaaagaagtggattaaaatcgatggagaagacccagataaaattggtgactgcataactcagtaggagtagcaagagtttatgatgacagcccacttgtcaaatatgtaattcaccgaaaccacaccaagtcctgctactgtagagtggaaatgacttctgaatagcggttttaggacaggtctgatggctgtgtttagagaagtttagacctaaaaccgaacaatctgtattttttgcttttcatgtgtttttgtcctaggggttcgatctaaaatgtttctataattcgtgtgatgttttgcttcctattgaaactcaaaggcactgttactcgttgtgtgaccccgcagccagtatgatttttgattactcagtggctgactgttttgctctctggattactgaggtgccgtcttcatttcttcccatctcttcttgctgcttagtgtctgtactagagggtaagggaatcaaaggagacataaaccaaaatagttaattttccctctttcttgcctctgaaatgtggctaggtgtagaatgatgttgaaaccacaggctaaaatgtagatctggaagtatctgtgcttttgaattacttatttacctgtcctc

SEQ ID NO: 186991 - DNA, 2977 bp, Homo sapiens
  Payload ID: 16819
  Gene Symbol: STON2
  Gene Name: stonin 2
  Uniprot ID: Q8WXE9
  ENST ID: ENST00000267540
  CDS Start-End: 202-2919
cagatttctgcctggcagattaaccaacggcaagagaggctgatctgtctacattctgagtactgcccttggcaagacacctagaacagaccctggacccaagtctaccgtactaccatacccctactccagcccaccccagacagtattctggggttcacctgaggtcagcagtgtgaagatgaccagtgcctttttagcatgacgactttggaccatgtgattgccacccaccagtcagaatgggtctccttcaatgaagagccaccctttcctgcccactcgcaggggggcacggaagagcacctcccaggactgtcatcttccccagaccagtccgagagctcctccggggagaaccatgtggtggatggaggctctcaagaccattcccactcggagcaggatgactcctctgaaaagatgggcctcatctctgaagcagcttccccacctgggagccctgagcagcccccacctgacctggcctcggccatcagcaactgggttcagtttgaagatgacacaccctgggccagcacatctccacctcatcaggaaacagctgagacagccctaccattgaccatgccctgctggacatgcccttcctttgactccctggggagatgccctctgacttctgagagcagctggaccacccattctgaagacaccagcagtcctagctttggatgttcgtatacagatctgcagctcatcaatgctgaggagcagacgagtggccaggcttctggggctgactcaactgacaattcctcctcgcttcaagaagatgaagaagtagagatggaggccatcagctggcaggccagcagtccagccatgaatgggcaccctgcccctccagtgacctctgctcgttttcccagctgggtcacctttgatgacaatgaagtcagctgccctttaccaccagtcacctctcctctgaagccaaatacaccaccaagtgcatctgtgatcccagatgtaccttataattcaatgggatcatttaagaagagggaccgtcccaagagcactttgatgaacttctccaaagttcagaagctggatatttcctctttaaaccgcacgccttctgtaactgaggcttcaccttggagggcaaccaaccctttcctgaatgagactctgcaggatgtacagccctcccctatcaaccctttcagtgctttctttgaggagcaggagaggcgctcccaaaacagttccatttccagtaccacgggcaaaagccaaagagattccctcattgtcatctaccaggatgccatcagttttgatgattcaagcaaaacccagtcacactctgatgctgttgaaaaactcaaacaactccaaattgatgaccctgatcactttggcagtgcaactctacctgatgatgacccagtagcctggattgaactagatgctcacccgcctggatcagcacggtcccagcctcgtgacgggtggccaatgatgttgaggatccctgagaagaaaaacatcatgtcctccaggcactggggaccgatcttcgtcaaactgacagacactggttacctgcagctgtattatgagcagggcctagaaaaaccattccgtgagttcaagctggagatctgtcatgagatttcagaaccccggcttcaaaactatgatgagaatggcagaatccacagcttgcggatagaccgtgtcacctataaagagaagaagaaataccagcccaaacctgctgtggcccacacagcagagagggaacaggtgattaagctgggcaccaccaattacgatgacttcctgagtttcatccatgcagttcaggaccgtctcatggatctgccagtgttgtcaatggacttgagcacagttggcctcaactaccttgaagaggagattacagtggatgtcagagatgaattctctggcattgtgagcaaaggagacaaccagattctccagcaccatgtcttgacacggatccacatcctgagtttcctgtctgggctcgcagagtgccgcctgggcctcaatgacatcctcgtcaaagggaatgaaatagttttgaggcaggacatcatgcccaccaccaccacaaagtggatcaagctccatgagtgccgtttccatgggtgtgtggatgaggatgttttccacaactcacgggtcattctgttcaaccctttggatgcgtgccggtttgagctaatgcggttcaggacagtgtttgctgagaagaccttgcctttcacactcaggacggccacaagtgtcaatggggcagaggtggaggtgcagagctggctgaggatgtcaactggcttctccgccaatcgtgaccccctcactcaggttccctgtgagaatgtgatgatccgttaccctgtgcccagtgagtgggtgaaaaacttccgcagggaaagtgtcctgggggaaaagtctttgaaagccaaagtgaaccggggggcaagttttggctccactagtgtttctggctctgagcctgtcatgagagtaactctgggaactgccaagtacgagcatgccttcaactccattgtgtggaggataaaccgactgccggacaaaaactcagcttccggtcacccacactgtttcttttgccaccttgaactcggctctgaccgggaagtgccttccagatttgccaatcacgtgaatgtcgagttcagcatgcccacaacttctgcctccaaagccagcgtgagatctatctctgtagaagacaagactgacgtcaggaagtgggtcaattattctgcacactacagctaccaggtagccttgggaagcatctggctaatgcttccaactccatttgttcaccccactaccctccccctcttattccttttagccatgcttactatgttcgcctggtaacctcttactgccttagaggaagttcaccatacatagctgtgggtgcgtctgctctgat

SEQ ID NO: 186992 - DNA, 686 bp, Homo sapiens
  Payload ID: 16819
  Gene Symbol: STON2
  Gene Name: stonin 2
  ENST ID: ENST00000553821
  CDS Start-End: 1-320
ggaggataaaccgactgccggacaaaaactcagcttccggtcacccacactgtttcttttgccaccttgaactcggctctgaccgggaagtgccttccagatttgccaatcacgtgaatgtcgagttcagcatgcccacaacttctgcctccaaagccagcgtgagatctatctctgtagaagacaagactgacgtcaggaagtgggtcaattattctgcacactacagctaccaggtggaaattgagcaaaaaaagagtttgaagccggactttgaaggagatgaaatggaaaatcccaaggagtgtggagtgcagtgacaaagccttgcggcaaggaatcctgatcccagagtcatgatagggtgtcttcctgagtcatgatagggtgtcttcctgagtagctgaagttgcagtcaatacctgctgtggccactgcatgttgggaacagtataccagatcttcctgtttgcagttacttgtattttaccaggaaaccctgagaatggtggcttttggagaggctctttgattctggtcatgcctaaagcacgaggttcacctgactgttggagcttactgtataattaagcctccttgtcttgtctctgcttatctcacagcactggtatgtggtttgttgtgactgttacagtcaggaaaagaacctcccacatcagtgttag

SEQ ID NO: 186993 - DNA, 4302 bp, Homo sapiens
  Payload ID: 16819
  Gene Symbol: STON2
  Gene Name: stonin 2
  Uniprot ID: Q8WXE9
  ENST ID: ENST00000555447
  CDS Start-End: 414-3176
cttggctggtcacagcacagtgctcctgggcccaggggctgtgatctcctgtcatttggttgccattttcctgtgaagagggtagagaatatgcacccagtcaggaaaacaactcacgaggcaaaaaagtacatctcgtggatggagcagggcgaagtggttacaagtacagactctggagccagactgcctgggtttgaattgtgcggtttcagatttctgcctggcagattaaccaacggcaagagaggctgatctgtctacattctgagtactgcccttggcaagacacctagaacagaccctggacccaagtctaccgtactaccatacccctactccagcccaccccagacagtattctggggttcacctgaggtcagcagtgtgaagatgaccagtgcctttttagcatgacgactttggaccatgtgattgccacccaccagtcagaatgggtctccttcaatgaagagccaccctttcctgcccactcgcaggggggcacggaagagcacctcccaggactgtcatcttccccagaccagtccgagagctcctccggggagaaccatgtggtggatggaggctctcaagaccattcccactcggagcaggatgactcctctgaaaagatgggcctcatctctgaagcagcttccccacctgggagccctgagcagcccccacctgacctggcctcggccatcagcaactgggttcagtttgaagatgacacaccctgggccagcacatctccacctcatcaggaaacagctgagacagccctaccattgaccatgccctgctggacatgcccttcctttgactccctggggagatgccctctgacttctgagagcagctggaccacccattctgaagacaccagcagtcctagctttggatgttcgtatacagatctgcagctcatcaatgctgaggagcagacgagtggccaggcttctggggctgactcaactgacaattcctcctcgcttcaagaagatgaagaagtagagatggaggccatcagctggcaggccagcagtccagccatgaatgggcaccctgcccctccagtgacctctgctcgttttcccagctgggtcacctttgatgacaatgaagtcagctgccctttaccaccagtcacctctcctctgaagccaaatacaccaccaagtgcatctgtgatcccagatgtaccttataattcaatgggatcatttaagaagagggaccgtcccaagagcactttgatgaacttctccaaagttcagaagctggatatttcctctttaaaccgcacgccttctgtaactgaggcttcaccttggagggcaaccaaccctttcctgaatgagactctgcaggatgtacagccctcccctatcaaccctttcagtgctttctttgaggagcaggagaggcgctcccaaaacagttccatttccagtaccacgggcaaaagccaaagagattccctcattgtcatctaccaggatgccatcagttttgatgattcaagcaaaacccagtcacactctgatgctgttgaaaaactcaaacaactccaaattgatgaccctgatcactttggcagtgcaactctacctgatgatgacccagtagcctggattgaactagatgctcacccgcctggatcagcacggtcccagcctcgtgacgggtggccaatgatgttgaggatccctgagaagaaaaacatcatgtcctccaggcactggggaccgatcttcgtcaaactgacagacactggttacctgcagctgtattatgagcagggcctagaaaaaccattccgtgagttcaagctggagatctgtcatgagatttcagaaccccggcttcaaaactatgatgagaatggcagaatccacagcttgcggatagaccgtgtcacctataaagagaagaagaaataccagcccaaacctgctgtggcccacacagcagagagggaacaggtgattaagctgggcaccaccaattacgatgacttcctgagtttcatccatgcagttcaggaccgtctcatggatctgccagtgttgtcaatggacttgagcacagttggcctcaactaccttgaagaggagattacagtggatgtcagagatgaattctctggcattgtgagcaaaggagacaaccagattctccagcaccatgtcttgacacggatccacatcctgagtttcctgtctgggctcgcagagtgccgcctgggcctcaatgacatcctcgtcaaagggaatgaaatagttttgaggcaggacatcatgcccaccaccaccacaaagtggatcaagctccatgagtgccgtttccatgggtgtgtggatgaggatgttttccacaactcacgggtcattctgttcaaccctttggatgcgtgccggtttgagctaatgcggttcaggacagtgtttgctgagaagaccttgcctttcacactcaggacggccacaagtgtcaatggggcagaggtggaggtgcagagctggctgaggatgtcaactggcttctccgccaatcgtgaccccctcactcaggttccctgtgagaatgtgatgatccgttaccctgtgcccagtgagtgggtgaaaaacttccgcagggaaagtgtcctgggggaaaagtctttgaaagccaaagtgaaccggggggcaagttttggctccactagtgtttctggctctgagcctgtcatgagagtaactctgggaactgccaagtacgagcatgccttcaactccattgtgtggaggataaaccgactgccggacaaaaactcagcttccggtcacccacactgtttcttttgccaccttgaactcggctctgaccgggaagtgccttccagatttgccaatcacgtgaatgtcgagttcagcatgcccacaacttctgcctccaaagccagcgtgagatctatctctgtagaagacaagactgacgtcaggaagtgggtcaattattctgcacactacagctaccagacaacagaaacagacaaccttccaaatcctctatattgcagttgccttccacacacagatttaaaaagaggatcaaagagggtggtgaagatcaggtggaatgcttctttggaagttccactggcatcatctatcagaacaatggtgtgagcatgaagaggcacagacaggtctccaaaatagatgttaggatttgggtgctacctgacacagaagtaggtctaaccctccaagtactggggatgataggataatcaatgaggtatatatatatttgtcattttgtataaaatattgtgaaaattgaaggaggacactcagtaaacatcctgggactatttgtaagttatggcaaaaccagatgagagaaaagggacagtcccctctgtatcctcgttgtctcttagtaacatcaaattgtagttaaaaaaattttaaactatgtacaagctacaaaatagcatctctttcatggtatgtttgagtgtgtaattttagtttcttttctggttgtatttgtggtagtcagatgtgttggattgattccaactggacagagtaaggaattccagcatcctcttcctgcttgctcgtgttaccccacagatcaaaccctcaattctagttggggatgctgtctagccccacaccatgactgaagccttaagcactgttgcgcctccatgtgctttggatcagcaaccccagtggtattctaccagagcattgtgggaaagcagatgtatagtcaggtcccaacagcaaattgttgggtgtgagagttctaaagtataggggtgagggaagagaaggatatgaactcctctgaccttaagccagcattcatttaacttttatgtctacttaacaagagaacctggagaaaactaccgtattcaagagattaatcaaaatcagtgttttagccaggcgatgacagagaagcaccattcctcaccctccattcttgtaatgtctgtaataaatttcagtgcgtcaggatggatgaacccaagatccagtgaatgattcagctgttccaagccttacattttccatcattcatcatccattctcattcagtgtaacctcttgcactattgtggttaattttatgtaaaaccagtttatgtttttttttttttaatatgtgcctatgtaataaagtctacacactggctatctctgtagaggtgaggttttgtttttagttgttctactgattatatccttttctgagctatgaaaatgaattattaataaaaaatttttgaac

SEQ ID NO: 186994 - DNA, 603 bp, Homo sapiens
  Payload ID: 16819
  Gene Symbol: STON2
  Gene Name: stonin 2
  ENST ID: ENST00000557055
  CDS Start-End: 455-603
gagtctggagccggcgtcggcgctgcggccgggagggatcgtggcgagagcagtgcggccgggtgggtatcccgcggccagagaagccggctttgccgcggcgacctttcggcggacgccggggaccctgcggaccgcggcgcaggaaaacaactcacgaggcaaaaaagtacatctcgtggatggagcagggcgaagtggttacaagtacagactctggagccagactgcctgggtttgaattgtgcggtttcagatttctgcctggcagattaaccaacggcaagagaggctgatctgtctacattctgagtactgcccttggcaagacacctagaacagaccctggacccaagtctaccgtactaccatacccctactccagcccaccccagacagtattctggggttcacctgaggtcagcagtgtgaagatgaccagtgcctttttagcatgacgactttggaccatgtgattgccacccaccagtcagaatgggtctccttcaatgaagagccaccctttcctgcccactcgcaggggggcacggaagagcacctcccaggactgtcatcttccccagaccagtccgagagctcctc

SEQ ID NO: 186995 - DNA, 439 bp, Homo sapiens
  Payload ID: 16819
  Gene Symbol: STON2
  Gene Name: stonin 2
  ENST ID: ENST00000554710
  CDS Start-End: 430-439
ctagcgccgctgtgccccctggcgcccccgagcctgcctggtcgagccacgcggaggcgcggcgtttccaccagccgcgggcgtcccggggtgggggaggacgaggggactctgcttaaggaaaacaactcacgaggcaaaaaagtacatctcgtggatggagcagggcgaagtggttacaagtacagactctggagccagactgcctgggtttgaattgtgcggtttcagatttctgcctggcagattaaccaacggcaagagaggctgatctgtctacattctgagtactgcccttggcaagacacctagaacagaccctggacccaagtctaccgtactaccatacccctactccagcccaccccagacagtattctggggttcacctgaggtcagcagtgtgaagatgaccagtgcctttttagcatgacgactt

SEQ ID NO: 186996 - DNA, 2964 bp, Homo sapiens
  Payload ID: 16819
  Gene Symbol: STON2
  Gene Name: stonin 2
  Uniprot ID: Q8WXE9
  ENST ID: ENST00000614646
  CDS Start-End: 202-2964
cagatttctgcctggcagattaaccaacggcaagagaggctgatctgtctacattctgagtactgcccttggcaagacacctagaacagaccctggacccaagtctaccgtactaccatacccctactccagcccaccccagacagtattctggggttcacctgaggtcagcagtgtgaagatgaccagtgcctttttagcatgacgactttggaccatgtgattgccacccaccagtcagaatgggtctccttcaatgaagagccaccctttcctgcccactcgcaggggggcacggaagagcacctcccaggactgtcatcttccccagaccagtccgagagctcctccggggagaaccatgtggtggatggaggctctcaagaccattcccactcggagcaggatgactcctctgaaaagatgggcctcatctctgaagcagcttccccacctgggagccctgagcagcccccacctgacctggcctcggccatcagcaactgggttcagtttgaagatgacacaccctgggccagcacatctccacctcatcaggaaacagctgagacagccctaccattgaccatgccctgctggacatgcccttcctttgactccctggggagatgccctctgacttctgagagcagctggaccacccattctgaagacaccagcagtcctagctttggatgttcgtatacagatctgcagctcatcaatgctgaggagcagacgagtggccaggcttctggggctgactcaactgacaattcctcctcgcttcaagaagatgaagaagtagagatggaggccatcagctggcaggccagcagtccagccatgaatgggcaccctgcccctccagtgacctctgctcgttttcccagctgggtcacctttgatgacaatgaagtcagctgccctttaccaccagtcacctctcctctgaagccaaatacaccaccaagtgcatctgtgatcccagatgtaccttataattcaatgggatcatttaagaagagggaccgtcccaagagcactttgatgaacttctccaaagttcagaagctggatatttcctctttaaaccgcacgccttctgtaactgaggcttcaccttggagggcaaccaaccctttcctgaatgagactctgcaggatgtacagccctcccctatcaaccctttcagtgctttctttgaggagcaggagaggcgctcccaaaacagttccatttccagtaccacgggcaaaagccaaagagattccctcattgtcatctaccaggatgccatcagttttgatgattcaagcaaaacccagtcacactctgatgctgttgaaaaactcaaacaactccaaattgatgaccctgatcactttggcagtgcaactctacctgatgatgacccagtagcctggattgaactagatgctcacccgcctggatcagcacggtcccagcctcgtgacgggtggccaatgatgttgaggatccctgagaagaaaaacatcatgtcctccaggcactggggaccgatcttcgtcaaactgacagacactggttacctgcagctgtattatgagcagggcctagaaaaaccattccgtgagttcaagctggagatctgtcatgagatttcagaaccccggcttcaaaactatgatgagaatggcagaatccacagcttgcggatagaccgtgtcacctataaagagaagaagaaataccagcccaaacctgctgtggcccacacagcagagagggaacaggtgattaagctgggcaccaccaattacgatgacttcctgagtttcatccatgcagttcaggaccgtctcatggatctgccagtgttgtcaatggacttgagcacagttggcctcaactaccttgaagaggagattacagtggatgtcagagatgaattctctggcattgtgagcaaaggagacaaccagattctccagcaccatgtcttgacacggatccacatcctgagtttcctgtctgggctcgcagagtgccgcctgggcctcaatgacatcctcgtcaaagggaatgaaatagttttgaggcaggacatcatgcccaccaccaccacaaagtggatcaagctccatgagtgccgtttccatgggtgtgtggatgaggatgttttccacaactcacgggtcattctgttcaaccctttggatgcgtgccggtttgagctaatgcggttcaggacagtgtttgctgagaagaccttgcctttcacactcaggacggccacaagtgtcaatggggcagaggtggaggtgcagagctggctgaggatgtcaactggcttctccgccaatcgtgaccccctcactcaggttccctgtgagaatgtgatgatccgttaccctgtgcccagtgagtgggtgaaaaacttccgcagggaaagtgtcctgggggaaaagtctttgaaagccaaagtgaaccggggggcaagttttggctccactagtgtttctggctctgagcctgtcatgagagtaactctgggaactgccaagtacgagcatgccttcaactccattgtgtggaggataaaccgactgccggacaaaaactcagcttccggtcacccacactgtttcttttgccaccttgaactcggctctgaccgggaagtgccttccagatttgccaatcacgtgaatgtcgagttcagcatgcccacaacttctgcctccaaagccagcgtgagatctatctctgtagaagacaagactgacgtcaggaagtgggtcaattattctgcacactacagctaccagacaacagaaacagacaaccttccaaatcctctatattgcagttgccttccacacacagatttaaaaagaggatcaaagagggtggtgaagatcaggtggaatgcttctttggaagttccactggcatcatctatcagaacaatggtgtga

SEQ ID NO: 186997 - DNA, 2154 bp, Homo sapiens
  Payload ID: 16820
  Gene Symbol: SARAF
  Gene Name: store-operated calcium entry-associated regulatory factor
  Uniprot ID: Q96BY9
  ENST ID: ENST00000256255
  CDS Start-End: 259-1278
acaccgcctcgccccgccccaagccgcgctgtgctccaggggcgggggcccacggcggccactcactgagccccacgggccgcagcggcagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccattgtggtactccttgggatcgcgtttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtagaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggggtttagtctcattctttctattagcctaggcgcaaataaatgttactttttgtttttttaaaccctttttcccaaaggggaaagtt

SEQ ID NO: 186998 - DNA, 878 bp, Homo sapiens
  Payload ID: 16820
  Gene Symbol: SARAF
  Gene Name: store-operated calcium entry-associated regulatory factor
  ENST ID: ENST00000518296
  CDS Start-End: 1-655
cttggagtataatttagattatacagaacttggcctgcagaaactgaaggagtctggaaagcagcacggctttgcctctttctctgattattattataagtggtcctcggcggattcctgtaacatgagtggattgattaccattgtggtactccttgggatcgcgtttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggtaagagcaaaaaatacaagttccttttacctaggagtaaagtacagaaatagtttgggaactttagaagatgattatctgtttagcaaccatggttttatttggtgtacctaccaaaaatattaatagcacagttaactgagatcccacttttaaacattctttaaaaatcaaacagggatttgatttaggcttagctctaccatagaccaaggttttaacttgaaccttactgggtgctagcttccccatatatttaattctgtgatctctaga

SEQ ID NO: 186999 - DNA, 582 bp, Homo sapiens
  Payload ID: 16820
  Gene Symbol: SARAF
  Gene Name: store-operated calcium entry-associated regulatory factor
  ENST ID: ENST00000522055
  CDS Start-End: 116-226
cgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccattgtggtactcctt

SEQ ID NO: 187000 - DNA, 735 bp, Homo sapiens
  Payload ID: 16820
  Gene Symbol: SARAF
  Gene Name: store-operated calcium entry-associated regulatory factor
  ENST ID: ENST00000523127
  CDS Start-End: 1-642
attgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccattgtggtactccttgggatcgcgtttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattggg

SEQ ID NO: 187001 - DNA, 566 bp, Homo sapiens
  Payload ID: 16820
  Gene Symbol: SARAF
  Gene Name: store-operated calcium entry-associated regulatory factor
  ENST ID: ENST00000523761
  CDS Start-End: 126-566
gcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcc

SEQ ID NO: 187002 - DNA, 1803 bp, Homo sapiens
  Payload ID: 16820
  Gene Symbol: SARAF
  Gene Name: store-operated calcium entry-associated regulatory factor
  ENST ID: ENST00000520303
  CDS Start-End: 205-318
gcggccactcactgagccccacgggccgcagcggcagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccattgtggtactccttgggatcgcgtttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtagaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaa

SEQ ID NO: 187003 - DNA, 1741 bp, Homo sapiens
  Payload ID: 16820
  Gene Symbol: SARAF
  Gene Name: store-operated calcium entry-associated regulatory factor
  ENST ID: ENST00000521265
  CDS Start-End: 1-1043
tggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccattgtggtactccttgggatcgcgtttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtagaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatctt

SEQ ID NO: 187004 - DNA, 808 bp, Homo sapiens
  Payload ID: 16820
  Gene Symbol: SARAF
  Gene Name: store-operated calcium entry-associated regulatory factor
  ENST ID: ENST00000522794
  CDS Start-End: 202-808
agtctctgagtcacccttagcggacagggctgcagacctcgcaggtctgttagcagaatcgcagattgcactcttttttttttttttgagtcggagtctcacattgtcgccccggccgcactgcaatgacgtgatctcggctcactgcaacctccgcctcctgggttcaagagattctcctgcctcggcctcaccgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccattgtggtactccttgggatcgcgtttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactg

SEQ ID NO: 187005 - DNA, 582 bp, Homo sapiens
  Payload ID: 16820
  Gene Symbol: SARAF
  Gene Name: store-operated calcium entry-associated regulatory factor
  ENST ID: ENST00000518340
  CDS Start-End: 17-130
atcttcatcgagcgccatggccgcagcctgcgggccgggagcggccgggtactgcttgctcctcggcttgcatttgtttctgctgaccgcgggccctgccctgggctggaacgaccctgtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccattgtggtactccttgggatcgcgtttgtagtctataagctgttcctgagtgacgggcagtattctcctccaccgtactctgagtatcctccattttcccaccgttaccagagattcaccaactcagcaggacctcctcccccaggctttaagtctgagttcacaggagacgataaagtagaaagttggagtcaaacactggatgcagaaa

SEQ ID NO: 187006 - DNA, 1981 bp, Homo sapiens
  Payload ID: 16820
  Gene Symbol: SARAF
  Gene Name: store-operated calcium entry-associated regulatory factor
  ENST ID: ENST00000518174
  CDS Start-End: 176-298
agcggcagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccattgtggtactccttgggatcgcgtttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtagaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggg

SEQ ID NO: 187007 - DNA, 1976 bp, Homo sapiens
  Payload ID: 16820
  Gene Symbol: SARAF
  Gene Name: store-operated calcium entry-associated regulatory factor
  Uniprot ID: Q96BY9
  ENST ID: ENST00000545648
  CDS Start-End: 597-1100
cacaccgcctcgccccgccccaagccgcgctgtgctccaggggcgggggcccacggcggccactcactgagccccacgggccgcagcggcagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccattgtggtactccttgggatcgcgtttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtagaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggggtttagtctcattctttctattagcctaggcgcaaataaatgttactttttgtttttttaaaccctttttcccaaaggggaaagtt

SEQ ID NO: 187008 - DNA, 3377 bp, Homo sapiens
  Payload ID: 16821
  Gene Symbol: STOX1
  Gene Name: storkhead box 1
  Uniprot ID: Q6ZVD7
  ENST ID: ENST00000298596
  CDS Start-End: 84-3053
gatcctcccgccgagcgagcggcgtcgtagccgccgcgctcgccgaggccctgcgttgcgggctcccggccgccggcgaaagcatggcccggcccgtgcagctggcgccgggctcgctggcgctagtgctgtgccggctggaggcgcagaaggcggcgggggccgcggaggagcctggtgggcgcgcggtgttccgcgctttccgtcgcgccaacgcgcgctgcttctggaacgcgcggctggcgcgcgccgcctcgcggctggccttccagggctggctgcggcggggggtgctgctggtgcgcgcgccccccgcctgcctgcaggtgctgcgcgatgcctggcggcgccgggccctgcggccgccgcgcggcttccgcatcagggcggtgggtgatgtctttccagtgcaaatgaatccaataactcaatctcagttcgtacctttgggtgaagttctttgctgtgctatatctgatatgaatacagctcagattgtagtaacgcaggaatcacttttggagcgtttgatgaaacattacccaggcattgcaattccatcggaagatattctttataccactctgggaacgctgattaaagaaaggaagatttatcacactggagaaggatacttcatagttactcctcagacttacttcattacaaatacaaccacccaggaaaataagagaatgctgccatcagatgaaagtcgcctgatgccagcttccatgacatatctggtgagcatggagagctgtgcagagtcagcccaagagaatgctgcccccatatcccactgtcagtcttgccagtgtttccgggacatgcacactcaggatgttcaggaagcaccagttgctgcagaagtgactaggaagagtcacagaggtcttggggaatccgtatcttgggtacagaatggggcagtttcagtgtctgcggagcaccacatttgtgagagcaccaaacctttaccatacacaagagataaagaaaaaggcaagaagtttggttttagtctcttatggcgcagcttatctagaaaggagaagcccaaaacagaacacagcagtttctctgctcagttcccacctgaagaatggcccgtccgagatgaagatgacttggacaatatccctcgagatgttgaacatgagataatcaaacgaattaaccccattttgactgttgacaatttaatcaaacacactgtcctaatgcaaaaatacgaagaacagaaaaaatataatagccagggcacttccactgacatgctgacaatcgggcataagtatccttcaaaagagggggttaagaaaaggcagggtctgtctgcaaaacctcaagggcagggccattctcgaagggatagacacaaagccaggaatcagggaagtgagtttcagccaggaagcattagactggagaaacaccccaagctccctgctacacagcccatccccagaattaaaagcccaaatgaaatggtaggtcagaaaccacttggtgagattacaacagtgctaggttcccatttgatttacaaaaagcgaatcagtaatcctttccagggtttgtctcaccgaggaagcacaatatccaaagggcacaaaattcagaagacgagtgatctgaaacccagccagactggaccaaaggaaaagcctttccaaaagcctaggtccttggattcctcaagaatctttgatggtaaagccaaagagccatatgctgaacaacctaatgataaaatggaagcagaatccatttacataaatgaccctactgtcaaacccatcaatgatgacttcagaggtcacctcttcagtcaccctcaacagagcatgttgcaaaatgatggtaaatgctgtccctttatggaaagcatgttgagatatgaagtgtatggtggagaaaatgaggtaattcctgaagtcttgaggaaaagtcattcccactttgacaaattaggggagaccaaacagactccgcatagtctgccatcacgaggtgcctccttttcagaccgaacaccctctgcttgtagattagtggataacacaatacaccagtttcaaaatcttggccttttggattacccagttggcgtgaaccctttaagacaagctgcaagacaagacaaagactcagaagaattattgagaaaaggatttgtccaggatgcagagactacaagcctagaaaatgaacagctttctaacgatgaccaggccttgtatcagaatgaagtggaagatgatgatggtgcctgtagttcattatatctagaggaggatgacatttctgagaatgacgacttacgtcaaatgctgcctggccacagtcagtattccttcacaggtggaagccagggaaatcatttaggaaaacaaaaagtgattgagagatctctgaccgagtacaacagcacaatggagagggttgagtctcaggtgcttaaaagaaatgaatgctacaaacccactgggctgcatgctaccccaggtgaaagccaagaacctaacctctctgctgaaagttgtggcctaaattcaggggcccagtttggttttaactacgaagaagaacccagtgttgctaaatgtgtacaggcctcagcacctgctgatgaaagaatctttgattactatagcgcaagaaaagccagttttgaagctgaagtcatacaagacactattggtgacacaggaaagaagccagctagctggagtcagagtcctcagaatcaggaaatgagaaaacatttcccacaaaagttccaacttttcaacacttcacatatgccagtgttggctcaggatgtccaatatgaacacagtcacttggaagggacagaaaatcacagcatggcaggagatagtggaatagattctccacggacacagagtctgggatctaataattcagtcattttggatggactaaaaagaagacagaattttctgcaaaatgtcgaaggcacaaagagcagtcaaccactcacatctaattccttactaccgctaactccagtcataaacgtttaattttcttttggaaacctacttttttctttataaaaaggtagagcattattacagaatctttcaatcatgtaagaattgagtatataagaattgtctaaaggcaagcatatctatactattaaccacattacacattttgttctaattactggctttttttcctcttttggtgtcttaaggctttttgaagcttattttactgtgagtttattgggagtatatagattattttcgattaaaaagtggaattattggtccccttccaattgtaattatcttgaatttttatacattagtttctcaaatatatagaatgccaattta

SEQ ID NO: 187009 - DNA, 935 bp, Homo sapiens
  Payload ID: 16821
  Gene Symbol: STOX1
  Gene Name: storkhead box 1
  Uniprot ID: Q6ZVD7
  ENST ID: ENST00000399162
  CDS Start-End: 1-510
atggcccggcccgtgcagctggcgccgggctcgctggcgctagtgctgtgccggctggaggcgcagaaggcggcgggggccgcggaggagcctggtgggcgcgcggtgttccgcgctttccgtcgcgccaacgcgcgctgcttctggaacgcgcggctggcgcgcgccgcctcgcggctggccttccagggctggctgcggcggggggtgctgctggtgcgcgcgccccccgcctgcctgcaggtgctgcgcgatgcctggcggcgccgggccctgcggccgccgcgcggcttccgcatcagggcggtgggtgatgtctttccagtgcaaatgaatccaataactcaatctcagttcgtacctttgggtgaagttctttgctgtgctatatctgatatgaatacagctcagattgtagtaacgcaggaatcacttttggagcgtttgatgaaacattacccaggacacagagtctgggatctaataattcagtcattttggatggactaaaaagaagacagaattttctgcaaaatgtcgaaggcacaaagagcagtcaaccactcacatctaattccttactaccgctaactccagtcataaacgtttaattttcttttggaaacctacttttttctttataaaaaggtagagcattattacagaatctttcaatcatgtaagaattgagtatataagaattgtctaaaggcaagcatatctatactattaaccacattacacattttgttctaattactggctttttttcctcttttggtgtcttaaggctttttgaagcttattttactgtgagtttattgggagtatatagattattttcgattaaaaagtggaattattggtccccttccaattgtaattatcttgaatttttatacattagtttctcaaatatatagaatgccaattta

SEQ ID NO: 187010 - DNA, 1135 bp, Homo sapiens
  Payload ID: 16821
  Gene Symbol: STOX1
  Gene Name: storkhead box 1
  Uniprot ID: Q6ZVD7
  ENST ID: ENST00000399165
  CDS Start-End: 1-684
atggcccggcccgtgcagctggcgccgggctcgctggcgctagtgctgtgccggctggaggcgcagaaggcggcgggggccgcggaggagcctggtgggcgcgcggtgttccgcgctttccgtcgcgccaacgcgcgctgcttctggaacgcgcggctggcgcgcgccgcctcgcggctggccttccagggctggctgcggcggggggtgctgctggtgcgcgcgccccccgcctgcctgcaggtgctgcgcgatgcctggcggcgccgggccctgcggccgccgcgcggcttccgcatcagggcggtgggtgatgtctttccagtgcaaatgaatccaataactcaatctcagttcgtacctttgggtgaagttctttgctgtgctatatctgatatgaatacagctcagattgtagtaacgcaggaatcacttttggagcgtttgatgaaacattacccaggcattgcaattccatcggaagatattctttataccactctgggaacgctgattaaagaaaggaagatttatcacactggagaaggatacttcatagttactcctcagacttacttcattacaaatacaaccacccaggaaaataagagaatgctgccatcagatgaaagtcgcctgatgccagcttccatgacatatctggacacagagtctgggatctaataattcagtcattttggatggactaaaaagaagacagaattttctgcaaaatgtcgaaggcacaaagagcagtcaaccactcacatctaattccttactaccgctaactccagtcataaacgtttaattttcttttggaaacctacttttttctttataaaaaggtagagcattattacagaatctttcaatcatgtaagaattgagtatataagaattgtctaaaggcaagcatatctatactattaaccacattacacattttgttctaattactggctttttttcctcttttggtgtcttaaggctttttgaagcttattttactgtgagtttattgggagtatatagattattttcgattaaaaagtggaattattggtccccttccaattgtaattatcttgaatttttatacattagtttctcaaatatatagaatgccaattta

SEQ ID NO: 187011 - DNA, 3281 bp, Homo sapiens
  Payload ID: 16821
  Gene Symbol: STOX1
  Gene Name: storkhead box 1
  Uniprot ID: Q6ZVD7
  ENST ID: ENST00000399169
  CDS Start-End: 84-3053
gatcctcccgccgagcgagcggcgtcgtagccgccgcgctcgccgaggccctgcgttgcgggctcccggccgccggcgaaagcatggcccggcccgtgcagctggcgccgggctcgctggcgctagtgctgtgccggctggaggcgcagaaggcggcgggggccgcggaggagcctggtgggcgcgcggtgttccgcgctttccgtcgcgccaacgcgcgctgcttctggaacgcgcggctggcgcgcgccgcctcgcggctggccttccagggctggctgcggcggggggtgctgctggtgcgcgcgccccccgcctgcctgcaggtgctgcgcgatgcctggcggcgccgggccctgcggccgccgcgcggcttccgcatcagggcggtgggtgatgtctttccagtgcaaatgaatccaataactcaatctcagttcgtacctttgggtgaagttctttgctgtgctatatctgatatgaatacagctcagattgtagtaacgcaggaatcacttttggagcgtttgatgaaacattacccaggcattgcaattccatcggaagatattctttataccactctgggaacgctgattaaagaaaggaagatttatcacactggagaaggatacttcatagttactcctcagacttacttcattacaaatacaaccacccaggaaaataagagaatgctgccatcagatgaaagtcgcctgatgccagcttccatgacatatctggtgagcatggagagctgtgcagagtcagcccaagagaatgctgcccccatatcccactgtcagtcttgccagtgtttccgggacatgcacactcaggatgttcaggaagcaccagttgctgcagaagtgactaggaagagtcacagaggtcttggggaatccgtatcttgggtacagaatggggcagtttcagtgtctgcggagcaccacatttgtgagagcaccaaacctttaccatacacaagagataaagaaaaaggcaagaagtttggttttagtctcttatggcgcagcttatctagaaaggagaagcccaaaacagaacacagcagtttctctgctcagttcccacctgaagaatggcccgtccgagatgaagatgacttggacaatatccctcgagatgttgaacatgagataatcaaacgaattaaccccattttgactgttgacaatttaatcaaacacactgtcctaatgcaaaaatacgaagaacagaaaaaatataatagccagggcacttccactgacatgctgacaatcgggcataagtatccttcaaaagagggggttaagaaaaggcagggtctgtctgcaaaacctcaagggcagggccattctcgaagggatagacacaaagccaggaatcagggaagtgagtttcagccaggaagcattagactggagaaacaccccaagctccctgctacacagcccatccccagaattaaaagcccaaatgaaatggtaggtcagaaaccacttggtgagattacaacagtgctaggttcccatttgatttacaaaaagcgaatcagtaatcctttccagggtttgtctcaccgaggaagcacaatatccaaagggcacaaaattcagaagacgagtgatctgaaacccagccagactggaccaaaggaaaagcctttccaaaagcctaggtccttggattcctcaagaatctttgatggtaaagccaaagagccatatgctgaacaacctaatgataaaatggaagcagaatccatttacataaatgaccctactgtcaaacccatcaatgatgacttcagaggtcacctcttcagtcaccctcaacagagcatgttgcaaaatgatggtaaatgctgtccctttatggaaagcatgttgagatatgaagtgtatggtggagaaaatgaggtaattcctgaagtcttgaggaaaagtcattcccactttgacaaattaggggagaccaaacagactccgcatagtctgccatcacgaggtgcctccttttcagaccgaacaccctctgcttgtagattagtggataacacaatacaccagtttcaaaatcttggccttttggattacccagttggcgtgaaccctttaagacaagctgcaagacaagacaaagactcagaagaattattgagaaaaggatttgtccaggatgcagagactacaagcctagaaaatgaacagctttctaacgatgaccaggccttgtatcagaatgaagtggaagatgatgatggtgcctgtagttcattatatctagaggaggatgacatttctgagaatgacgacttacgtcaaatgctgcctggccacagtcagtattccttcacaggtggaagccagggaaatcatttaggaaaacaaaaagtgattgagagatctctgaccgagtacaacagcacaatggagagggttgagtctcaggtgcttaaaagaaatgaatgctacaaacccactgggctgcatgctaccccaggtgaaagccaagaacctaacctctctgctgaaagttgtggcctaaattcaggggcccagtttggttttaactacgaagaagaacccagtgttgctaaatgtgtacaggcctcagcacctgctgatgaaagaatctttgattactatagcgcaagaaaagccagttttgaagctgaagtcatacaagacactattggtgacacaggaaagaagccagctagctggagtcagagtcctcagaatcaggaaatgagaaaacatttcccacaaaagttccaacttttcaacacttcacatatgccagtgttggctcaggatgtccaatatgaacacagtcacttggaagggacagaaaatcacagcatggcaggagatagtggaatagattctccacggacacagagtctgggatctaataattcagtcattttggatggactaaaaagaagacagaattttctgcaaaatgtcgaaggcacaaagagcagtcaaccactcacatctaattccttactaccgctaactccagtcataaacgtttaattttcttttggaaacctacttttttctttataaaaaggagatggggttttgccatgttgcgcaactaatgaagtccatctaattttgccactggatgcattatgacactctccctgttttaaaggaatgtattaaatgaatcaagctcattatgaaaccagtaaaattttctcctatgaaactcatcatataacacagacattaaagatgggaatatgtgcgattaaa

SEQ ID NO: 187012 - DNA, 10458 bp, Homo sapiens
  Payload ID: 16822
  Gene Symbol: STOX2
  Gene Name: storkhead box 2
  Uniprot ID: Q9P2F5
  ENST ID: ENST00000308497
  CDS Start-End: 1436-4216
gcagcgtagcgggctggcggtgacttacaccgggactccagagggagagaggaagcgctgcaggccacttgcattgcgtcttccaggctgcgtggacccggcgccccggcgtgtgcggttgtgggggagctcgccgtggcctcccctccctctggctttagcttcctttggggttggcgcaggtgggccaggcagcgcaccgcagatctccccgttcccacgaaggctggctcgctgtctctctccgagcgggagggaccatcctaaaaatatgtaaatatccaagcgctggctccaggctggggcagctgccaaggtccccgcgccgccgccgggtgttttacatgaaaatgagaagcctgatgggaaccgcgttctaacttaaggcagcctggtgattagcatgagactgggcggctgtcctgcttcctgcccttcaatagccgttccgcgcgctcgcgccggagcagcgctgccgccgcgcgggggtcgatcgcaggctcggcgtccttggcagccatggctccggcgccgcctcggccagtaagtaggagcatgcatgtgtagggggcacatgcgtgtcggcgcacccacccagccatccacccgcgcgcacgcacagcgcccggagcctcggcaaggggaagattgacgaggcgctgcagtcgcggggacgacgcgggctcttcctggattccgcaggagcccgcccgccgcagctgctgtctgcagagcctgctcggatcctgtgcacacgcgccccccgctcgagcctctgtgatgaagactgtctcccggggactgcagcggaggcagagccagccagcgccggggactgcgggccgtgcggctgataggcccgcggggacacgactcggacactgtcatccccacgcctcgcgctgagctgcccggcgcggagggtctgccgccgcccctccggcctcccgcacgcccgatcccgggtcagccccggaggcctcggctgcctcatttgtttgggtcttttgtgccgtggctcccagttggccaagcactcctgcgctgaatcgggccattgtctgcgctcccattgccttcacgctgcaagtctcggcgcccccaccccgcccgccccctccccgcctcctcccggccggggagcctcctaacgtgcctttccccccaggaatctggaagctataagccgggcggattgcaaatgaagtgtaatgcattgtgggacgtgtgtaaaatcggagccttcgccgtgggggtgtgggggggcgtggggagggccggacccgccgctggcggtgtagacgccgacgaggaggggctgggaaaatgtgcgcagagtccgcccgggtcgtgcccgccgtagacggatgaaggagcgcgctgcgccccggcgctgaggccccgaggatcggggcggcaggtcgccctccccaccatgaagaagacccggagcacaaccttgcggcgagcctggcctagctcggatttctcggaccgggcctcggaccgcatgaggtcccgcagcgagaaggactaccgcctgcacaagcgtttccccgcggccttcgcgccccaggcttcgcggggctacatgacatcaggtgatgtatcacccatcagtatgtctcccatcagtcagtctcagtttattccactcggggagatcctctgcttggccatctcagcaatgaactcggcaagaaagcctgtcacccaagaagcactgatggagcacctgaccacgtgcttcccaggtgttccaacgccaagccaagaaattctgcggcacacgctgaacacgctggtacgggagaggaagatctacccaactccagatggctacttcatcgtgaccccacagacttatttcataactccttccctcataagaactaacagtaaatggtaccatttggacgagaggatacctgaccggtctcagtgcacctctccgcaacccgggaccatcacgccctctgcctcaggctgtgtcagggaaaggacattgccccgaaaccactgcgactcttgccactgctgcagagaagacgtgcacagcacgcatgcacccaccctgcaaaggaagtctgccaaggactgcaaagacccttactgtcccccttctctgtgccaggtgccacccactgaaaagagcaaaagtactgtaaatttttcctataagacagaaactctctcaaaacctaaagatagtgaaaagcagtcaaaaaaattcgggctaaagttattccggttaagttttaaaaaagacaagaccaaacagctggccaatttttctgcccagtttcctcctgaagagtggcccctgcgagacgaggacacgccagctacgatccctcgggaagtagagatggaaatcattaggcgcattaacccagacctgaccgtggaaaatgtcatgcggcacaccgcgctcatgaagaaactggaagaagaaaaggcccagaggagtaaagccgggtcctctgcccatcacagcggaaggagtaaaaagagtaggactcatcggaagtcccatggaaagtctcggtctcacagcaagacacgggtgtctaaaggagacccttccgacggttcacatctggatatcccagctgaaagagagtatgacttttgtgatcctcttaccagggtgcccagggagggctgcttcatcattgaacacaaaggagataacttcatcatgcacagcaacacaaacgtgctcgagtcccacttccccatgacaccagaatgggatgtgtctggtgaattggctaaaaggagaactgagatgccttttcctgaaccttctaggggaagctcccactcaaaagtgcaccgaagccacagccatacacaggaccggaggtccaggaatgagagatccaacaaagccaaggagagatccaggtcgatggataactccaaaggccctctgggtgcttcttctctagggacgccggaagaccttgctgaaggctgcagccaagacgaccagacccccagccaatcctacattgacgacagtactttaaggcctgcacagaccgttagtctccaaagggctcacatttcgtccacaagctataaagaggtgtgtattccagagatagtcagtggcagcaaggaaccgtccagcgcttgcagccttttggagccaggaaaaccacccgagagtttgccatcctatggcgaactcaactcttgtccaacaaaaacagccacagatgactatttccagtgcaacacctctagtgagacggtgctcacggcaccatcacctctgggaaagaataaggaggaccatgacactctgactttggcagaaggggtgaaaaagctctccccttctgataggcaggtcccccactcctccagggagcctgtggggcacaaggaggagtcaccaaaagggccgggtgggggccccgctgcttcgggaggagtggctgaagggatcgccaacggacgcctcgtccagcaccatggtgccgagcccagcagcttggacaagaggaaagagatatttagcaaagacacactgttcaaacctcttcacagcaccttgtctgtaaacagctatcacaagtcgagcctgtccctcctcaaatctcacccgaagacacctgctgacacattgccaggccgatgtgagaaactggaaccgtccctggggacctcggcggcacaagccatgcctgcttcccagcgtcagcaggagtcaggagggaaccaggaagcctcttttgactattacaacgtctctgatgatgacgactctgaggaaggggcaaacaagaacacagaggaggagaaaaatagagaggacgtaggcaccatgcagtggctcctcgagcgggagaaggaaagagacttgcagaggaaatttgaaaagaacctcacccttcttgctccaaaagaaaccgacagcagcagcaaccagagagccacccattcagcccggctcgacagcatggacagcagcagcatcacagtggacagtggattcaactccccacgtactcgggagagcctggcttccaacacatcaagcattgttgaaagtaaccgtcgtcagaaccccgctttgagcccggcccatggtggagctggtccagccttcaacttccgagcgagcgcggagcccccgacaaatgaagctgagaagctacagaaaccttccaactgcttgcaagcttctgttactagcgtgtgattgtccttctgcctcagatcttctgtctcattcgatacagcaaagtttacgacactgggactgatgtttacatctttggaaagacaagcatctcaaccacagtttttgtgtttacttaaactgtgctgctaagtagggctagggcaaaaaaacaaaaaatctttatttcagagtattgcttttcacatttatggctctgtagcaactgagtaacagtaggggtgatatgtatacttttgcttcactaattgtatctgagcacacataggaaagtctagacactgtaagtgtaatacgcattttcaatgtcatgcagttgccaattccattttaaaatgccacagatgcgtgttgctcccagtctgtggttaaacggtgccacagaactgatccttgacacttccaaaaaaaaaaaaacaaaacaaaacaaaaaaaatttaaaaaaaaaaaacaaaaaacaaaactaagctaccacgaaatgtcaaatgcaagggtccaccttgagggaaatagatgccaaactaactagaagggaccccggccctttgtgtgtgaattgtttatgcaccagtcatttttcactgtgagttttcgtgacactattttgcaggagcccatggaagtgtgtgagaaggggtcgcaatggagatcactgggagtgaatgttttcagggttttgttttgaagtgtcacagatgcttgtctgatttttttaaccttccgtgatcacaaacaggaatataggcctttgaatctgaagtggacaaaggaaagcaatttccagtctggctggggcacagcattaggtgattgaaaaggtgatgtggacttgtaaaaggtgttactcaaatattgaaggaagagaatttcctccttgtgatacttaggatgaccctatcttactctaatagatacaataattagtttgtttaaaagcaaaatgttctttgtgatacaaatgaagagtagggcctgaggatgttattctttctaatggaaggacataaatctattttatgtagttttaaatagaatgcctaaattaggctgtgggagataatttttagtggttgtaggaaagagcaaatttagggagtgttgaacttcaggccttttattcctgggaagatatgtatagagaaaacttttaaaataatttttgattagaaatatacatgtgcccatgtaataaacaacagaatgtgctcattctgctagtgcggtataatccgaatttgtactcccctaaaatttatcagaataacaattatgcatacatgaactatgccagagtaatgtttacagatactttgtaaccaatttcaggaggcgtttttagctggatgtgtagttaattagaccaacttatttccaaatggtttgttaacattttgctttggtttacaatgtcatgttgaacacaaagaagacccagcagcaaagggatgaccaataatttcatcttatagcaaggagacattccaacgttcccatgttttattttctgagaacagtgggacagatctgtagtaatggaatattatttgcaaaagggttacatatgacacaagtaagtgttctgacataaagttttatttagttcagtggcatgtgctgttgggagccatacaccataaaatatatatatcccaaaataaatctagaatattttcacctccaatttcagtaattggcatatgatttgtgagacgcatctgtttttgtatgaggtttaatcactagcaatctgtttaaagaatccagtcctatacacagttggactcattcttgaaacctttaaatgctccctcatagtttttcagttatttggaagttgcattgggtcaaactgaactccttgagtttggtgtaaattccttttttctgcttattatagtgaaacttcagcatgtttcttagtaaactcccataccattgaaatgcttaagccagttggctttcagtctcatgccttatttcctccaaggcatgcctcaacgcattgtttgtctcattgcttaaatatgtccagaaggaatgatcatgtatctaatagactacatagttggttcccttggggagttatatatcatacagttactaaatatttgtctaaattcattttttccaaaaacctgctctcaaatttttcttctactctcagttcataaataatataaccattgaaacaacacatcagcctctagctgatcctctgaaagtagccattgaaataatcgaatactgtgtgaacaggaaaggaaagcgttacctttaagagaagctttaaaataggaatttattgatatttcacaagatataggtttacagaagacattattcaaataaatatgtacactatttgcctgatgctatggggtacataattttttaaaaactcccttagaccagcagccattagtgtagaaatgatggactttaaaggtgataccatgtaagcagatgttgcatataaaaatattcctgcctgaatctgatcgagattcttgaatgggggaggagtggcagccggcagcacattgcaaatgtcattcgaggtcacggtgaggctctcggtcccggaacagtgggggcctcgccaggcgttgccagtatccctttcctcctgtaaaatcatagctttgtgttacacgactgcttatccagtcttagggtttagcagctgaaaggtttacaaaactgaatctggttgaatctctgtgaaagggtcaacacatctgtcggcattttgcacacttatgtattattatgatacaacatattactttatggtaatttttatttttacatataactacctccataaatttgatgaaatggcagccgtgtgttaaagtgtatcgttcagaagagcaaagttgaacacttccttcaacattagggcatggcgtgctgtgtgtgtcagtgattgcctctgtggactcatgactttccatcgccatggctttctcttacgccgctgtttggctttcagatgtaatcctgtcttctcctctcttccccacgaaagcgcactcgattttgttaggaatgaacggaagtttaaaaattcttgtgcccacccccgccctccacccattcctgttaaaagttctctggcgaagagccaatgggtgaacgtaattgaaagagctatttactcttttggaaatctgatttgaagtctaagttttcagtaacagaagacacacaagcaatgtggactgccaagcttgaagcacttcgggctctgccttcactcgcatgctaccatgtcgagcccaaactccactttaattaaaagagctgtgctgtgaattccacaacttctgttaaataatttgtattccattatatatattttgcacatctcaggggaccataatgaacatatgaaaggggggggggtgccatcaaatagagaaaacaaatagaagaggtgaatggagactagctggataaaaataacaaattacttcttctctgatgttgtgaaggtcaggttcaggaagcatcaattcacagttaatccggagtaacaatgatctgaacaccagctgttcccaggtccctctttttcatagcccaaccagcatctaaaatgtaaatttaaattacattgcagtcaccatggggagaagaaacctgttcagtggaagcagaagcattgttccttttttaggttggcgcagctttgcaaaactctacccaggataaaccacttatcaccaccaagtgtacttgaaaataaagtttttaacttaaattacaagcatattgctcataatacaatagtgatcattttttgaaagtcttgccatttataacatgggcagtatttggagcttcatttaaaaaccaacaacaaccgataatgactttgcacgattcactttgggatctcaaagtgcttccaaagcattcagatttacaaacaattcacaagacaggtcatctttgtaatacgcatacttacaacgaattaacaaaaggagtgacttaagattctccaggaacacagtggcagctattgatgatctgttttctatctgtttgatagagcatcatgagaaatcacaaaatacaatgctatttttctgatgtgtgctaataaagtcaaagaaaacaaatacatcttgacacttttgtccattttcattaaaaaaaaaaaagttcagggtgtttggaattttacatctcagcacaccttactggtatcaatggataaagcgggtgattgacagatccacccaaatgccactgcagtcagaagcagatctggacacacccttgtttacagtttcatattgggttgctatagttcccgtgctaaatcaccagctttcaggaacatgactgctcctggcagtggaaggtgctgaaacagaaattttaattaaaaactttatcaagtactcttcacagtgctgcttggcaccatagaaaatcagtacaatatatcgagccctactttggaggagctggatttctgagggagctgatccagttctaagtgtcttctcgaattaggagatagatgatctttgatggggatctcctccgtcaccacaggccagtcacagaaccaactagccacgtgctgccagacctcagtgggcccaagcaggagcaatctcttctatcccccatctcccccaggaccatcccgcccattgtcaacgtcatccagggctcttctggtagtgagtgacttttctgcacatgtttagggcttgggggagctagaacacaggaaacatgaatgcaaaaggcatggaaaacactgttttgctttgggttagtaaaatgtgggcaggacaaagattactattggtctgagctttgccaagtgagatagaatcaactgtcaccccattcctttcccagaaggtcttatggtattaaggatacatccagtattttcccacagatttttattcaggcgatgtttcataaattacatatatgaaaacattcattattacatttccttgtgtgtttcaaacagacattggcaccttcctattgagttaattctctgcatcttttgcagcagcagcccacaaggagattcccagagatggctcccctaacacacagtcctgtgattttacagttctatgacttacagttgatgattcacaagattcaggattctacaagactcaagggggaactaaactttcttacgattgtacatgatcagttatagggctgtaatcattaattgttggcttcaaatgtggacacacacacacacacatcatgccaaggagggaatggggtgtttcaagtcaggcagcgatgattctggaaggttggaaatgtaaggttagaagcttggctggtcttagtaaacttgttcccttgctcccaccaagaagaggtaccaaatgtgagacctgagatctcctccaatatctgtcctctgcagttccgggaaactaatcatgaagtacacatgcagcagctcctccacttcctttcctccgaggtcctcctttccattctcccacctagatactgacacaccgccacggtttccacattggaagggcagaacactgtgcagtatcgtgcacacttgctgggttaggaatagagctgccctagggtcaccttcatgcaagtattgacagctacaaattaaagtccttagagcagttgacacagatactacgttctagaagagaattaaatttaaacgtcaagtttaaagggatcataattctgcaggtatctttctctgagtgactgaatgtgactattgcattagggtaaatgaattaagacgtgcaagtgggatttactgtatgttagaaaggagttttgcagccaagactgccttgaataaaatgtgtttgcactgaaaaaaaattttaaattacttggtctctggttgctgtaaaggtcatccaagatggatgttctgtttatattgtatagtatttcatatgaaataattacagttcatgaaatgtcttccctaatgttactgatttataacagcacatttgtaacatggtttttatcgtgtcagtgtaccatactgtaaatgatgattacttgtcatgcttagtataataacttaaaagaaaaaaaaggacagggatttttgtaagtctatatttgaaagtccctccctatggtgatactgtgttcatgttgtttatgtagtgttgtgtgaaatatccattttggattgtgttactttttaagatattaaataacatttggttata

SEQ ID NO: 187013 - DNA, 443 bp, Homo sapiens
  Payload ID: 16822
  Gene Symbol: STOX2
  Gene Name: storkhead box 2
  ENST ID: ENST00000513034
  CDS Start-End: 1-224
gtgatgtatcacccatcagtatgtctcccatcagtcagtctcagtttattccactcggggagatcctctgcttggccatctcagcaatgaactcggcaagaaagcctgtcacccaagaagcactgatggagcacctgaccacgtgcttcccagtactcgggagagcctggcttccaacacatcaagcattgttgaaagtaaccgtcgtcagaaccccgctttgagcccggcccatggtggagctggtccagccttcaacttccgagcgagcgcggagcccccgacaaatgaagctgagaagctacagaaaccttccaactgcttgcaagcttctgttactagcgtgtgattgtccttctgcctcagatcttctgtctcattcgatacagcaaagtttacgacactgggactgatgtttacatctttggaaagacaagcatctc

SEQ ID NO: 187014 - DNA, 518 bp, Homo sapiens
  Payload ID: 16822
  Gene Symbol: STOX2
  Gene Name: storkhead box 2
  ENST ID: ENST00000512520
  CDS Start-End: 53-518
gaatgctcagcttgtctcaaggctgcaatgaggtgatgtatcacccatcagtatgtctcccatcagtcagtctcagtttattccactcggggagatcctctgcttggccatctcagcaatgaactcggcaagaaagcctgtcacccaagaagcactgatggagcacctgaccacgtgcttcccaggtgttccaacgccaagccaagaaattctgcggcacacgctgaacacgctggtacgggagaggaagatctacccaactccagatggctacttcatcgtgaccccacagacttatttcataactccttccctcataagaactaacagtaaatggtaccatttggacgagaggatacctgaccggtctcagtgcacctctccgcaacccgggaccatcacgccctctgcctcaggctgtgtcagggaaaggacattgccccgaaaccactgcgactcttgccactgctgcagagaagacgtgcacagcacgcatgcacccaccctgcaaaggaagt

SEQ ID NO: 187015 - DNA, 1055 bp, Homo sapiens
  Payload ID: 16822
  Gene Symbol: STOX2
  Gene Name: storkhead box 2
  ENST ID: ENST00000506529
  CDS Start-End: 1-658
ctcctccagggagcctgtggggcacaaggaggagtcaccaaaagggccgggtgggggccccgctgcttcgggaggagtggctgaagggatcgccaacggacgcctcgtccagcaccatggtgccgagcccagcagcttggacaagaggaaagagatatttagcaaagacacactgttcaaacctcttcacagcaccttgtctgtaaacagctatcacaagtcgagcctgtccctcctcaaatctcacccgaagacacctgctgacacattgccaggccgatgtgagaaactggaaccgtccctggggacctcggcggcacaagccatgcctgcttcccagcgtcagcaggagtcaggagggaaccaggaagcctcttttgactattacaacgtctctgatgatgacgactctgaggaaggggcaaacaagaacacagaggaggagaaaaatagagaggacgtaggcaccatgcagtggctcctcgagcgggagaaggaaagagacttgcagaggaaatttgaaaagaacctcacccttcttgctccaaaagaaaccgacagcagcagcaaccagagagccacccattcagcccggctcgacagcatggacagcagcagcatcacagtggacagtggattcaactccccacggaattgaaaaaaatgtttctgcacctgtagagatcaccaatctggactgtactcgggagagcctggcttccaacacatcaagcattgttgaaagtaaccgtcgtcagaaccccgctttgagcccggcccatggtggagctggtccagccttcaacttccgagcgagcgcggagcccccgacaaatgaagctgagaagctacagaaaccttccaactgcttgcaagcttctgttactagcgtgtgattgtccttctgcctcagatcttctgtctcattcgatacagcaaagtttacgacactgggactgatgtttacatctttggaaagacaagcatctcaaccacagtttttgtgtttacttaaactgtgctgctaagtagggctagggcaaaaaaacaaaaaa

SEQ ID NO: 187016 - DNA, 1320 bp, Homo sapiens
  Payload ID: 16823
  Gene Symbol: SFN
  Gene Name: stratifin
  Uniprot ID: P31947
  ENST ID: ENST00000339276
  CDS Start-End: 76-822
gcaggagagacacagagtccggcattggtcccaggcagcagttagcccgccgcccgcctgtgtgtccccagagccatggagagagccagtctgatccagaaggccaagctggcagagcaggccgaacgctatgaggacatggcagccttcatgaaaggcgccgtggagaagggcgaggagctctcctgcgaagagcgaaacctgctctcagtagcctataagaacgtggtgggcggccagagggctgcctggagggtgctgtccagtattgagcagaaaagcaacgaggagggctcggaggagaaggggcccgaggtgcgtgagtaccgggagaaggtggagactgagctccagggcgtgtgcgacaccgtgctgggcctgctggacagccacctcatcaaggaggccggggacgccgagagccgggtcttctacctgaagatgaagggtgactactaccgctacctggccgaggtggccaccggtgacgacaagaagcgcatcattgactcagcccggtcagcctaccaggaggccatggacatcagcaagaaggagatgccgcccaccaaccccatccgcctgggcctggccctgaacttttccgtcttccactacgagatcgccaacagccccgaggaggccatctctctggccaagaccactttcgacgaggccatggctgatctgcacaccctcagcgaggactcctacaaagacagcaccctcatcatgcagctgctgcgagacaacctgacactgtggacggccgacaacgccggggaagaggggggcgaggctccccaggagccccagagctgagtgttgcccgccaccgccccgccctgccccctccagtcccccaccctgccgagaggactagtatggggtgggaggccccacccttctcccctaggcgctgttcttgctccaaagggctccgtggagagggactggcagagctgaggccacctggggctggggatcccactcttcttgcagctgttgagcgcacctaaccactggtcatgcccccacccctgctctccgcacccgcttcctcccgaccccaggaccaggctacttctcccctcctcttgcctccctcctgcccctgctgcctctgatcgtaggaattgaggagtgtcccgccttgtggctgagaactggacagtggcaggggctggagatgggtgtgtgtgtgtgtgtgtgtgtgtgtgtgtgtgtgcgcgcgcgccagtgcaagaccgagattgagggaaagcatgtctgctgggtgtgaccatgtttcctctcaataaagttcccctgtgacactcc

SEQ ID NO: 187017 - DNA, 11121 bp, Homo sapiens
  Payload ID: 16824
  Gene Symbol: SBNO1
  Gene Name: strawberry notch homolog 1 (Drosophila)
  Uniprot ID: A3KN83
  ENST ID: ENST00000267176
  CDS Start-End: 144-4322
gcgtcaagatggcggcggggaggtaggcagagcaggacgccgctgctgccgccgccaccgccgcctccgctccagtcgcctctggtccttcaaactcacacctcccgggaggagctgtgctggcgccgggtcccgcggggaaaatggtggagccagggcaagatttactgcttgctgctttgagtgagagtggaattagtccgaatgacctctttgatattgatggtggagatgcagggcttgcaactccaatgcctaccccgtcagttcagcagtcagtgccacttagtgcattagaactaggtttggagaccgaagcagcagttcctgttaaacaagaaccagagactgtacctactccagcactattaaatgtgaggcagcctccatctactacaacatttgtgctgaatcaaataaatcatcttccacccttgggatctacaattgtaatgactaaaacaccacctgtaacaaccaacaggcaaaccatcactttaactaagtttatccagactactgcaagcacacgcccgtcagtctcagcaccaacagtacgaaatgccatgacctctgcaccttcaaaagaccaagttcagcttaaagatctactgaaaaataatagtcttaatgaactgatgaaactaaagccacctgctaatattgctcagccagtagcaacagcagctactgatgtaagcaatggtacagtaaagaaagagtcttctaataaagaaggagctagaatgtggataaacgacatgaagatgaggagtttttccccaaccatgaaggttcctgttgtaaaagaagatgatgaaccagaggaagaagatgaagaagaaatgggtcatgcagaaacctatgcagaatacatgccaataaaattaaaaattggcctacgtcatccagatgctgtagtggaaaccagctctttatccagtgttactcctcctgatgtttggtacaaaacatccatttctgaggaaaccattgataatggctggttatcagcattgcagcttgaggcaattacatatgcagcccagcaacatgaaactttcctacctaatggagatcgtgctggcttcttaataggtgatggtgccggtgtaggaaaaggaaggacgatagcaggaatcatctatgaaaattatttgttgagtagaaaacgagcattgtggtttagtgtttcaaatgacttaaagtatgatgctgaaagagatttaagggatattggagcaaaaaacattttggttcattcgttaaataagtttaaatacggaaaaatttcttccaaacataatgggagtgtgaaaaagggtgttatttttgctacttactcttcacttattggtgaaagccagtctggcggcaagtataaaactaggttaaaacaacttctgcattggtgcggtgatgacttcgatggagtgatagtgtttgatgagtgtcataaagccaaaaacttatgtcctgttggttcttcaaagccaaccaagacaggcttagcagttttagagcttcagaacaaattgccaaaagccagagttgtttatgctagtgcaactggtgcttctgaaccacgcaacatggcctatatgaaccgtcttggcatatggggtgagggtactccatttagagaattcagtgattttattcaagcagtagaacggagaggagttggtgccatggaaatagttgctatggatatgaagcttagaggaatgtacattgctcgacaactgagctttactggagtgaccttcaaaattgaggaagttcttctttctcagagctacgttaaaatgtataacaaagctgtcaagctgtgggtcatcgccagagagcggtttcagcaagctgcagatctgattgatgctgagcaacgaatgaagaagtccatgtggggtcagttctggtctgctcaccagaggttcttcaaatacttatgcatagcatccaaagttaaaagggttgtgcaactagctcgagaggaaatcaagaatggaaaatgtgttgtaattggtctgcagtctacaggagaagctagaacattagaagctttggaagagggcgggggagaattgaatgattttgtttcaactgccaaaggtgtgttgcagtcactcattgaaaaacattttcctgctccagacaggaaaaaactttatagtttactaggaatcgatttgacagctccaagtaacaacagttcgccaagagatagtccttgtaaagaaaataaaataaagaagcggaaaggtgaagaaataactcgagaagccaaaaaagcacgaaaagtaggtggccttactggtagcagttctgacgacagtggaagtgaatctgatgcctctgataatgaagaaagtgactatgagagctctaaaaacatgagttctggagatgatgacgatttcaacccatttttagatgagtctaatgaggatgatgaaaatgatccctggttaattagaaaagaccacaagaaaaacaaagagaaaaaaaagaagaaaagtatagatccagattctattcaaagtgccttattagcatcaggtcttggatcaaaacgacctagtttttcatctacaccagttatctcacctgctcctaacagtacaccagctaacagtaacaccaacagtaacagtagccttataacaagtcaggatgctgtggaaagggctcagcagatgaagaaagacctgcttgataagctagaaaaattagctgaagacctcccccctaataccctggatgaacttatcgatgaacttggtggccctgagaacgttgctgagatgactggccgcaagggacgggttgtgagcaatgatgatggaagcatatcttatgagtcaagatctgaacttgatgtgcctgtggaaatactaaacatcacagaaaaacaacgatttatggatggagataagaatattgctatcatctcagaagctgccagctcgggtatttcattacaagcagataggagagctaaaaatcaaaggcgaagagttcatatgactttagaattaccttggagcgctgatagagcaattcaacagttcggacgtactcatagatcaaaccaagttactgctcctgagtatgtctttctgatatctgaactggcaggagaacaaagatttgcatctattgttgctaaaagacttgagagtttgggggcacttacacatggtgatagaagggcaacagaatctagagatctgagcaggttcaactttgataataagtatggaagaaatgctttagaaattgtcatgaaatccattgtaaacttggattctcctatggtatcaccacctccagactatcctggagaattttttaaagatgttcgacaaggactgataggcgttggcctgataaatgtagaagatcgctcgggaattcttactctcgataaagattataacaacataggaaaattcttaaatagaattttaggcatggaggtgcatcagcagaatgcgttatttcagtattttgcggacacacttactgcagttgttcaaaatgccaaaaaaaatggaagatatgatatgggaatcttagatcttggttctggagatgaaaaagtgcggaaaagtgatgttaaaaagtttctgactccaggatattcaacctctggccacgtagaattatacacaattagtgtagagaggggaatgtcatgggaggaagctaccaagatttgggctgagctgacaggaccagacgatggcttttacttgtcattgcaaataaggaacaacaagaaaactgccatcttagttaaagaagtgaatcctaaaaagaaacttttcttagtttatcgaccaaatactgggaagcagctcaaattagaaatttatgctgatctaaaaaagaaatataagaaggtcgtctcagatgatgccctgatgcactggttagatcagtataattcatctgcagatacttgtactcatgcttattggcgcggcaattgcaaaaaagcaagcttggggctagtttgtgaaataggtcttcgttgccgtacatattatgtattatgtggttcagtgctgagtgtctggacaaaagttgagggtgttctagcatctgtcagtggcacaaacgtgaagatgcagatcgtgcggctaagaacggaagatgggcaacggattgtaggtttgatcattccggcaaattgtgtgtctcctcttgtaaatctcctatcaacttcagaccagtctcaacagcttgcggtccaacagaaacagctatggcaacagcatcaccctcagagcatcaccaacttgagcaacgcatgaagaacagacaggtttcaacatggatggatctgaaatgctgttgaagcatatcatttgcataaaaatcagggacagtttccaaagaattatatatttttttcagttgtgctctctagttagtttttttgggagtaaggacaaacctggaatagatagcaaaactgaaaatcagcagtgctgatggtggtacatatgtctttcctttagcttctcccctgataattcccatctgcttttacttcgggtgagcagagggggatgtgtgtgtgcgtgtgtgtcagtctgtttgtgagtgtgttaaaggctacagaccacagttggtttaaaatgcttggaacttcccaaactggctttactttatgtttatacagtgctcagggttaacgcagtacatccatgccattgctgtgggaggtatccccggatgcatgtgttttgagtctataaatatagaaaatatatattggtttctttttccaacttaataggtttattaaagcatgaaatgaaaggttgcatatcatgcattcaggttattttctaatttttgttctgacagtgcatgtctttggaagcatgctgaaacaagattaacacaggagtcgagtaacagagagaaacatttgttagatgtacagcattggttattgcatttttatagtgtttatacctgggtattgcttcaaaccctgcagacccctccttccccttctccctgccctgggtttctggtcaaggtaatgaatacatacatttttctgtgataaaactcttaaaagttaattttaatgtattaatagtattcctaatgtgtgctgcagaaatggctatgagcctcttaaatttacatttgcaacttaaaggtagttttagaaggaagtacaaattggctttcatcttgcaaacaatcgttttttacttcattatcttaatttgctttgtcactcataaaaaggaaaccatacctgagttgtagacaatgaggaaacacttgaggcttctgctgtgtgttcttttgttattgttgttattgttgttactcagtaacttgaatattgtttaatgtgttgtaagacgtagagtttatctcaagctgttaaaaatggtaatgtacaaatgtgaatagacacttatctatataatatgggtaagttttgtttcgcctataatagatgtttataaaaacaagtgaggggacagttggtctttttatcttttctttctttttctttcttttctttttttctttttttttttttttttttttttttttgcttccacaggttgcactattgaaaaatcgagattgtataaacctggtaaaaagctgcaagatgccaaaatcttgtagatgtcaaataaaaagttattatactaacaagaagtggactcttgtttaggccctcactggtgaccttcagaagtagtctgtgacggggactcagcagaatttgtgtgttgtctcagcattccaggtagccttatagtttggcttaaaacttatccctaaaatgtaagatggcattgagggaaagggtataatgatagtacttctgaatgttttttaagttgaattgtttgtaaacttcttgcagaattgggtgagatgtgtgttaaaactgacaaacctggctgaaagcttagggcgttcatcctcttgtgtctcctttagcctgagtttggttatgtcaagcttaccgtaagttttcttaggatttatttattcttggtgcctaaaagaataaattgaaagtactttctgttctttggcacattttgcccagcggatgcaacttctatcctcagtccagttcatatatctcaggcagtgatccattttgtatcagccagtttcccttgttagggccgctagacccggctggcagccaagagcagcactctccccaccttcagcagaacttctcagctcatgtgtgtgtttttaaaagcagtaggcagcttccatcagcaatggaagtgtcccccactccagtggtggaggtgcagtcgctggacctgaggaagtggggaagcattacaaaccctcctgcagtaagaatggcagagttgggaaggatcttctctcgcaggctgttggcccaactcctcttttctgtgtatgagggcatcttagttttttatggcgttttcaaagcagcatatgaggattcttagcatgcagctaagtgacaacccccatggcctatgatgtaatgtttgctctggactagccatcttgataaataggagtgtatgtatcttaggttctttgtagaacagctatttttttttctcattaaaaaggcctctgaaagccctctcaaaatggacctcacaaaggcaaccagtgtgaatggatgggagctggggtgctgcatgcccaggctggtcatggtgtgtgcagcacccagagagttgcacccaccccttcttcaggtggacatccgacctttacactgtggtcttgcaaaaatcagcgagttagtttggccgccctgtgaagcttcagcattcaaggtcctcttctgttaaaacccaactcgtagccgggcgtggtggctcactcctataatcccagcacttcgggaggccaaggcaggtgcatcacttgaggccaggagttcgagaccagcctggtccacatggcaaaaccccatctgtaccaaaaaatacaaaaaatttgccgctgacttctgtaaaataggtccattcattgcaggatctaaatgccacacctgaattcagaggccttgtttaattaaccccatgtccactttgcctctgcaatgcctttttctttttagcaatatggctctgagcacaaagatttggttggaaatcatgttcgtgttttcagagtttacagcgtcaattgtactgaaaaccacttccagagtctaaagcagctcagatgttatctctgggggaattagtgttcccctcatttagcaacctccataccacaaggtctctgtctgtagttactgggattatccagatacactatcaatgatacaaattcataggagtattaatgcatttctttaaacacaacttgattaagaagcaaatatgttaagcagttttctttttctgctgctaaattacagttagacacttcagtatcttctctttacatgtgtatataaattagtaagaacctgcatccaaagcaatgtagtgtgtgtatgtatctatatatatttattctaactcagcacttcagaagcctttttgagttacaacaatattttagtttgcctcatctgtagaggtaaaatttctatattaccaagctccagaggaatatgatattttacaggcacaattttctggctgtagtccctggggcattcatttgctggcctccatgggatgctgttagaacaattgttagccggcaagagaagaaaggctaccaggacagcatttataattgtagaatgggagccttcttccctctcccctccactttcattttagcatgagataaaaaaatagattggaaatgattgttgcatctcacttcatggaagtaggggcagaagttccctctggatccttttcttgacaagcagtcaagaggaaggtccccatacacatgtacctgtgtgatacttggtagtttctaagaatggtgctacataagcgttgctgttaggctgggatcctattaatgaacgtttgattagttcaggcctcccaatggcaaaggcagacaccgtggagatggacatttactgactccccttctgtgtggcttcggtctccctggctaacaccacacctgtgcgtactgcgctcggcccactttgctgcagaaacgtagcaagcgtttcatgtcagggctacagctgagagcaaaaactgcaaaaaaaaaaaaaaatgtctcattgaatgccagttgtctgatacaaatgcagtgtcttttaagtgacagaaacacacctaaatacctgcaactcaagctcgctagcattttttttttgagtacttgagataaaatccaaaacccaccctctaattttgtgctgtatttatatatatgtacataaatgtatatatagagaaatgttgagttcttctggattctgaatgtaaataattcttgtaaattgggactctgcccacctgtttctcccttttccctcttcccttcagctctatttattcttttcttgactttcccatatggggcatcttatgacttttttttttttttttttttaagaaaagtatggaaaacttttcatttagaaaagtatttgttcctgtattttagaattcagttttgcatctttgctgtagaattcctgttttgtgttaatgttttttactatgtcttattgtgttgtgtgcaatgcattgtactggggggatgcacttgagtgccatttctgatactgtcattgtatgactgctgatgctcgtttatgttgttctttggaagctatagtgagcctgatgttttcacattttaaaaaatgcttcctgagacttctttaagctcctctaacttcttcagtgcatttgggatcaaacttagctcttagatcagcaaacctgacttgcttctacttttgcaatttttcaggccttaccatatttcttatctctgtcttcccacctgataggaaaatcttgcagatttgaaacagtggtttctggcctgctgctgcagcaaattccctatgtttatttaagaagtcgggcctatgcttttaacctacaaatgatgagtaatttacttgcaatgaacacaggtagcctgctgctgtttataacctgttgaggatatttatagcaggcaggaggcaggcctagtgtgttattgacaggtgactttagagaatgtacattggccgggtgcggtggctcacgcctgtaatcccagcactttgggaggccgaggcgggcggatcatgaggtcaggagattgagaccatctcctggctaacacggtgaaaccccgtctctactaaaaatacaaaaaaaaaaaaaacttagccaggcgtggtggcgggtgcctgtagtcccagctactcaggaggctgaggcaggagaatggcatgaacctgggaggcagagcttgcagtgagcccagatcgcgccactgcactccagcctgggcaacagaccgagactccgtctcgaaaaaaaaaaaagagagagaatgtacattaaggaacaattgtcctccaaaagagagccaagcaactgctctggagcctcctaggctgactctgctggagggtgagacaagcagattcccattgcagcactggtccctggggtaccctgaacggctgtgctctccacccttgtatcggtgagtggatcttgtctacatcagccgtaagcctagaagcagagcgggatcgaggcgtttttaataattcgagttgggaagacccggatggttcatcaaaatgatggtgttgagcacccgggaggcagacattgggtatttgttcacaattttgcacctgtaagaaaatgttcctttataactttcaaggattgccgtgagcgtctttggggccttttcattcatgtacaagtttcattcattactattcaacttggtagacttggtgaaaaatgtaaaagcattctgtatttggatcagtcttgggaactaaatttgtcgtgaattggggcctgtcacagattgcctccagtgtgcatcctccacgcagaccctccttgctcagtctccctctggcgcccatggggaagccgtgctgtggttggcagtgcggccatctgggctgccgcaacgtggcagggcaccgtccagcaagactgccccttagtgcagggctaagcaaggaaaagaagaagcccaaaaaggcgggttctttttgatacttgtaattcaggcgtcctccagagtgaaggccactctgcaggcccctggtgagaacctgtctggcttttccactgcgggcccctaaccagtaccctgcccttgtggcccatttgtgcctgggcagatgtttctggccagcagacactgaaggcctttttgctgtgacagtatttatggcactgaagaggataaagaagcttgagccctctttctgactcccactttatggggcagagagagctttttttctacatagcacattgcagtctcaccgctatcagaaaaatatcctgttcatggtttatactgaatttgcaaactactgatatgatttttcaataaccacttgtatcttccatcatccatgagaggtgggaagaggtacactgtatctctgcaataaaactttggccaggttctacctcctctgagcaaaggatacttttctatgtaggtgtagatggttctcctttactaatctgacatggtgcatctggagacaacatctgatgggatccaaagacaacttgaaacaaaggtggatgtcagctcttggtgtgttttcatttggttctcttttttaaatctcccttttgttatcgctcctgttgtagcgtgtccatcagtgtgtgaagggtgcgccctgttccaatgatactgcattgctgcatccagcctttcgtgggagcacggtaccaagcgtccggaattgattatcccaatcatttttgatatgtaactgaaaaatttggtctcatgcaataaaaatgtactggctgcattttagcaaggtttatttactcttgcaagtaaaaacgatcaaccgtgaagcgtaacaaattctgtatttagtttttttttctgttgtggtggtttttgttttgttttttgtttttgtaagattctaaataaattaaatacgagtca

SEQ ID NO: 187018 - DNA, 10981 bp, Homo sapiens
  Payload ID: 16824
  Gene Symbol: SBNO1
  Gene Name: strawberry notch homolog 1 (Drosophila)
  Uniprot ID: A3KN83
  ENST ID: ENST00000420886
  CDS Start-End: 1-4182
atggtggagccagggcaagatttactgcttgctgctttgagtgagagtggaattagtccgaatgacctctttgatattgatggtggagatgcagggcttgcaactccaatgcctaccccgtcagttcagcagtcagtgccacttagtgcattagaactaggtttggagaccgaagcagcagttcctgttaaacaagaaccagagactgtacctactccagcactattaaatgtgaggcagcagcctccatctactacaacatttgtgctgaatcaaataaatcatcttccacccttgggatctacaattgtaatgactaaaacaccacctgtaacaaccaacaggcaaaccatcactttaactaagtttatccagactactgcaagcacacgcccgtcagtctcagcaccaacagtacgaaatgccatgacctctgcaccttcaaaagaccaagttcagcttaaagatctactgaaaaataatagtcttaatgaactgatgaaactaaagccacctgctaatattgctcagccagtagcaacagcagctactgatgtaagcaatggtacagtaaagaaagagtcttctaataaagaaggagctagaatgtggataaacgacatgaagatgaggagtttttccccaaccatgaaggttcctgttgtaaaagaagatgatgaaccagaggaagaagatgaagaagaaatgggtcatgcagaaacctatgcagaatacatgccaataaaattaaaaattggcctacgtcatccagatgctgtagtggaaaccagctctttatccagtgttactcctcctgatgtttggtacaaaacatccatttctgaggaaaccattgataatggctggttatcagcattgcagcttgaggcaattacatatgcagcccagcaacatgaaactttcctacctaatggagatcgtgctggcttcttaataggtgatggtgccggtgtaggaaaaggaaggacgatagcaggaatcatctatgaaaattatttgttgagtagaaaacgagcattgtggtttagtgtttcaaatgacttaaagtatgatgctgaaagagatttaagggatattggagcaaaaaacattttggttcattcgttaaataagtttaaatacggaaaaatttcttccaaacataatgggagtgtgaaaaagggtgttatttttgctacttactcttcacttattggtgaaagccagtctggcggcaagtataaaactaggttaaaacaacttctgcattggtgcggtgatgacttcgatggagtgatagtgtttgatgagtgtcataaagccaaaaacttatgtcctgttggttcttcaaagccaaccaagacaggcttagcagttttagagcttcagaacaaattgccaaaagccagagttgtttatgctagtgcaactggtgcttctgaaccacgcaacatggcctatatgaaccgtcttggcatatggggtgagggtactccatttagagaattcagtgattttattcaagcagtagaacggagaggagttggtgccatggaaatagttgctatggatatgaagcttagaggaatgtacattgctcgacaactgagctttactggagtgaccttcaaaattgaggaagttcttctttctcagagctacgttaaaatgtataacaaagctgtcaagctgtgggtcatcgccagagagcggtttcagcaagctgcagatctgattgatgctgagcaacgaatgaagaagtccatgtggggtcagttctggtctgctcaccagaggttcttcaaatacttatgcatagcatccaaagttaaaagggttgtgcaactagctcgagaggaaatcaagaatggaaaatgtgttgtaattggtctgcagtctacaggagaagctagaacattagaagctttggaagagggcgggggagaattgaatgattttgtttcaactgccaaaggtgtgttgcagtcactcattgaaaaacattttcctgctccagacaggaaaaaactttatagtttactaggaatcgatttgacagctccaagtaacaacagttcgccaagagatagtccttgtaaagaaaataaaataaagaagcggaaaggtgaagaaataactcgagaagccaaaaaagcacgaaaagtaggtggccttactggtagcagttctgacgacagtggaagtgaatctgatgcctctgataatgaagaaagtgactatgagagctctaaaaacatgagttctggagatgatgacgatttcaacccatttttagatgagtctaatgaggatgatgaaaatgatccctggttaattagaaaagaccacaagaaaaacaaagagaaaaaaaagaagaaaagtatagatccagattctattcaaagtgccttattagcatcaggtcttggatcaaaacgacctagtttttcatctacaccagttatctcacctgctcctaacagtacaccagctaacagtaacaccaacagtaacagtagccttataacaagtcaggatgctgtggaaagggctcagcagatgaagaaagacctgcttgataagctagaaaaattagctgaagacctcccccctaataccctggatgaacttatcgatgaacttggtggccctgagaacgttgctgagatgactggccgcaagggacgggttgtgagcaatgatgatggaagcatatcttatgagtcaagatctgaacttgatgtgcctgtggaaatactaaacatcacagaaaaacaacgatttatggatggagataagaatattgctatcatctcagaagctgccagctcgggtatttcattacaagcagataggagagctaaaaatcaaaggcgaagagttcatatgactttagaattaccttggagcgctgatagagcaattcaacagttcggacgtactcatagatcaaaccaagttactgctcctgagtatgtctttctgatatctgaactggcaggagaacaaagatttgcatctattgttgctaaaagacttgagagtttgggggcacttacacatggtgatagaagggcaacagaatctagagatctgagcaggttcaactttgataataagtatggaagaaatgctttagaaattgtcatgaaatccattgtaaacttggattctcctatggtatcaccacctccagactatcctggagaattttttaaagatgttcgacaaggactgataggcgttggcctgataaatgtagaagatcgctcgggaattcttactctcgataaagattataacaacataggaaaattcttaaatagaattttaggcatggaggtgcatcagcagaatgcgttatttcagtattttgcggacacacttactgcagttgttcaaaatgccaaaaaaaatggaagatatgatatgggaatcttagatcttggttctggagatgaaaaagtgcggaaaagtgatgttaaaaagtttctgactccaggatattcaacctctggccacgtagaattatacacaattagtgtagagaggggaatgtcatgggaggaagctaccaagatttgggctgagctgacaggaccagacgatggcttttacttgtcattgcaaataaggaacaacaagaaaactgccatcttagttaaagaagtgaatcctaaaaagaaacttttcttagtttatcgaccaaatactgggaagcagctcaaattagaaatttatgctgatctaaaaaagaaatataagaaggtcgtctcagatgatgccctgatgcactggttagatcagtataattcatctgcagatacttgtactcatgcttattggcgcggcaattgcaaaaaagcaagcttggggctagtttgtgaaataggtcttcgttgccgtacatattatgtattatgtggttcagtgctgagtgtctggacaaaagttgagggtgttctagcatctgtcagtggcacaaacgtgaagatgcagatcgtgcggctaagaacggaagatgggcaacggattgtaggtttgatcattccggcaaattgtgtgtctcctcttgtaaatctcctatcaacttcagaccagtctcaacagcttgcggtccaacagaaacagctatggcaacagcatcaccctcagagcatcaccaacttgagcaacgcatgaagaacagacaggtttcaacatggatggatctgaaatgctgttgaagcatatcatttgcataaaaatcagggacagtttccaaagaattatatatttttttcagttgtgctctctagttagtttttttgggagtaaggacaaacctggaatagatagcaaaactgaaaatcagcagtgctgatggtggtacatatgtctttcctttagcttctcccctgataattcccatctgcttttacttcgggtgagcagagggggatgtgtgtgtgcgtgtgtgtcagtctgtttgtgagtgtgttaaaggctacagaccacagttggtttaaaatgcttggaacttcccaaactggctttactttatgtttatacagtgctcagggttaacgcagtacatccatgccattgctgtgggaggtatccccggatgcatgtgttttgagtctataaatatagaaaatatatattggtttctttttccaacttaataggtttattaaagcatgaaatgaaaggttgcatatcatgcattcaggttattttctaatttttgttctgacagtgcatgtctttggaagcatgctgaaacaagattaacacaggagtcgagtaacagagagaaacatttgttagatgtacagcattggttattgcatttttatagtgtttatacctgggtattgcttcaaaccctgcagacccctccttccccttctccctgccctgggtttctggtcaaggtaatgaatacatacatttttctgtgataaaactcttaaaagttaattttaatgtattaatagtattcctaatgtgtgctgcagaaatggctatgagcctcttaaatttacatttgcaacttaaaggtagttttagaaggaagtacaaattggctttcatcttgcaaacaatcgttttttacttcattatcttaatttgctttgtcactcataaaaaggaaaccatacctgagttgtagacaatgaggaaacacttgaggcttctgctgtgtgttcttttgttattgttgttattgttgttactcagtaacttgaatattgtttaatgtgttgtaagacgtagagtttatctcaagctgttaaaaatggtaatgtacaaatgtgaatagacacttatctatataatatgggtaagttttgtttcgcctataatagatgtttataaaaacaagtgaggggacagttggtctttttatcttttctttctttttctttcttttctttttttctttttttttttttttttttttttttttgcttccacaggttgcactattgaaaaatcgagattgtataaacctggtaaaaagctgcaagatgccaaaatcttgtagatgtcaaataaaaagttattatactaacaagaagtggactcttgtttaggccctcactggtgaccttcagaagtagtctgtgacggggactcagcagaatttgtgtgttgtctcagcattccaggtagccttatagtttggcttaaaacttatccctaaaatgtaagatggcattgagggaaagggtataatgatagtacttctgaatgttttttaagttgaattgtttgtaaacttcttgcagaattgggtgagatgtgtgttaaaactgacaaacctggctgaaagcttagggcgttcatcctcttgtgtctcctttagcctgagtttggttatgtcaagcttaccgtaagttttcttaggatttatttattcttggtgcctaaaagaataaattgaaagtactttctgttctttggcacattttgcccagcggatgcaacttctatcctcagtccagttcatatatctcaggcagtgatccattttgtatcagccagtttcccttgttagggccgctagacccggctggcagccaagagcagcactctccccaccttcagcagaacttctcagctcatgtgtgtgtttttaaaagcagtaggcagcttccatcagcaatggaagtgtcccccactccagtggtggaggtgcagtcgctggacctgaggaagtggggaagcattacaaaccctcctgcagtaagaatggcagagttgggaaggatcttctctcgcaggctgttggcccaactcctcttttctgtgtatgagggcatcttagttttttatggcgttttcaaagcagcatatgaggattcttagcatgcagctaagtgacaacccccatggcctatgatgtaatgtttgctctggactagccatcttgataaataggagtgtatgtatcttaggttctttgtagaacagctatttttttttctcattaaaaaggcctctgaaagccctctcaaaatggacctcacaaaggcaaccagtgtgaatggatgggagctggggtgctgcatgcccaggctggtcatggtgtgtgcagcacccagagagttgcacccaccccttcttcaggtggacatccgacctttacactgtggtcttgcaaaaatcagcgagttagtttggccgccctgtgaagcttcagcattcaaggtcctcttctgttaaaacccaactcgtagccgggcgtggtggctcactcctataatcccagcacttcgggaggccaaggcaggtgcatcacttgaggccaggagttcgagaccagcctggtccacatggcaaaaccccatctgtaccaaaaaatacaaaaaatttgccgctgacttctgtaaaataggtccattcattgcaggatctaaatgccacacctgaattcagaggccttgtttaattaaccccatgtccactttgcctctgcaatgcctttttctttttagcaatatggctctgagcacaaagatttggttggaaatcatgttcgtgttttcagagtttacagcgtcaattgtactgaaaaccacttccagagtctaaagcagctcagatgttatctctgggggaattagtgttcccctcatttagcaacctccataccacaaggtctctgtctgtagttactgggattatccagatacactatcaatgatacaaattcataggagtattaatgcatttctttaaacacaacttgattaagaagcaaatatgttaagcagttttctttttctgctgctaaattacagttagacacttcagtatcttctctttacatgtgtatataaattagtaagaacctgcatccaaagcaatgtagtgtgtgtatgtatctatatatatttattctaactcagcacttcagaagcctttttgagttacaacaatattttagtttgcctcatctgtagaggtaaaatttctatattaccaagctccagaggaatatgatattttacaggcacaattttctggctgtagtccctggggcattcatttgctggcctccatgggatgctgttagaacaattgttagccggcaagagaagaaaggctaccaggacagcatttataattgtagaatgggagccttcttccctctcccctccactttcattttagcatgagataaaaaaatagattggaaatgattgttgcatctcacttcatggaagtaggggcagaagttccctctggatccttttcttgacaagcagtcaagaggaaggtccccatacacatgtacctgtgtgatacttggtagtttctaagaatggtgctacataagcgttgctgttaggctgggatcctattaatgaacgtttgattagttcaggcctcccaatggcaaaggcagacaccgtggagatggacatttactgactccccttctgtgtggcttcggtctccctggctaacaccacacctgtgcgtactgcgctcggcccactttgctgcagaaacgtagcaagcgtttcatgtcagggctacagctgagagcaaaaactgcaaaaaaaaaaaaaaatgtctcattgaatgccagttgtctgatacaaatgcagtgtcttttaagtgacagaaacacacctaaatacctgcaactcaagctcgctagcattttttttttgagtacttgagataaaatccaaaacccaccctctaattttgtgctgtatttatatatatgtacataaatgtatatatagagaaatgttgagttcttctggattctgaatgtaaataattcttgtaaattgggactctgcccacctgtttctcccttttccctcttcccttcagctctatttattcttttcttgactttcccatatggggcatcttatgacttttttttttttttttttttaagaaaagtatggaaaacttttcatttagaaaagtatttgttcctgtattttagaattcagttttgcatctttgctgtagaattcctgttttgtgttaatgttttttactatgtcttattgtgttgtgtgcaatgcattgtactggggggatgcacttgagtgccatttctgatactgtcattgtatgactgctgatgctcgtttatgttgttctttggaagctatagtgagcctgatgttttcacattttaaaaaatgcttcctgagacttctttaagctcctctaacttcttcagtgcatttgggatcaaacttagctcttagatcagcaaacctgacttgcttctacttttgcaatttttcaggccttaccatatttcttatctctgtcttcccacctgataggaaaatcttgcagatttgaaacagtggtttctggcctgctgctgcagcaaattccctatgtttatttaagaagtcgggcctatgcttttaacctacaaatgatgagtaatttacttgcaatgaacacaggtagcctgctgctgtttataacctgttgaggatatttatagcaggcaggaggcaggcctagtgtgttattgacaggtgactttagagaatgtacattggccgggtgcggtggctcacgcctgtaatcccagcactttgggaggccgaggcgggcggatcatgaggtcaggagattgagaccatctcctggctaacacggtgaaaccccgtctctactaaaaatacaaaaaaaaaaaaaacttagccaggcgtggtggcgggtgcctgtagtcccagctactcaggaggctgaggcaggagaatggcatgaacctgggaggcagagcttgcagtgagcccagatcgcgccactgcactccagcctgggcaacagaccgagactccgtctcgaaaaaaaaaaaagagagagaatgtacattaaggaacaattgtcctccaaaagagagccaagcaactgctctggagcctcctaggctgactctgctggagggtgagacaagcagattcccattgcagcactggtccctggggtaccctgaacggctgtgctctccacccttgtatcggtgagtggatcttgtctacatcagccgtaagcctagaagcagagcgggatcgaggcgtttttaataattcgagttgggaagacccggatggttcatcaaaatgatggtgttgagcacccgggaggcagacattgggtatttgttcacaattttgcacctgtaagaaaatgttcctttataactttcaaggattgccgtgagcgtctttggggccttttcattcatgtacaagtttcattcattactattcaacttggtagacttggtgaaaaatgtaaaagcattctgtatttggatcagtcttgggaactaaatttgtcgtgaattggggcctgtcacagattgcctccagtgtgcatcctccacgcagaccctccttgctcagtctccctctggcgcccatggggaagccgtgctgtggttggcagtgcggccatctgggctgccgcaacgtggcagggcaccgtccagcaagactgccccttagtgcagggctaagcaaggaaaagaagaagcccaaaaaggcgggttctttttgatacttgtaattcaggcgtcctccagagtgaaggccactctgcaggcccctggtgagaacctgtctggcttttccactgcgggcccctaaccagtaccctgcccttgtggcccatttgtgcctgggcagatgtttctggccagcagacactgaaggcctttttgctgtgacagtatttatggcactgaagaggataaagaagcttgagccctctttctgactcccactttatggggcagagagagctttttttctacatagcacattgcagtctcaccgctatcagaaaaatatcctgttcatggtttatactgaatttgcaaactactgatatgatttttcaataaccacttgtatcttccatcatccatgagaggtgggaagaggtacactgtatctctgcaataaaactttggccaggttctacctcctctgagcaaaggatacttttctatgtaggtgtagatggttctcctttactaatctgacatggtgcatctggagacaacatctgatgggatccaaagacaacttgaaacaaaggtggatgtcagctcttggtgtgttttcatttggttctcttttttaaatctcccttttgttatcgctcctgttgtagcgtgtccatcagtgtgtgaagggtgcgccctgttccaatgatactgcattgctgcatccagcctttcgtgggagcacggtaccaagcgtccggaattgattatcccaatcatttttgatatgtaactgaaaaatttggtctcatgcaataaaaatgtactggctgcattttagcaaggtttatttactcttgcaagtaaaaacgatcaaccgtgaagcgtaacaaattctgtatttagtttttttttctgttgtggtggtttttgttttgttttttgtttttgtaagattctaaataaattaaatacgagtca

SEQ ID NO: 187019 - DNA, 4313 bp, Homo sapiens
  Payload ID: 16824
  Gene Symbol: SBNO1
  Gene Name: strawberry notch homolog 1 (Drosophila)
  Uniprot ID: A3KN83
  ENST ID: ENST00000602398
  CDS Start-End: 129-4310
cggggaggtaggcagagcaggacgccgctgctgccgccgccaccgccgcctccgctccagtcgcctctggtccttcaaactcacacctcccgggaggagctgtgctggcgccgggtcccgcggggaaaatggtggagccagggcaagatttactgcttgctgctttgagtgagagtggaattagtccgaatgacctctttgatattgatggtggagatgcagggcttgcaactccaatgcctaccccgtcagttcagcagtcagtgccacttagtgcattagaactaggtttggagaccgaagcagcagttcctgttaaacaagaaccagagactgtacctactccagcactattaaatgtgaggcagcagcctccatctactacaacatttgtgctgaatcaaataaatcatcttccacccttgggatctacaattgtaatgactaaaacaccacctgtaacaaccaacaggcaaaccatcactttaactaagtttatccagactactgcaagcacacgcccgtcagtctcagcaccaacagtacgaaatgccatgacctctgcaccttcaaaagaccaagttcagcttaaagatctactgaaaaataatagtcttaatgaactgatgaaactaaagccacctgctaatattgctcagccagtagcaacagcagctactgatgtaagcaatggtacagtaaagaaagagtcttctaataaagaaggagctagaatgtggataaacgacatgaagatgaggagtttttccccaaccatgaaggttcctgttgtaaaagaagatgatgaaccagaggaagaagatgaagaagaaatgggtcatgcagaaacctatgcagaatacatgccaataaaattaaaaattggcctacgtcatccagatgctgtagtggaaaccagctctttatccagtgttactcctcctgatgtttggtacaaaacatccatttctgaggaaaccattgataatggctggttatcagcattgcagcttgaggcaattacatatgcagcccagcaacatgaaactttcctacctaatggagatcgtgctggcttcttaataggtgatggtgccggtgtaggaaaaggaaggacgatagcaggaatcatctatgaaaattatttgttgagtagaaaacgagcattgtggtttagtgtttcaaatgacttaaagtatgatgctgaaagagatttaagggatattggagcaaaaaacattttggttcattcgttaaataagtttaaatacggaaaaatttcttccaaacataatgggagtgtgaaaaagggtgttatttttgctacttactcttcacttattggtgaaagccagtctggcggcaagtataaaactaggttaaaacaacttctgcattggtgcggtgatgacttcgatggagtgatagtgtttgatgagtgtcataaagccaaaaacttatgtcctgttggttcttcaaagccaaccaagacaggcttagcagttttagagcttcagaacaaattgccaaaagccagagttgtttatgctagtgcaactggtgcttctgaaccacgcaacatggcctatatgaaccgtcttggcatatggggtgagggtactccatttagagaattcagtgattttattcaagcagtagaacggagaggagttggtgccatggaaatagttgctatggatatgaagcttagaggaatgtacattgctcgacaactgagctttactggagtgaccttcaaaattgaggaagttcttctttctcagagctacgttaaaatgtataacaaagctgtcaagctgtgggtcatcgccagagagcggtttcagcaagctgcagatctgattgatgctgagcaacgaatgaagaagtccatgtggggtcagttctggtctgctcaccagaggttcttcaaatacttatgcatagcatccaaagttaaaagggttgtgcaactagctcgagaggaaatcaagaatggaaaatgtgttgtaattggtctgcagtctacaggagaagctagaacattagaagctttggaagagggcgggggagaattgaatgattttgtttcaactgccaaaggtgtgttgcagtcactcattgaaaaacattttcctgctccagacaggaaaaaactttatagtttactaggaatcgatttgacagctccaagtaacaacagttcgccaagagatagtccttgtaaagaaaataaaataaagaagcggaaaggtgaagaaataactcgagaagccaaaaaagcacgaaaagtaggtggccttactggtagcagttctgacgacagtggaagtgaatctgatgcctctgataatgaagaaagtgactatgagagctctaaaaacatgagttctggagatgatgacgatttcaacccatttttagatgagtctaatgaggatgatgaaaatgatccctggttaattagaaaagaccacaagaaaaacaaagagaaaaaaaagaagaaaagtatagatccagattctattcaaagtgccttattagcatcaggtcttggatcaaaacgacctagtttttcatctacaccagttatctcacctgctcctaacagtacaccagctaacagtaacaccaacagtaacagtagccttataacaagtcaggatgctgtggaaagggctcagcagatgaagaaagacctgcttgataagctagaaaaattagctgaagacctcccccctaataccctggatgaacttatcgatgaacttggtggccctgagaacgttgctgagatgactggccgcaagggacgggttgtgagcaatgatgatggaagcatatcttatgagtcaagatctgaacttgatgtgcctgtggaaatactaaacatcacagaaaaacaacgatttatggatggagataagaatattgctatcatctcagaagctgccagctcgggtatttcattacaagcagataggagagctaaaaatcaaaggcgaagagttcatatgactttagaattaccttggagcgctgatagagcaattcaacagttcggacgtactcatagatcaaaccaagttactgctcctgagtatgtctttctgatatctgaactggcaggagaacaaagatttgcatctattgttgctaaaagacttgagagtttgggggcacttacacatggtgatagaagggcaacagaatctagagatctgagcaggttcaactttgataataagtatggaagaaatgctttagaaattgtcatgaaatccattgtaaacttggattctcctatggtatcaccacctccagactatcctggagaattttttaaagatgttcgacaaggactgataggcgttggcctgataaatgtagaagatcgctcgggaattcttactctcgataaagattataacaacataggaaaattcttaaatagaattttaggcatggaggtgcatcagcagaatgcgttatttcagtattttgcggacacacttactgcagttgttcaaaatgccaaaaaaaatggaagatatgatatgggaatcttagatcttggttctggagatgaaaaagtgcggaaaagtgatgttaaaaagtttctgactccaggatattcaacctctggccacgtagaattatacacaattagtgtagagaggggaatgtcatgggaggaagctaccaagatttgggctgagctgacaggaccagacgatggcttttacttgtcattgcaaataaggaacaacaagaaaactgccatcttagttaaagaagtgaatcctaaaaagaaacttttcttagtttatcgaccaaatactgggaagcagctcaaattagaaatttatgctgatctaaaaaagaaatataagaaggtcgtctcagatgatgccctgatgcactggttagatcagtataattcatctgcagatacttgtactcatgcttattggcgcggcaattgcaaaaaagcaagcttggggctagtttgtgaaataggtcttcgttgccgtacatattatgtattatgtggttcagtgctgagtgtctggacaaaagttgagggtgttctagcatctgtcagtggcacaaacgtgaagatgcagatcgtgcggctaagaacggaagatgggcaacggattgtaggtttgatcattccggcaaattgtgtgtctcctcttgtaaatctcctatcaacttcagaccagtctcaacagcttgcggtccaacagaaacagctatggcaacagcatcaccctcagagcatcaccaacttgagcaacgcatgaaga

SEQ ID NO: 187020 - DNA, 4923 bp, Homo sapiens
  Payload ID: 16825
  Gene Symbol: SBNO2
  Gene Name: strawberry notch homolog 2 (Drosophila)
  Uniprot ID: Q9Y2G9
  ENST ID: ENST00000361757
  CDS Start-End: 239-4339
gtgcgcggggcccccaagatggcgcccgaaacccggaagtgagcggcggcagctgcgaggctcggagaaacaggcgccgcgggctccgcgcccggccggacccgggcccgagatcatgatgctgccgccaccgccgccaccacggagcgagaagcccagatagacgccccggcggccccgggtcctggagtcccgccgcctgctgcccggccgaggaccccaccccgcctgccgcccgatgcttgcagtggggcccgccatggacagggattacccgcagcatgaacccccgccggcgggcagcctcctgtacagcccgccgcccctgcagagcgccatgctgcactgcccctactggaacaccttctcgctgccgccataccctgccttctccagcgacagccgcccgttcatgagctccgcctccttcctcggcagccagccctgcccagacaccagctatgcccccgtggccaccgcctccagcttgccaccaaagacctgcgactttgctcaggactcctcctattttgaggacttctccaacatctccatcttctcctcgtccgtggactccctgtcggacatcgtggacacgcccgacttcctgccggctgacagcctcaaccaggtgtccaccatctgggacgataaccctgccccctccacccacgataagctgttccagctcagcaggccgtttgcaggcttcgaggactttctgccctcccacagcaccccgcttctcgtcagctaccaggagcagagtgtgcagagccagccagaggaggaggacgaggctgaggaggaggaggcggaggagctggggcacacagagacctacgccgactacgtgccgtccaagtccaagatcgggaagcagcacccagaccgcgtggtggagaccagcacactgtccagcgtcccacccccagacatcacctacaccctggccctgccctcggacagcggggccctgtctgccctgcagctagaggccatcacctacgcctgccagcaacacgaggtcctgctccccagcgggcagcgcgcgggctttctcatcggcgatggggccggcgtgggcaaaggccggacggtggccggagtcatcctggagaaccacctgcgcggccggaagaaagcattgtggttcagcgtctccaacgacctcaagtacgatgcggagcgcgacctgcgggacatcgaagccacgggcatcgcggtgcacgcgctcagcaagatcaagtacggtgacaccactacctcagagggcgtcctcttcgccacctactccgccctgattggggagagccaggccggcggccagcaccgcactcgcctccggcagatcctggactggtgtggggaggccttcgagggcgtcatcgtgttcgacgagtgtcacaaagccaagaatgccggctccaccaagatgggcaaggctgtgctagacctgcagaacaagctgcccctggcccgcgtggtctacgccagcgccacaggtgcctctgagcctcggaacatgatctacatgagccgcttgggtatctggggcgagggcacacccttccggaactttgaggagttcctgcacgccatcgagaagaggggcgttggcgccatggagatcgtggccatggacatgaaggtcagcggcatgtacatcgcacgccagctcagcttctccggcgtcaccttccgcatcgaggagatcccgctggccccagccttcgagtgcgtctacaaccgcgcggccctgctgtgggccgaggccctgaacgtgttccagcaggcggccgactggatcggcctggagtcgcgcaagtccctgtggggccagttctggtcggcacaccagcgcttcttcaagtatctgtgcatcgcagccaaggtgcgccggctggtggagctggcccgagaggagctggcgcgagacaagtgcgtggtcatcgggctgcagtccacgggcgaggcgcgcacgcgggaggtgctgggggagaacgatgggcacctcaactgcttcgtctcggccgctgaaggcgtgttcctgtcgctaattcagaagcactttccgtccaccaagagaaagcgggacagaggagcgggcagcaagcggaaacggcgacctcggggacgcggggccaaagccccccggctggcgtgcgagacagcgggcgtcatccgcatcagtgacgacagcagcacggagtcggaccctggcctggacagcgacttcaactcctcccccgagtccctggtggatgacgacgttgtcatcgttgatgcagtcgggctccccagtgacgaccggggacccctgtgcctcctgcagagagacccgcatggccccggggtcctggagcgggtggagcggctgaagcaggatctgctggacaaagtgcggcggctgggccgggaactgccagtcaacaccctggacgagctcatcgaccagctgggcggcccccagcgggtggcggagatgaccggcaggaaaggccgcgtggtgtccaggcccgacgggacggtggccttcgagtcgcgggcagagcagggtctgtccatcgaccacgtgaacctcagggagaagcagcgcttcatgagcggcgagaagctcgtggccatcatctcggaggcctccagctcgggtgtctccctccaagccgaccgccgtgtccagaaccagcggcgccgcgtgcacatgaccttggagctgccgtggagcgccgaccgcgccatccagcagttcggccgcacccaccggtccaaccaggtctccgcgccagagtatgtcttcctcatctcggagctggccggggagcgccggttcgcctccatcgtggccaagcgcctggagagtctgggggccctgacccacggagaccgccgcgccacggagtcccgtgacctcagcaagtacaactttgagaacaagtatggcacccgggccctgcactgtgtcctcaccaccatcctgagccagactgagaacaaagtgcctgtgccccagggataccctggaggggtccccaccttcttccgggacatgaagcagggcctgctgtctgtgggcattggtggccgggagtcccggaatggctgcctggacgtggagaaggactgttccatcaccaagttcctgaaccgcatcctggggctggaggtgcacaagcagaacgccctgttccagtacttctcagacaccttcgaccacctcatcgagatggacaagcgggagggcaaatacgacatgggcatcctggaccttgctcccggtatcgaggagatctacgaggagagccagcaggtgttcctggctcccgggcacccgcaggacgggcaggtggtcttctacaagatcagcgtggaccgcggcctgaagtgggaggacgcctttgccaagtcgctggcgctgacgggcccctatgacggcttctacctctcctacaaggtccgcggtaacaagcccagctgcctgctggcggagcagaaccgcggccagttcttcacggtgtacaagcccaacatcggccggcagagccagctggaggccctggacagcctccgccgcaagttccaccgggtcaccgcggaggaggccaaggagccctgggagagtggctacgctttgtcgctgacgcactgcagccacagcgcctggaaccggcactgccggctggcgcaggagggtaaggactgcctgcaggggctgcggctgcggcaccactacatgctgtgcggcgcgctgctgcgcgtgtggggccgcatcgccgccgtcatggccgacgtcagcagcagcagctacctgcagatcgtgcggctgaagaccaaggacaggaagaagcaagtgggcatcaagatccccgagggctgcgtgcgccgggtgctgcaggagctgcggctgatggatgcggacgtgaagcgcaggcaggcgcccgccctgggctgccccgccccgcccgccccgcgcccgctggcgctgccttgcggccccggagaggtgctggacctcacctacagccccccggccgaggccttcccgccgcccccgcacttctctttcccggcgccgctgtccctggacgccggccccggcgtcgtgccgctgggcacccccgacgcccaggccgaccctgcggccctcgcgcaccagggctgcgacatcaacttcaaggaggtgctggaggacatgctgcgctcgctgcacgcggggccgccctccgagggcgcgctgggggagggcgcgggggcggggggcgcggcgggcggtggtcccgagcggcagagcgtgatccagttcagcccacccttccccggcgcccaggctcctctctgacacgcctttaggcgaaacatgccccaagacacagggaccgtttctcccctaggagcagcggtggggagcagggccaaggtcccctgaccactgctcagaggagccctaggccctggccgcagtgccttcagcgcccgacccgggcccccacctggtcagccctggcggggcccactcaggacagctgggggccggggcgtggcagggccctctctgtgcctctcctcccaagtaggaaggggctccgggtggctgctctgggactgggcacccacaagggctcagtgggcccaaacccttgaaatccgtgaaaccgggtggtcccaagagctagaaactcaggaaaccccaggtgctcagggccccgcgtctcgggggctccgtggggcagacccctgctaatatatgcaattctccctcccccagcccttccctgacccctaagttattgcccgctcacctctcccaggccccaggccgcggagctggcagggtggcgcctgcggtttctatgtatttatagcaagttctgatgtacatatgtaaaggacttttttaaatatatgtgccttttgcctacttcc

SEQ ID NO: 187021 - DNA, 4537 bp, Homo sapiens
  Payload ID: 16825
  Gene Symbol: SBNO2
  Gene Name: strawberry notch homolog 2 (Drosophila)
  Uniprot ID: Q9Y2G9
  ENST ID: ENST00000438103
  CDS Start-End: 25-3954
aatgctggggctgctgccgcggtcatgagggagccgctcccgggcagcgcttcctgggggacccctggccccccgagcgccgggaccatgtcccagctgcagctgtggctgcagtttgaggctctgaacaaggactcctcctattttgaggacttctccaacatctccatcttctcctcgtccgtggactccctgtcggacatcgtggacacgcccgacttcctgccggctgacagcctcaaccaggtgtccaccatctgggacgataaccctgccccctccacccacgataagctgttccagctcagcaggccgtttgcaggcttcgaggactttctgccctcccacagcaccccgcttctcgtcagctaccaggagcagagtgtgcagagccagccagaggaggaggacgaggctgaggaggaggaggcggaggagctggggcacacagagacctacgccgactacgtgccgtccaagtccaagatcgggaagcagcacccagaccgcgtggtggagaccagcacactgtccagcgtcccacccccagacatcacctacaccctggccctgccctcggacagcggggccctgtctgccctgcagctagaggccatcacctacgcctgccagcaacacgaggtcctgctccccagcgggcagcgcgcgggctttctcatcggcgatggggccggcgtgggcaaaggccggacggtggccggagtcatcctggagaaccacctgcgcggccggaagaaagcattgtggttcagcgtctccaacgacctcaagtacgatgcggagcgcgacctgcgggacatcgaagccacgggcatcgcggtgcacgcgctcagcaagatcaagtacggtgacaccactacctcagagggcgtcctcttcgccacctactccgccctgattggggagagccaggccggcggccagcaccgcactcgcctccggcagatcctggactggtgtggggaggccttcgagggcgtcatcgtgttcgacgagtgtcacaaagccaagaatgccggctccaccaagatgggcaaggctgtgctagacctgcagaacaagctgcccctggcccgcgtggtctacgccagcgccacaggtgcctctgagcctcggaacatgatctacatgagccgcttgggtatctggggcgagggcacacccttccggaactttgaggagttcctgcacgccatcgagaagaggggcgttggcgccatggagatcgtggccatggacatgaaggtcagcggcatgtacatcgcacgccagctcagcttctccggcgtcaccttccgcatcgaggagatcccgctggccccagccttcgagtgcgtctacaaccgcgcggccctgctgtgggccgaggccctgaacgtgttccagcaggcggccgactggatcggcctggagtcgcgcaagtccctgtggggccagttctggtcggcacaccagcgcttcttcaagtatctgtgcatcgcagccaaggtgcgccggctggtggagctggcccgagaggagctggcgcgagacaagtgcgtggtcatcgggctgcagtccacgggcgaggcgcgcacgcgggaggtgctgggggagaacgatgggcacctcaactgcttcgtctcggccgctgaaggcgtgttcctgtcgctaattcagaagcactttccgtccaccaagagaaagcgggacagaggagcgggcagcaagcggaaacggcgacctcggggacgcggggccaaagccccccggctggcgtgcgagacagcgggcgtcatccgcatcagtgacgacagcagcacggagtcggaccctggcctggacagcgacttcaactcctcccccgagtccctggtggatgacgacgttgtcatcgttgatgcagtcgggctccccagtgacgaccggggacccctgtgcctcctgcagagagacccgcatggccccggggtcctggagcgggtggagcggctgaagcaggatctgctggacaaagtgcggcggctgggccgggaactgccagtcaacaccctggacgagctcatcgaccagctgggcggcccccagcgggtggcggagatgaccggcaggaaaggccgcgtggtgtccaggcccgacgggacggtggccttcgagtcgcgggcagagcagggtctgtccatcgaccacgtgaacctcagggagaagcagcgcttcatgagcggcgagaagctcgtggccatcatctcggaggcctccagctcgggtgtctccctccaagccgaccgccgtgtccagaaccagcggcgccgcgtgcacatgaccttggagctgccgtggagcgccgaccgcgccatccagcagttcggccgcacccaccggtccaaccaggtctccgcgccagagtatgtcttcctcatctcggagctggccggggagcgccggttcgcctccatcgtggccaagcgcctggagagtctgggggccctgacccacggagaccgccgcgccacggagtcccgtgacctcagcaagtacaactttgagaacaagtatggcacccgggccctgcactgtgtcctcaccaccatcctgagccagactgagaacaaagtgcctgtgccccagggataccctggaggggtccccaccttcttccgggacatgaagcagggcctgctgtctgtgggcattggtggccgggagtcccggaatggctgcctggacgtggagaaggactgttccatcaccaagttcctgaaccgcatcctggggctggaggtgcacaagcagaacgccctgttccagtacttctcagacaccttcgaccacctcatcgagatggacaagcgggagggcaaatacgacatgggcatcctggaccttgctcccggtatcgaggagatctacgaggagagccagcaggtgttcctggctcccgggcacccgcaggacgggcaggtggtcttctacaagatcagcgtggaccgcggcctgaagtgggaggacgcctttgccaagtcgctggcgctgacgggcccctatgacggcttctacctctcctacaaggtccgcggtaacaagcccagctgcctgctggcggagcagaaccgcggccagttcttcacggtgtacaagcccaacatcggccggcagagccagctggaggccctggacagcctccgccgcaagttccaccgggtcaccgcggaggaggccaaggagccctgggagagtggctacgctttgtcgctgacgcactgcagccacagcgcctggaaccggcactgccggctggcgcaggagggtaaggactgcctgcaggggctgcggctgcggcaccactacatgctgtgcggcgcgctgctgcgcgtgtggggccgcatcgccgccgtcatggccgacgtcagcagcagcagctacctgcagatcgtgcggctgaagaccaaggacaggaagaagcaagtgggcatcaagatccccgagggctgcgtgcgccgggtgctgcaggagctgcggctgatggatgcggacgtgaagcgcaggcaggcgcccgccctgggctgccccgccccgcccgccccgcgcccgctggcgctgccttgcggccccggagaggtgctggacctcacctacagccccccggccgaggccttcccgccgcccccgcacttctctttcccggcgccgctgtccctggacgccggccccggcgtcgtgccgctgggcacccccgacgcccaggccgaccctgcggccctcgcgcaccagggctgcgacatcaacttcaaggaggtgctggaggacatgctgcgctcgctgcacgcggggccgccctccgagggcgcgctgggggagggcgcgggggcggggggcgcggcgggcggtggtcccgagcggcagagcgtgatccagttcagcccacccttccccggcgcccaggctcctctctgacacgcctttaggcgaaacatgccccaagacacagggaccgtttctcccctaggagcagcggtggggagcagggccaaggtcccctgaccactgctcagaggagccctaggccctggccgcagtgccttcagcgcccgacccgggcccccacctggtcagccctggcggggcccactcaggacagctgggggccggggcgtggcagggccctctctgtgcctctcctcccaagtaggaaggggctccgggtggctgctctgggactgggcacccacaagggctcagtgggcccaaacccttgaaatccgtgaaaccgggtggtcccaagagctagaaactcaggaaaccccaggtgctcagggccccgcgtctcgggggctccgtggggcagacccctgctaatatatgcaattctccctcccccagcccttccctgacccctaagttattgcccgctcacctctcccaggccccaggccgcggagctggcagggtggcgcctgcggtttctatgtatttatagcaagttctgatgtacatatgtaaaggacttttttaaatatatgtgccttttgcctacttc

SEQ ID NO: 187022 - DNA, 561 bp, Homo sapiens
  Payload ID: 16825
  Gene Symbol: SBNO2
  Gene Name: strawberry notch homolog 2 (Drosophila)
  ENST ID: ENST00000590176
  CDS Start-End: 178-561
actcatcggtgcccccgagccccttggtgaccccgcacccgcttttcctcgatcatgatgctgccgccaccgccgccaccacggagcgagaagcccagatagacgccccggcggccccgggtcctggagtcccgccgcctgctgcccggccgaggaccccaccccgcctgccgcccgatgcttgcagtggggcccgccatggacagggattacccgcagcatgaacccccgccggcgggcagcctcctgtacagcccgccgcccctgcagagcgccatgctgcactgcccctactggaacaccttctcgctgccgccataccctgccttctccagcgacagccgcccgttcatgagctccgcctccttcctcggcagccagccctgcccagacaccagctatgcccccgtggccaccgcctccagcttgccaccaaagacctgcgactttgctcaggactcctcctattttgaggacttctccaacatctccatcttctcctcgtccgtggactccctgtcggacatcgtggacacgcccgacttcctgccggctgacagc

SEQ ID NO: 187023 - DNA, 914 bp, Homo sapiens
  Payload ID: 16825
  Gene Symbol: SBNO2
  Gene Name: strawberry notch homolog 2 (Drosophila)
  ENST ID: ENST00000587655
  CDS Start-End: 580-914
gcagatcggactggcgggcctggtgccgctgtctcagtgacctgctttgtgactcgtgcccgtgcttcccggagccttgtgattgacctccatccccagcaagaacaagcgtccaagtgaaaccgaaagaggcggccttggccttggttccaggccccgctgcgttttgaaagtgatgtgcgccaggttccggaaggcggctcactcgcgtttcctgggagtctctgccgctgtgggctcctggggccaaggccctgggtgctggggcgtggggagggggagccggtgagccttcgggcctggcgggcagtaaacgtttctggaactgactcacttgctggggaggggcagccagggagggtcacggagaaagtccctgcccgccatggccccggaccgccgtcggctgcccgtccagcctggagtgaggaggcgtcttcctttgcatgtcagatcatgatgctgccgccaccgccgccaccacggagcgagaagcccagatagacgccccggcggccccgggtcctggagtcccgccgcctgctgcccggccgaggaccccaccccgcctgccgcccgatgcttgcagtggggcccgccatggacagggattacccgcagcatgaacccccgccggcgggcagcctcctgtacagcccgccgcccctgcagagcgccatgctgcactgcccctactggaacaccttctcgctgccgccataccctgccttctccagcgacagccgcccgttcatgagctccgcctccttcctcggcagccagccctgcccagacaccagctatgcccccgtggccaccgcctccagcttgccaccaaagacctgcgactttgctcaggactcctcctattttgaggacttctccaacatctccatcttctcctcgtccgtgga

SEQ ID NO: 187024 - DNA, 4861 bp, Homo sapiens
  Payload ID: 16825
  Gene Symbol: SBNO2
  Gene Name: strawberry notch homolog 2 (Drosophila)
  ENST ID: ENST00000587024
  CDS Start-End: 212-4282
gaaacccggaagtgagcggcggcagctgcgaggctcggagaaacaggcgccgcgggctccgcgcccggccggacccgggcccgagatcatgatgctgccgccaccgccgccaccacggagcgagaagcccagatagacgccccggcggccccgggtcctggagtcccgccgcctgctgcccggccgaggaccccaccccgcctgccgcccgatgcttgcagtggggcccgccatggacagggattacccgcagcatgaacccccgccggcgggcagcctcctgtacagcccgccgcccctgcagagcgccatgctgcactgcccctactggaacaccttctcgctgccgccataccctgccttctccagcgacagccgcccgttcatgagctccgcctccttcctcggcagccagccctgcccagacaccagctatgcccccgtggccaccgcctccagcttgccaccaaagacctgcgactttgctcaggactcctcctattttgaggacttctccaacatctccatcttctcctcgtccgtggactccctgtcggacatcgtggacacgcccgacttcctgccggctgacagcctcaaccaggtgtccaccatctgggacgataaccctgccccctccacccacgataagctgttccagctcagcaggccgtttgcaggcttcgaggactttctgccctcccacagcaccccgcttctcgtcagctaccaggagcagagtgtgcagagccagccagaggaggaggacgaggctgaggaggaggaggcggaggagctggggcacacagagacctacgccgactacgtgccgtccaagtccaagatcgggaagcagcacccagaccgcgtggtggagaccagcacactgtccagcgtcccacccccagacatcacctacaccctggccctgccctcggacagcggggccctgtctgccctgcagctagaggccatcacctacgcctgccagcaacacgaggtcctgctccccagcgggcagcgcgcgggctttctcatcggcgatggggccggcgtgggcaaaggccggacggtggccggagtcatcctggagaaccacctgcgcggccggaagaaagcattgtggttcagcgtctccaacgacctcaagtacgatgcggagcgcgacctgcgggacatcgaagccacgggcatcgcggtgcacgcgctcagcaagatcaagtacggtgacaccactacctcagagggcgtcctcttcgccacctactccgccctgattggggagagccaggccggcggccagcaccgcactcgcctccggcagatcctggactggtgtggggaggccttcgagggcgtcatcgtgttcgacgagtgtcacaaagccaagaatgccggctccaccaagatgggcaaggctgtgctagacctgcagaacaagctgcccctggcccgcgtggtctacgccagcgccacaggtgcctctgagcctcggaacatgatctacatgagccgcttgggtatctggggcgagggcacacccttccggaactttgaggagttcctgcacgccatcgagaagaggggcgttggcgccatggagatcgtggccatggacatgaaggtcagcggcatgtacatcgcacgccagctcagcttctccggcgtcaccttccgcatcgaggagatcccgctggccccagccttcgagtgcgtctacaaccgcgcggccctgctggcggccgactggatcggcctggagtcgcgcaagtccctgtggggccagttctggtcggcacaccagcgcttcttcaagtatctgtgcatcgcagccaaggtgcgccggctggtggagctggcccgagaggagctggcgcgagacaagtgcgtggtcatcgggctgcagtccacgggcgaggcgcgcacgcgggaggtgctgggggagaacgatgggcacctcaactgcttcgtctcggccgctgaaggcgtgttcctgtcgctaattcagaagcactttccgtccaccaagagaaagcgggacagaggagcgggcagcaagcggaaacggcgacctcggggacgcggggccaaagccccccggctggcgtgcgagacagcgggcgtcatccgcatcagtgacgacagcagcacggagtcggaccctggcctggacagcgacttcaactcctcccccgagtccctggtggatgacgacgttgtcatcgttgatgcagtcgggctccccagtgacgaccggggacccctgtgcctcctgcagagagacccgcatggccccggggtcctggagcgggtggagcggctgaagcaggatctgctggacaaagtgcggcggctgggccgggaactgccagtcaacaccctggacgagctcatcgaccagctgggcggcccccagcgggtggcggagatgaccggcaggaaaggccgcgtggtgtccaggcccgacgggacggtggccttcgagtcgcgggcagagcagggtctgtccatcgaccacgtgaacctcagggagaagcagcgcttcatgagcggcgagaagctcgtggccatcatctcggaggcctccagctcgggtgtctccctccaagccgaccgccgtgtccagaaccagcggcgccgcgtgcacatgaccttggagctgccgtggagcgccgaccgcgccatccagcagttcggccgcacccaccggtccaaccaggtctccgcgccagagtatgtcttcctcatctcggagctggccggggagcgccggttcgcctccatcgtggccaagcgcctggagagtctgggggccctgacccacggagaccgccgcgccacggagtcccgtgacctcagcaagtacaactttgagaacaagtatggcacccgggccctgcactgtgtcctcaccaccatcctgagccagactgagaacaaagtgcctgtgccccagggataccctggaggggtccccaccttcttccgggacatgaagcagggcctgctgtctgtgggcattggtggccgggagtcccggaatggctgcctggacgtggagaaggactgttccatcaccaagttcctgaaccgcatcctggggctggaggtgcacaagcagaacgccctgttccagtacttctcagacaccttcgaccacctcatcgagatggacaagcgggagggcaaatacgacatgggcatcctggaccttgctcccggtatcgaggagatctacgaggagagccagcaggtgttcctggctcccgggcacccgcaggacgggcaggtggtcttctacaagatcagcgtggaccgcggcctgaagtgggaggacgcctttgccaagtcgctggcgctgacgggcccctatgacggcttctacctctcctacaaggtccgcggtaacaagcccagctgcctgctggcggagcagaaccgcggccagttcttcacggtgtacaagcccaacatcggccggcagagccagctggaggccctggacagcctccgccgcaagttccaccgggtcaccgcggaggaggccaaggagccctgggagagtggctacgctttgtcgctgacgcactgcagccacagcgcctggaaccggcactgccggctggcgcaggagggtaaggactgcctgcaggggctgcggctgcggcaccactacatgctgtgcggcgcgctgctgcgcgtgtggggccgcatcgccgccgtcatggccgacgtcagcagcagcagctacctgcagatcgtgcggctgaagaccaaggacaggaagaagcaagtgggcatcaagatccccgagggctgcgtgcgccgggtgctgcaggagctgcggctgatggatgcggacgtgaagcgcaggcaggcgcccgccctgggctgccccgccccgcccgccccgcgcccgctggcgctgccttgcggccccggagaggtgctggacctcacctacagccccccggccgaggccttcccgccgcccccgcacttctctttcccggcgccgctgtccctggacgccggccccggcgtcgtgccgctgggcacccccgacgcccaggccgaccctgcggccctcgcgcaccagggctgcgacatcaacttcaaggaggtgctggaggacatgctgcgctcgctgcacgcggggccgccctccgagggcgcgctgggggagggcgcgggggcggggggcgcggcgggcggtggtcccgagcggcagagcgtgatccagttcagcccacccttccccggcgcccaggctcctctctgacacgcctttaggcgaaacatgccccaagacacagggaccgtttctcccctaggagcagcggtggggagcagggccaaggtcccctgaccactgctcagaggagccctaggccctggccgcagtgccttcagcgcccgacccgggcccccacctggtcagccctggcggggcccactcaggacagctgggggccggggcgtggcagggccctctctgtgcctctcctcccaagtaggaaggggctccgggtggctgctctgggactgggcacccacaagggctcagtgggcccaaacccttgaaatccgtgaaaccgggtggtcccaagagctagaaactcaggaaaccccaggtgctcagggccccgcgtctcgggggctccgtggggcagacccctgctaatatatgcaattctccctcccccagcccttccctgacccctaagttattgcccgctcacctctcccaggccccaggccgcggagctggcagggtggcgcctgcggtttctatgtatttatagcaagttctgatgtacatatgtaaaggacttttttaaatatatgtgccttttgccta

SEQ ID NO: 187025 - DNA, 562 bp, Homo sapiens
  Payload ID: 16825
  Gene Symbol: SBNO2
  Gene Name: strawberry notch homolog 2 (Drosophila)
  ENST ID: ENST00000590998
  CDS Start-End: 178-562
ggaaagctttccctgccaccacgggccagcctgggtccctgcactcgccagatcatgatgctgccgccaccgccgccaccacggagcgagaagcccagatagacgccccggcggccccgggtcctggagtcccgccgcctgctgcccggccgaggaccccaccccgcctgccgcccgatgcttgcagtggggcccgccatggacagggattacccgcagcatgaacccccgccggcgggcagcctcctgtacagcccgccgcccctgcagagcgccatgctgcactgcccctactggaacaccttctcgctgccgccataccctgccttctccagcgacagccgcccgttcatgagctccgcctccttcctcggcagccagccctgcccagacaccagctatgcccccgtggccaccgcctccagcttgccaccaaagacctgcgactttgctcaggactcctcctattttgaggacttctccaacatctccatcttctcctcgtccgtggactccctgtcggacatcgtggacacgcccgacttcctgccggctgacagcc

SEQ ID NO: 187026 - DNA, 4686 bp, Homo sapiens
  Payload ID: 16825
  Gene Symbol: SBNO2
  Gene Name: strawberry notch homolog 2 (Drosophila)
  Uniprot ID: Q9Y2G9
  ENST ID: ENST00000612198
  CDS Start-End: 1-4101
atgcttgcagtggggcccgccatggacagggattacccgcagcatgaacccccgccggcgggcagcctcctgtacagcccgccgcccctgcagagcgccatgctgcactgcccctactggaacaccttctcgctgccgccataccctgccttctccagcgacagccgcccgttcatgagctccgcctccttcctcggcagccagccctgcccagacaccagctatgcccccgtggccaccgcctccagcttgccaccaaagacctgcgactttgctcaggactcctcctattttgaggacttctccaacatctccatcttctcctcgtccgtggactccctgtcggacatcgtggacacgcccgacttcctgccggctgacagcctcaaccaggtgtccaccatctgggacgataaccctgccccctccacccacgataagctgttccagctcagcaggccgtttgcaggcttcgaggactttctgccctcccacagcaccccgcttctcgtcagctaccaggagcagagtgtgcagagccagccagaggaggaggacgaggctgaggaggaggaggcggaggagctggggcacacagagacctacgccgactacgtgccgtccaagtccaagatcgggaagcagcacccagaccgcgtggtggagaccagcacactgtccagcgtcccacccccagacatcacctacaccctggccctgccctcggacagcggggccctgtctgccctgcagctagaggccatcacctacgcctgccagcaacacgaggtcctgctccccagcgggcagcgcgcgggctttctcatcggcgatggggccggcgtgggcaaaggccggacggtggccggagtcatcctggagaaccacctgcgcggccggaagaaagcattgtggttcagcgtctccaacgacctcaagtacgatgcggagcgcgacctgcgggacatcgaagccacgggcatcgcggtgcacgcgctcagcaagatcaagtacggtgacaccactacctcagagggcgtcctcttcgccacctactccgccctgattggggagagccaggccggcggccagcaccgcactcgcctccggcagatcctggactggtgtggggaggccttcgagggcgtcatcgtgttcgacgagtgtcacaaagccaagaatgccggctccaccaagatgggcaaggctgtgctagacctgcagaacaagctgcccctggcccgcgtggtctacgccagcgccacaggtgcctctgagcctcggaacatgatctacatgagccgcttgggtatctggggcgagggcacacccttccggaactttgaggagttcctgcacgccatcgagaagaggggcgttggcgccatggagatcgtggccatggacatgaaggtcagcggcatgtacatcgcacgccagctcagcttctccggcgtcaccttccgcatcgaggagatcccgctggccccagccttcgagtgcgtctacaaccgcgcggccctgctgtgggccgaggccctgaacgtgttccagcaggcggccgactggatcggcctggagtcgcgcaagtccctgtggggccagttctggtcggcacaccagcgcttcttcaagtatctgtgcatcgcagccaaggtgcgccggctggtggagctggcccgagaggagctggcgcgagacaagtgcgtggtcatcgggctgcagtccacgggcgaggcgcgcacgcgggaggtgctgggggagaacgatgggcacctcaactgcttcgtctcggccgctgaaggcgtgttcctgtcgctaattcagaagcactttccgtccaccaagagaaagcgggacagaggagcgggcagcaagcggaaacggcgacctcggggacgcggggccaaagccccccggctggcgtgcgagacagcgggcgtcatccgcatcagtgacgacagcagcacggagtcggaccctggcctggacagcgacttcaactcctcccccgagtccctggtggatgacgacgttgtcatcgttgatgcagtcgggctccccagtgacgaccggggacccctgtgcctcctgcagagagacccgcatggccccggggtcctggagcgggtggagcggctgaagcaggatctgctggacaaagtgcggcggctgggccgggaactgccagtcaacaccctggacgagctcatcgaccagctgggcggcccccagcgggtggcggagatgaccggcaggaaaggccgcgtggtgtccaggcccgacgggacggtggccttcgagtcgcgggcagagcagggtctgtccatcgaccacgtgaacctcagggagaagcagcgcttcatgagcggcgagaagctcgtggccatcatctcggaggcctccagctcgggtgtctccctccaagccgaccgccgtgtccagaaccagcggcgccgcgtgcacatgaccttggagctgccgtggagcgccgaccgcgccatccagcagttcggccgcacccaccggtccaaccaggtctccgcgccagagtatgtcttcctcatctcggagctggccggggagcgccggttcgcctccatcgtggccaagcgcctggagagtctgggggccctgacccacggagaccgccgcgccacggagtcccgtgacctcagcaagtacaactttgagaacaagtatggcacccgggccctgcactgtgtcctcaccaccatcctgagccagactgagaacaaagtgcctgtgccccagggataccctggaggggtccccaccttcttccgggacatgaagcagggcctgctgtctgtgggcattggtggccgggagtcccggaatggctgcctggacgtggagaaggactgttccatcaccaagttcctgaaccgcatcctggggctggaggtgcacaagcagaacgccctgttccagtacttctcagacaccttcgaccacctcatcgagatggacaagcgggagggcaaatacgacatgggcatcctggaccttgctcccggtatcgaggagatctacgaggagagccagcaggtgttcctggctcccgggcacccgcaggacgggcaggtggtcttctacaagatcagcgtggaccgcggcctgaagtgggaggacgcctttgccaagtcgctggcgctgacgggcccctatgacggcttctacctctcctacaaggtccgcggtaacaagcccagctgcctgctggcggagcagaaccgcggccagttcttcacggtgtacaagcccaacatcggccggcagagccagctggaggccctggacagcctccgccgcaagttccaccgggtcaccgcggaggaggccaaggagccctgggagagtggctacgctttgtcgctgacgcactgcagccacagcgcctggaaccggcactgccggctggcgcaggagggtaaggactgcctgcaggggctgcggctgcggcaccactacatgctgtgcggcgcgctgctgcgcgtgtggggccgcatcgccgccgtcatggccgacgtcagcagcagcagctacctgcagatcgtgcggctgaagaccaaggacaggaagaagcaagtgggcatcaagatccccgagggctgcgtgcgccgggtgctgcaggagctgcggctgatggatgcggacgtgaagcgcaggcaggcgcccgccctgggctgccccgccccgcccgccccgcgcccgctggcgctgccttgcggccccggagaggtgctggacctcacctacagccccccggccgaggccttcccgccgcccccgcacttctctttcccggcgccgctgtccctggacgccggccccggcgtcgtgccgctgggcacccccgacgcccaggccgaccctgcggccctcgcgcaccagggctgcgacatcaacttcaaggaggtgctggaggacatgctgcgctcgctgcacgcggggccgccctccgagggcgcgctgggggagggcgcgggggcggggggcgcggcgggcggtggtcccgagcggcagagcgtgatccagttcagcccacccttccccggcgcccaggctcctctctgacacgcctttaggcgaaacatgccccaagacacagggaccgtttctcccctaggagcagcggtggggagcagggccaaggtcccctgaccactgctcagaggagccctaggccctggccgcagtgccttcagcgcccgacccgggcccccacctggtcagccctggcggggcccactcaggacagctgggggccggggcgtggcagggccctctctgtgcctctcctcccaagtaggaaggggctccgggtggctgctctgggactgggcacccacaagggctcagtgggcccaaacccttgaaatccgtgaaaccgggtggtcccaagagctagaaactcaggaaaccccaggtgctcagggccccgcgtctcgggggctccgtggggcagacccctgctaatatatgcaattctccctcccccagcccttccctgacccctaagttattgcccgctcacctctcccaggccccaggccgcggagctggcagggtggcgcctgcggtttctatgtatttatagcaagttctgatgtacatatgtaaaggacttttttaaatatatgtgccttttgcctacttccc

SEQ ID NO: 187027 - DNA, 4537 bp, Homo sapiens; identical to SEQ ID NO: 187021
  Payload ID: 16825
  Gene Symbol: SBNO2
  Gene Name: strawberry notch homolog 2 (Drosophila)
  Uniprot ID: Q9Y2G9
  ENST ID: ENST00000622719
  CDS Start-End: 25-3954

SEQ ID NO: 187028 - DNA, 461 bp, Homo sapiens
  Payload ID: 16825
  Gene Symbol: SBNO2
  Gene Name: strawberry notch homolog 2 (Drosophila)
  ENST ID: ENST00000631778
  CDS Start-End: 127-461
atcatgatgctgccgccaccgccgccaccacggagcgagaagcccagatagacgccccggcggccccgggtcctggagtcccgccgcctgctgcccggccgaggaccccaccccgcctgccgcccgatgcttgcagtggggcccgccatggacagggattacccgcagcatgaacccccgccggcgggcagcctcctgtacagcccgccgcccctgcagagcgccatgctgcactgcccctactggaacaccttctcgctgccgccataccctgccttctccagcgacagccgcccgttcatgagctccgcctccttcctcggcagccagccctgcccagacaccagctatgcccccgtggccaccgcctccagcttgccaccaaagacctgcgactttgctcaggactcctcctattttgaggacttctccaacatctccatcttctcctcgtccgtgga

SEQ ID NO: 187029 - DNA, 510 bp, Homo sapiens
  Payload ID: 16825
  Gene Symbol: SBNO2
  Gene Name: strawberry notch homolog 2 (Drosophila)
  ENST ID: ENST00000633604
  CDS Start-End: 127-510
atcatgatgctgccgccaccgccgccaccacggagcgagaagcccagatagacgccccggcggccccgggtcctggagtcccgccgcctgctgcccggccgaggaccccaccccgcctgccgcccgatgcttgcagtggggcccgccatggacagggattacccgcagcatgaacccccgccggcgggcagcctcctgtacagcccgccgcccctgcagagcgccatgctgcactgcccctactggaacaccttctcgctgccgccataccctgccttctccagcgacagccgcccgttcatgagctccgcctccttcctcggcagccagccctgcccagacaccagctatgcccccgtggccaccgcctccagcttgccaccaaagacctgcgactttgctcaggactcctcctattttgaggacttctccaacatctccatcttctcctcgtccgtggactccctgtcggacatcgtggacacgcccgacttcctgccggctgacagc

SEQ ID NO: 187030 - DNA, 4776 bp, Homo sapiens
  Payload ID: 16825
  Gene Symbol: SBNO2
  Gene Name: strawberry notch homolog 2 (Drosophila)
  ENST ID: ENST00000634172
  CDS Start-End: 127-4197
atcatgatgctgccgccaccgccgccaccacggagcgagaagcccagatagacgccccggcggccccgggtcctggagtcccgccgcctgctgcccggccgaggaccccaccccgcctgccgcccgatgcttgcagtggggcccgccatggacagggattacccgcagcatgaacccccgccggcgggcagcctcctgtacagcccgccgcccctgcagagcgccatgctgcactgcccctactggaacaccttctcgctgccgccataccctgccttctccagcgacagccgcccgttcatgagctccgcctccttcctcggcagccagccctgcccagacaccagctatgcccccgtggccaccgcctccagcttgccaccaaagacctgcgactttgctcaggactcctcctattttgaggacttctccaacatctccatcttctcctcgtccgtggactccctgtcggacatcgtggacacgcccgacttcctgccggctgacagcctcaaccaggtgtccaccatctgggacgataaccctgccccctccacccacgataagctgttccagctcagcaggccgtttgcaggcttcgaggactttctgccctcccacagcaccccgcttctcgtcagctaccaggagcagagtgtgcagagccagccagaggaggaggacgaggctgaggaggaggaggcggaggagctggggcacacagagacctacgccgactacgtgccgtccaagtccaagatcgggaagcagcacccagaccgcgtggtggagaccagcacactgtccagcgtcccacccccagacatcacctacaccctggccctgccctcggacagcggggccctgtctgccctgcagctagaggccatcacctacgcctgccagcaacacgaggtcctgctccccagcgggcagcgcgcgggctttctcatcggcgatggggccggcgtgggcaaaggccggacggtggccggagtcatcctggagaaccacctgcgcggccggaagaaagcattgtggttcagcgtctccaacgacctcaagtacgatgcggagcgcgacctgcgggacatcgaagccacgggcatcgcggtgcacgcgctcagcaagatcaagtacggtgacaccactacctcagagggcgtcctcttcgccacctactccgccctgattggggagagccaggccggcggccagcaccgcactcgcctccggcagatcctggactggtgtggggaggccttcgagggcgtcatcgtgttcgacgagtgtcacaaagccaagaatgccggctccaccaagatgggcaaggctgtgctagacctgcagaacaagctgcccctggcccgcgtggtctacgccagcgccacaggtgcctctgagcctcggaacatgatctacatgagccgcttgggtatctggggcgagggcacacccttccggaactttgaggagttcctgcacgccatcgagaagaggggcgttggcgccatggagatcgtggccatggacatgaaggtcagcggcatgtacatcgcacgccagctcagcttctccggcgtcaccttccgcatcgaggagatcccgctggccccagccttcgagtgcgtctacaaccgcgcggccctgctggcggccgactggatcggcctggagtcgcgcaagtccctgtggggccagttctggtcggcacaccagcgcttcttcaagtatctgtgcatcgcagccaaggtgcgccggctggtggagctggcccgagaggagctggcgcgagacaagtgcgtggtcatcgggctgcagtccacgggcgaggcgcgcacgcgggaggtgctgggggagaacgatgggcacctcaactgcttcgtctcggccgctgaaggcgtgttcctgtcgctaattcagaagcactttccgtccaccaagagaaagcgggacagaggagcgggcagcaagcggaaacggcgacctcggggacgcggggccaaagccccccggctggcgtgcgagacagcgggcgtcatccgcatcagtgacgacagcagcacggagtcggaccctggcctggacagcgacttcaactcctcccccgagtccctggtggatgacgacgttgtcatcgttgatgcagtcgggctccccagtgacgaccggggacccctgtgcctcctgcagagagacccgcatggccccggggtcctggagcgggtggagcggctgaagcaggatctgctggacaaagtgcggcggctgggccgggaactgccagtcaacaccctggacgagctcatcgaccagctgggcggcccccagcgggtggcggagatgaccggcaggaaaggccgcgtggtgtccaggcccgacgggacggtggccttcgagtcgcgggcagagcagggtctgtccatcgaccacgtgaacctcagggagaagcagcgcttcatgagcggcgagaagctcgtggccatcatctcggaggcctccagctcgggtgtctccctccaagccgaccgccgtgtccagaaccagcggcgccgcgtgcacatgaccttggagctgccgtggagcgccgaccgcgccatccagcagttcggccgcacccaccggtccaaccaggtctccgcgccagagtatgtcttcctcatctcggagctggccggggagcgccggttcgcctccatcgtggccaagcgcctggagagtctgggggccctgacccacggagaccgccgcgccacggagtcccgtgacctcagcaagtacaactttgagaacaagtatggcacccgggccctgcactgtgtcctcaccaccatcctgagccagactgagaacaaagtgcctgtgccccagggataccctggaggggtccccaccttcttccgggacatgaagcagggcctgctgtctgtgggcattggtggccgggagtcccggaatggctgcctggacgtggagaaggactgttccatcaccaagttcctgaaccgcatcctggggctggaggtgcacaagcagaacgccctgttccagtacttctcagacaccttcgaccacctcatcgagatggacaagcgggagggcaaatacgacatgggcatcctggaccttgctcccggtatcgaggagatctacgaggagagccagcaggtgttcctggctcccgggcacccgcaggacgggcaggtggtcttctacaagatcagcgtggaccgcggcctgaagtgggaggacgcctttgccaagtcgctggcgctgacgggcccctatgacggcttctacctctcctacaaggtccgcggtaacaagcccagctgcctgctggcggagcagaaccgcggccagttcttcacggtgtacaagcccaacatcggccggcagagccagctggaggccctggacagcctccgccgcaagttccaccgggtcaccgcggaggaggccaaggagccctgggagagtggctacgctttgtcgctgacgcactgcagccacagcgcctggaaccggcactgccggctggcgcaggagggtaaggactgcctgcaggggctgcggctgcggcaccactacatgctgtgcggcgcgctgctgcgcgtgtggggccgcatcgccgccgtcatggccgacgtcagcagcagcagctacctgcagatcgtgcggctgaagaccaaggacaggaagaagcaagtgggcatcaagatccccgagggctgcgtgcgccgggtgctgcaggagctgcggctgatggatgcggacgtgaagcgcaggcaggcgcccgccctgggctgccccgccccgcccgccccgcgcccgctggcgctgccttgcggccccggagaggtgctggacctcacctacagccccccggccgaggccttcccgccgcccccgcacttctctttcccggcgccgctgtccctggacgccggccccggcgtcgtgccgctgggcacccccgacgcccaggccgaccctgcggccctcgcgcaccagggctgcgacatcaacttcaaggaggtgctggaggacatgctgcgctcgctgcacgcggggccgccctccgagggcgcgctgggggagggcgcgggggcggggggcgcggcgggcggtggtcccgagcggcagagcgtgatccagttcagcccacccttccccggcgcccaggctcctctctgacacgcctttaggcgaaacatgccccaagacacagggaccgtttctcccctaggagcagcggtggggagcagggccaaggtcccctgaccactgctcagaggagccctaggccctggccgcagtgccttcagcgcccgacccgggcccccacctggtcagccctggcggggcccactcaggacagctgggggccggggcgtggcagggccctctctgtgcctctcctcccaagtaggaaggggctccgggtggctgctctgggactgggcacccacaagggctcagtgggcccaaacccttgaaatccgtgaaaccgggtggtcccaagagctagaaactcaggaaaccccaggtgctcagggccccgcgtctcgggggctccgtggggcagacccctgctaatatatgcaattctccctcccccagcccttccctgacccctaagttattgcccgctcacctctcccaggccccaggccgcggagctggcagggtggcgcctgcggtttctatgtatttatagcaagttctgatgtacatatgtaaaggacttttttaaatatatgtgccttttgccta

SEQ ID NO: 187031 - DNA, 4811 bp, Homo sapiens
  Payload ID: 16825
  Gene Symbol: SBNO2
  Gene Name: strawberry notch homolog 2 (Drosophila)
  Uniprot ID: Q9Y2G9
  ENST ID: ENST00000631948
  CDS Start-End: 127-4227
atcatgatgctgccgccaccgccgccaccacggagcgagaagcccagatagacgccccggcggccccgggtcctggagtcccgccgcctgctgcccggccgaggaccccaccccgcctgccgcccgatgcttgcagtggggcccgccatggacagggattacccgcagcatgaacccccgccggcgggcagcctcctgtacagcccgccgcccctgcagagcgccatgctgcactgcccctactggaacaccttctcgctgccgccataccctgccttctccagcgacagccgcccgttcatgagctccgcctccttcctcggcagccagccctgcccagacaccagctatgcccccgtggccaccgcctccagcttgccaccaaagacctgcgactttgctcaggactcctcctattttgaggacttctccaacatctccatcttctcctcgtccgtggactccctgtcggacatcgtggacacgcccgacttcctgccggctgacagcctcaaccaggtgtccaccatctgggacgataaccctgccccctccacccacgataagctgttccagctcagcaggccgtttgcaggcttcgaggactttctgccctcccacagcaccccgcttctcgtcagctaccaggagcagagtgtgcagagccagccagaggaggaggacgaggctgaggaggaggaggcggaggagctggggcacacagagacctacgccgactacgtgccgtccaagtccaagatcgggaagcagcacccagaccgcgtggtggagaccagcacactgtccagcgtcccacccccagacatcacctacaccctggccctgccctcggacagcggggccctgtctgccctgcagctagaggccatcacctacgcctgccagcaacacgaggtcctgctccccagcgggcagcgcgcgggctttctcatcggcgatggggccggcgtgggcaaaggccggacggtggccggagtcatcctggagaaccacctgcgcggccggaagaaagcattgtggttcagcgtctccaacgacctcaagtacgatgcggagcgcgacctgcgggacatcgaagccacgggcatcgcggtgcacgcgctcagcaagatcaagtacggtgacaccactacctcagagggcgtcctcttcgccacctactccgccctgattggggagagccaggccggcggccagcaccgcactcgcctccggcagatcctggactggtgtggggaggccttcgagggcgtcatcgtgttcgacgagtgtcacaaagccaagaatgccggctccaccaagatgggcaaggctgtgctagacctgcagaacaagctgcccctggcccgcgtggtctacgccagcgccacaggtgcctctgagcctcggaacatgatctacatgagccgcttgggtatctggggcgagggcacacccttccggaactttgaggagttcctgcacgccatcgagaagaggggcgttggcgccatggagatcgtggccatggacatgaaggtcagcggcatgtacatcgcacgccagctcagcttctccggcgtcaccttccgcatcgaggagatcccgctggccccagccttcgagtgcgtctacaaccgcgcggccctgctgtgggccgaggccctgaacgtgttccagcaggcggccgactggatcggcctggagtcgcgcaagtccctgtggggccagttctggtcggcacaccagcgcttcttcaagtatctgtgcatcgcagccaaggtgcgccggctggtggagctggcccgagaggagctggcgcgagacaagtgcgtggtcatcgggctgcagtccacgggcgaggcgcgcacgcgggaggtgctgggggagaacgatgggcacctcaactgcttcgtctcggccgctgaaggcgtgttcctgtcgctaattcagaagcactttccgtccaccaagagaaagcgggacagaggagcgggcagcaagcggaaacggcgacctcggggacgcggggccaaagccccccggctggcgtgcgagacagcgggcgtcatccgcatcagtgacgacagcagcacggagtcggaccctggcctggacagcgacttcaactcctcccccgagtccctggtggatgacgacgttgtcatcgttgatgcagtcgggctccccagtgacgaccggggacccctgtgcctcctgcagagagacccgcatggccccggggtcctggagcgggtggagcggctgaagcaggatctgctggacaaagtgcggcggctgggccgggaactgccagtcaacaccctggacgagctcatcgaccagctgggcggcccccagcgggtggcggagatgaccggcaggaaaggccgcgtggtgtccaggcccgacgggacggtggccttcgagtcgcgggcagagcagggtctgtccatcgaccacgtgaacctcagggagaagcagcgcttcatgagcggcgagaagctcgtggccatcatctcggaggcctccagctcgggtgtctccctccaagccgaccgccgtgtccagaaccagcggcgccgcgtgcacatgaccttggagctgccgtggagcgccgaccgcgccatccagcagttcggccgcacccaccggtccaaccaggtctccgcgccagagtatgtcttcctcatctcggagctggccggggagcgccggttcgcctccatcgtggccaagcgcctggagagtctgggggccctgacccacggagaccgccgcgccacggagtcccgtgacctcagcaagtacaactttgagaacaagtatggcacccgggccctgcactgtgtcctcaccaccatcctgagccagactgagaacaaagtgcctgtgccccagggataccctggaggggtccccaccttcttccgggacatgaagcagggcctgctgtctgtgggcattggtggccgggagtcccggaatggctgcctggacgtggagaaggactgttccatcaccaagttcctgaaccgcatcctggggctggaggtgcacaagcagaacgccctgttccagtacttctcagacaccttcgaccacctcatcgagatggacaagcgggagggcaaatacgacatgggcatcctggaccttgctcccggtatcgaggagatctacgaggagagccagcaggtgttcctggctcccgggcacccgcaggacgggcaggtggtcttctacaagatcagcgtggaccgcggcctgaagtgggaggacgcctttgccaagtcgctggcgctgacgggcccctatgacggcttctacctctcctacaaggtccgcggtaacaagcccagctgcctgctggcggagcagaaccgcggccagttcttcacggtgtacaagcccaacatcggccggcagagccagctggaggccctggacagcctccgccgcaagttccaccgggtcaccgcggaggaggccaaggagccctgggagagtggctacgctttgtcgctgacgcactgcagccacagcgcctggaaccggcactgccggctggcgcaggagggtaaggactgcctgcaggggctgcggctgcggcaccactacatgctgtgcggcgcgctgctgcgcgtgtggggccgcatcgccgccgtcatggccgacgtcagcagcagcagctacctgcagatcgtgcggctgaagaccaaggacaggaagaagcaagtgggcatcaagatccccgagggctgcgtgcgccgggtgctgcaggagctgcggctgatggatgcggacgtgaagcgcaggcaggcgcccgccctgggctgccccgccccgcccgccccgcgcccgctggcgctgccttgcggccccggagaggtgctggacctcacctacagccccccggccgaggccttcccgccgcccccgcacttctctttcccggcgccgctgtccctggacgccggccccggcgtcgtgccgctgggcacccccgacgcccaggccgaccctgcggccctcgcgcaccagggctgcgacatcaacttcaaggaggtgctggaggacatgctgcgctcgctgcacgcggggccgccctccgagggcgcgctgggggagggcgcgggggcggggggcgcggcgggcggtggtcccgagcggcagagcgtgatccagttcagcccacccttccccggcgcccaggctcctctctgacacgcctttaggcgaaacatgccccaagacacagggaccgtttctcccctaggagcagcggtggggagcagggccaaggtcccctgaccactgctcagaggagccctaggccctggccgcagtgccttcagcgcccgacccgggcccccacctggtcagccctggcggggcccactcaggacagctgggggccggggcgtggcagggccctctctgtgcctctcctcccaagtaggaaggggctccgggtggctgctctgggactgggcacccacaagggctcagtgggcccaaacccttgaaatccgtgaaaccgggtggtcccaagagctagaaactcaggaaaccccaggtgctcagggccccgcgtctcgggggctccgtggggcagacccctgctaatatatgcaattctccctcccccagcccttccctgacccctaagttattgcccgctcacctctcccaggccccaggccgcggagctggcagggtggcgcctgcggtttctatgtatttatagcaagttctgatgtacatatgtaaaggacttttttaaatatatgtgccttttgcctacttcc

SEQ ID NO: 187032 - DNA, 562 bp, Homo sapiens; identical to SEQ ID NO: 187025
  Payload ID: 16825
  Gene Symbol: SBNO2
  Gene Name: strawberry notch homolog 2 (Drosophila)
  ENST ID: ENST00000632777
  CDS Start-End: 178-562

SEQ ID NO: 187033 - DNA, 3171 bp, Homo sapiens
  Payload ID: 16826
  Gene Symbol: SERP1
  Gene Name: stress-associated endoplasmic reticulum protein 1
  Uniprot ID: Q9Y6X1
  ENST ID: ENST00000239944
  CDS Start-End: 507-707
aaacgcgcacgcgcaaatctagggcgacgcttgacagagcttgggagggtgcgcctgctttcgccctccttctccagcgggaggggcgcgcacttccgcggggcggagtccgtctagtgctgacgttggcagccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgttaagatacagtagtggaccctacttattcagtcaattaagagtaagtttttttatgtggttattaaaacagtatgaacaattagtctaactctgcatagacagggtctagattttgttaacccaaatgtataactgcagttagcttaaattacaatttgaagtcttgtggtttttatatagctaggcactttattactcttttgaactgaaagcacactcccttataggttcatgtaactgtcctgtaataaggtgcttataaatggaacaactacacagcctagttttgccacaacctttagcatctaaaaagttttaaaagcttctaaatgtctaatataaagggagatgcttatagccacaacatctattttaccaatattgtttccattacactaccttggattttgcatgagtgagtatagtaacccaagatgccataaaaaaaaaacttgatcgttttctgacttaatcagttactgtggtttcactaaaagctaccgtggtggagtgaagtcagtcagggaaggtttgtttatgttacatttatttcaccagaactattttaatatatcaaaggggtttactatgccaaacaaaattctagggaaaaatactgctaaaaatggatgcctcatcagaacatgctgttgagtccaatgtgccataagacattttagcatgttaaatagcacttttaatagcaaaaaaaggcacatcaactgcgaagttatccttagtttgcaaatgctttttctagattaatgatttttcaatcattagggtactagacacatcagcctaaagtggcatctggaattgaatggatttactgataatgatcagtctttagtcttccctttgttatatgactttataggttatgattgatcaaatttacgttttactaatggtaagggtgagggtcatagggcaggttttgggttttctagtactgttgaaaactgcaagtattggctatttgtatacttagccataacttggtgaaaaaaaacctgagcagtgtctatgtattaatgcgttggaaagaaagctgcttgtgtttgctttgttaattgcctcaggatatttcttttaaaataagctgttttaagaggaacagaagggaaatctgctacctagtctatacacagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttccctgaatatttgatgcttttcttctaaacggaaatgattttacagttatctgagtgtaccttttatagttagtagaaaatgattttaaagaatgtttagtattgtacttaaatggtatgcagaggcacagatgtaaggtttataactggaaataggtggtaagaaaaatatatagaaagcacaatgatttgaatatttttccacttaggatttcctaatctccttgtcatccaattcaagctcaagatgaagcacaattctttgatctccctttgccagttgaattttatagatcatctaatgttgagcacagtatgagaataaatattggggttgtcaacattactcagttactctttgtggtttaactctaacatttcaacaagttgtcaattaattgtatctgttgggttgtatataatgttgctcaaaataattaagtggacttccaaaaataagatttccattgtaacaggatgcattgtgatgggctttgacttacattaaagaaatgtggatagtcaactgc

SEQ ID NO: 187034 - DNA, 830 bp, Homo sapiens
  Payload ID: 16826
  Gene Symbol: SERP1
  Gene Name: stress-associated endoplasmic reticulum protein 1
  ENST ID: ENST00000491660
  CDS Start-End: 365-601
agtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctggtaagtggcttgggggctcccatcaggtagagtcttgggttgaaaggatttgggatgacgtggtgaccggtcagtagtgagtcctacctgcgtagttctcaacccacctgccgaggactccacataattctgtttcgtctgaaccaaattacttgttccacatatgcacagagggtggtgctccagaaacttctcccagcttaatttgtactcacaggagatcaaaaaggaggtcaggtcttggtaatgatccagttggaataaatgttaagaccggacaaaacctaacgaaatgagaatttagaa

SEQ ID NO: 187035 - DNA, 657 bp, Homo sapiens
  Payload ID: 16826
  Gene Symbol: SERP1
  Gene Name: stress-associated endoplasmic reticulum protein 1
  ENST ID: ENST00000487153
  CDS Start-End: 367-534
aaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattcca

SEQ ID NO: 187036 - DNA, 3934 bp, Homo sapiens
  Payload ID: 16826
  Gene Symbol: SERP1
  Gene Name: stress-associated endoplasmic reticulum protein 1
  Uniprot ID: Q9Y6X1
  ENST ID: ENST00000479209
  CDS Start-End: 1274-1474
actcaccaccatcttggtagtgtgcaagactctgggacggcatgagaaaggcagaaagggagcaaaggagctggtggggtgtcacagggcctatgtatgaggcagatgtgagttctgcatccagttttgcaatttatccatttacctgcctgagacttggaaacacctactttatagtcctgattcaagtgttggcggatggaagggaggagactcctgaccctcagaatgacctaaatgacttcacaagggcccgtgtaacaccagtattgcagacccatgtgtcacaaattcaactagcacattgtttttctcccccttcttctatttctgtagaagatgaatccgcaggcaagaatgatggatgggtgaaagggagggggaatacgaaagcccagaggcggagacttcacttccgattgccacgctatatcaagaaagccaacagtctggcctttccgcaagccacaagaaaaggcagatcagactccccggctcctcgggtagttctcaaaggcaaagacaaaaataagaaactagtctgaagaaagagagtccctcgcttcttcagaactcacctgtcaagagcggcgtggacggcgccatgttgtcccggaaagagaaaccgctcgggtgagagttcaccagggccgaacccggcccctacacgtctcctcatgcgtggagacagcgaattggtgtttccggagccatcagcctcggggccaattcacttccggttacggagtgacgcggaaaaggcgcccaaacgcgcacgcgcaaatctagggcgacgcttgacagagcttgggagggtgcgcctgctttcgccctccttctccagcgggaggggcgcgcacttccgcggggcggagtccgtctagtgctgacgttggcagccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgttaagatacagtagtggaccctacttattcagtcaattaagagtaagtttttttatgtggttattaaaacagtatgaacaattagtctaactctgcatagacagggtctagattttgttaacccaaatgtataactgcagttagcttaaattacaatttgaagtcttgtggtttttatatagctaggcactttattactcttttgaactgaaagcacactcccttataggttcatgtaactgtcctgtaataaggtgcttataaatggaacaactacacagcctagttttgccacaacctttagcatctaaaaagttttaaaagcttctaaatgtctaatataaagggagatgcttatagccacaacatctattttaccaatattgtttccattacactaccttggattttgcatgagtgagtatagtaacccaagatgccataaaaaaaaaacttgatcgttttctgacttaatcagttactgtggtttcactaaaagctaccgtggtggagtgaagtcagtcagggaaggtttgtttatgttacatttatttcaccagaactattttaatatatcaaaggggtttactatgccaaacaaaattctagggaaaaatactgctaaaaatggatgcctcatcagaacatgctgttgagtccaatgtgccataagacattttagcatgttaaatagcacttttaatagcaaaaaaaggcacatcaactgcgaagttatccttagtttgcaaatgctttttctagattaatgatttttcaatcattagggtactagacacatcagcctaaagtggcatctggaattgaatggatttactgataatgatcagtctttagtcttccctttgttatatgactttataggttatgattgatcaaatttacgttttactaatggtaagggtgagggtcatagggcaggttttgggttttctagtactgttgaaaactgcaagtattggctatttgtatacttagccataacttggtgaaaaaaaacctgagcagtgtctatgtattaatgcgttggaaagaaagctgcttgtgtttgctttgttaattgcctcaggatatttcttttaaaataagctgttttaagaggaacagaagggaaatctgctacctagtctatacacagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttccctgaatatttgatgcttttcttctaaacggaaatgattttacagttatctgagtgtaccttttatagttagtagaaaatgattttaaagaatgtttagtattgtacttaaatggtatgcagaggcacagatgtaaggtttataactggaaataggtggtaagaaaaatatatagaaagcacaatgatttgaatatttttccacttaggatttcctaatctccttgtcatccaattcaagctcaagatgaagcacaattctttgatctccctttgccagttgaattttatagatcatctaatgttgagcacagtatgagaataaatattggggttgtcaacattactcagttactctttgtggtttaactctaacatttcaacaagttgtcaattaattgtatctgttgggttgtatataatgttgctcaaaataattaagtggacttccaaaaataagatttccattgtaacaggatgcattgtgatgggctttgacttacattaaagaaatgtggatagtcaa

SEQ ID NO: 187037 - DNA, 784 bp, Homo sapiens
  Payload ID: 16827
  Gene Symbol: SERP2
  Gene Name: stress-associated endoplasmic reticulum protein family member 2
  Uniprot ID: Q8N6R1
  ENST ID: ENST00000379179
  CDS Start-End: 185-382
gcctctctctggagtcggctagccggggctcggggagcggggtgcgcagggctcggggccacgccttgccacctgcagcgcccgggtgggccgcgggggcctcggcgggacgcgctcggccctgtcgcaggagctaacgcagggggaatccttgcaggtgggagcatttcagagcgcacaagccatggtggccaaacagcggatccggatggctaacgagaagcacagcaaaaacatcacccagagggggaacgtagccaaaaccctgaggccgcaagaggagaaatatcctgtgggaccatggctgttggcactgtttgtttttgttgtctgtggctcagctatctttcagatcattcagagcataaggatgggcatgtgagaaagccagggatttgacaccacctccctcccactggaggcgggaggacaacggaagcggtcagccagtttctgcgggaaacaagcaggccacacggaatagaaaaaaacgctcccccacttgttccctgatcacttcatcgtggatgtcagaccaaattgccttctcacaggacatcttggtgcatccgcgttctcaagcggaaaggacattttgcttttctgttggcaggattagtagccacgcgggtcgtccgcagcagtgctgtttttttggtttttcccttggtttcactaatgcgtgcatgtggccctctgaacgatcactggtttactttctatggatacaatctctcctccattgagaattgattttacaaataaatgtcttcgttcaacctta

SEQ ID NO: 187038 - DNA, 747 bp, Homo sapiens
  Payload ID: 16827
  Gene Symbol: SERP2
  Gene Name: stress-associated endoplasmic reticulum protein family member 2
  ENST ID: ENST00000474333
  CDS Start-End: 121-360
cgcgacactgcagggccccggctctgcgcgctgcgctccggccgctcggcgcgggaggacgtgcggtcgcgcctgcctcggtggccgcgcggggtgggagcatttcagagcgcacaagccatggtggccaaacagcggatccggatggctaacgagaagcacagcaaaaacatcacccagagggggaacgtagccaaaaccctgaggccgcaagaggagaaatatcctgtgggaccatggctgttggcactgtttgtttttgttgtctgtggctcagtttctgttttcagcttagtctacggcaacaaaataatagtacaggacccactgcagattggtgtagtaatacaagagatgtgaccagagatgagaagaaagagacccaaaaaatgatcagaagcagaaatgggagcccagaagtgcagctgaccagaagcatttcagtgtcagatcacacgcagcctcctctgtaatgagatcacagcacgtctcatcagttactggttttcattatggtgacactgaacactcatgaaaagttagcattgaaatatgttggtatctccaatttagaaagctatctttcagatcattcagagcataaggatgggcatgtgagaaagccagggatttgacaccacctccctcccactggaggcgggaggacaacggaagcggtcagccagtttctgcgggaaacaagcaggccacacggaatagaaaaaaacgctcccccacttgttccct

SEQ ID NO: 187039 - DNA, 962 bp, Homo sapiens
  Payload ID: 16827
  Gene Symbol: SERP2
  Gene Name: stress-associated endoplasmic reticulum protein family member 2
  ENST ID: ENST00000493476
  CDS Start-End: 145-399
ggtgcgcagggctcggggccacgccttgccacctgcagcgcccgggtgggccgcgggggcctcggcgggacgcgctcggccctgtcgcaggagctaacgcagggggaatccttgcaggtgggagcatttcagagcgcacaagccatggtggccaaacagcggatccggatggctaacgagaagcacagcaaaaacatcacccagagggggaacgtagccaaaaccctgaggccgcaagaggagaaatatcctgtgggaccatggctgttggcactgtttgtttttgttgtctgtggctcaggtcaaccacataaattggcctctcctggagactgccagaactttctcaaagttgtaacatccagagggagtcaccccacccccaagaccggcaactgagatgtttaaaggaactggctggccctgaaggaaagactgaggccattcatctgctctggagttcatcctcgggatctgagatgcacagcctgaagacatctcatcagccatcagctcccttaagctatctttcagatcattcagagcataaggatgggcatgtgagaaagccagggatttgacaccacctccctcccactggaggcgggaggacaacggaagcggtcagccagtttctgcgggaaacaagcaggccacacggaatagaaaaaaacgctcccccacttgttccctgatcacttcatcgtggatgtcagaccaaattgccttctcacaggacatcttggtgcatccgcgttctcaagcggaaaggacattttgcttttctgttggcaggattagtagccacgcgggtcgtccgcagcagtgctgtttttttggtttttcccttggtttcactaatgcgtgcatgtggccctctgaacgatcactggtttactttctatggatacaatctctcctccattgagaattgattttacaaataaatgtcttcgttcaac

SEQ ID NO: 187040 - DNA, 778 bp, Homo sapiens
  Payload ID: 16827
  Gene Symbol: SERP2
  Gene Name: stress-associated endoplasmic reticulum protein family member 2
  ENST ID: ENST00000616650
  CDS Start-End: 1-126
ctgtttgtttttgttgtctgtggctcaggtcaaccacataaattggcctctcctggagactgccagaactttctcaaagttgtaacatccagagggagtcaccccacccccaagaccggcaactgagatgtttaaaggaactggctggccctgaaggaaagactgaggccattcatctgctctggagttcatcctcgggatctgagatgcacagcctgaagacatctcatcagccatcagctcccttaaggtgacctgcagcctcctttgtgccctgggggcatttgggattgtgtagaggctctctctcagaagcatctttctgttattttaatgcggatagaaagctttacattctttgctaataacatctgggttttaatagcgcctccttgccctgcctgtctccggcatctctcttttttccctcttctccatctctagagaagccaccagaaaatggcatcttgcttttgactttctttgtgctgattcttttagagaacttagtgatccactttgcaatgtctcgtctcctaacatttcagcttgtttctcagagggcctgtactttgctttctaccagctctttcatcattttcattttctttaatgaaaaataagcaaaactgtatgatttctaggttgtcttcttctcctaaaggatattcttcttccggcctctcttaatctctcttctcagcaactcccttgatctcttttatcatcaatttattgtcaataaaagtggctttaggaagcctcctgttacctggca

SEQ ID NO: 187041 - DNA, 2196 bp, Homo sapiens
  Payload ID: 16828
  Gene Symbol: STIP1
  Gene Name: stress-induced phosphoprotein 1
  Uniprot ID: P31948
  ENST ID: ENST00000305218
  CDS Start-End: 148-1779
ctagaagaactcgaccagtgagcaggcgaggaaggggcgggagccggggtcccggtagcttctagtaggttccagaaggcggcgcgtgcggttgggaacgcggagcggacggattcgattcaacggggttccggaccgcgctgcgctatggagcaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggctattcacgaaaagcagcagctctagagttcttaaaccgctttgaagaagccaagcgaacctatgaggagggcttaaaacacgaggcaaataaccctcaactgaaagagggtttacagaatatggaggccaggttggcagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgaaactacaagatccccggatcatgaccactctcagcgtcctccttggggtcgatctgggcagtatggatgaggaggaagagattgcaacacctccaccaccaccccctcccaaaaaggagaccaagccagagccaatggaagaagatcttccagagaataagaagcaggcactgaaagaaaaagagctggggaacgatgcctacaagaagaaagactttgacacagccttgaagcattacgacaaagccaaggagctggaccccactaacatgacttacattaccaatcaagcagcggtatactttgaaaagggcgactacaataagtgccgggagctttgtgagaaggccattgaagtggggagagaaaaccgagaagactatcgacagattgccaaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggttata

SEQ ID NO: 187042 - DNA, 2743 bp, Homo sapiens
  Payload ID: 16828
  Gene Symbol: STIP1
  Gene Name: stress-induced phosphoprotein 1
  Uniprot ID: P31948
  ENST ID: ENST00000358794
  CDS Start-End: 554-2326
gaattcccctcggccctacaggaccaaacgaccggcgcgctgagaaagggtgtgcggttccactgaggacgcccaagcgggacagccgggcccgccgcggtgagatccccggcctgtccagcccaagcccaagcgccctcgcggtcacgtggcatttccggaacattcagaacctaacagccaggaggcaggagggccgggccgaggccggagcgctggacaacgcgggtagctggcgctcgagggacaggcagctcccaccggctaggacccccatcccgatgcgcgggcgaagggctggggccctgtgccgctggcgatcccggggaccgcctggaactcgcggcactcgggagcgagagggaaagcaacccagaggccccgcagccgccggcgacacagctacagaccccgactgcagccggtactcccatatatcaggggcggggcgaaacccggccttttgaagggcagcgatttaaaccaatcagcgcaaagagttggcaaccctccgcccaattggaatcgctctcattctgaaggcggttccgacatggagtccggcagcccaatgggagaggtggaaatttccagaacgatcagaaccaatgggcgcggccagcgcggctacgattggcagtgcaaaagaccaatccgtgtcgcagaagttcgctcctccctccattcgtggagcctgagatgggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggctattcacgaaaagcagcagctctagagttcttaaaccgctttgaagaagccaagcgaacctatgaggagggcttaaaacacgaggcaaataaccctcaactgaaagagggtttacagaatatggaggccaggttggcagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgaaactacaagatccccggatcatgaccactctcagcgtcctccttggggtcgatctgggcagtatggatgaggaggaagagattgcaacacctccaccaccaccccctcccaaaaaggagaccaagccagagccaatggaagaagatcttccagagaataagaagcaggcactgaaagaaaaagagctggggaacgatgcctacaagaagaaagactttgacacagccttgaagcattacgacaaagccaaggagctggaccccactaacatgacttacattaccaatcaagcagcggtatactttgaaaagggcgactacaataagtgccgggagctttgtgagaaggccattgaagtggggagagaaaaccgagaagactatcgacagattgccaaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggttata

SEQ ID NO: 187043 - DNA, 738 bp, Homo sapiens
  Payload ID: 16828
  Gene Symbol: STIP1
  Gene Name: stress-induced phosphoprotein 1
  ENST ID: ENST00000536973
  CDS Start-End: 78-494
tccagaaggcggcgcgtgcggttgggaacgcggagcggacggattcgattcaacggggttccggaccgcgctgcgctatggagcaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggctattcacgaaaagcagcagctctagagttcttaaaccgctttgaagaagccaagcgaacctatgaggagggcttaaaacacgaggcaaataaccctcaactgaaagagggtttacagaatatggaggccaggttggcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggag

SEQ ID NO: 187044 - DNA, 772 bp, Homo sapiens
  Payload ID: 16828
  Gene Symbol: STIP1
  Gene Name: stress-induced phosphoprotein 1
  ENST ID: ENST00000543847
  CDS Start-End: 38-748
ggattcgattcaacggggttccggaccgcgctgcgctatggagcaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggctattcacgaaaagcagcagctctagagttcttaaaccgctttgaagaagccaagcgaacctatgaggagggcttaaaacacgaggcaaataaccctcaactgaaagagggtttacagaatatggaggccaggttggcagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgaaactacaagatccccggatcatgaccactctcagcgtcctccttggggtcgatctgggcagtatggatgaggaggaagagattgcaacacctccaccaccaccccctcccaaaaaggagaccaagccagagccaatggaagaagatcttccagagaataagaagcaggtcttgtttttttctctcctcactgtcacctatctataaacaactagaaatctttatgttgaa

SEQ ID NO: 187045 - DNA, 877 bp, Homo sapiens
  Payload ID: 16828
  Gene Symbol: STIP1
  Gene Name: stress-induced phosphoprotein 1
  ENST ID: ENST00000540887
  CDS Start-End: 1-414
gcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgagtacgtagagtcagagaggcggccttgctggaaatggagaacaaaagcaggcagatgagtgcacgcggctggggggtggtatgctcagtctgcgaggaagaggaattctgtcattcttcctaaacttaaggagattggcagtgggtggcgagctggaagggctttgttagtcgtgatagcttaagcagtcatttggaaaggcccatttagctgggagaaaggtcttgactggaagctgtgtcgtgggctcaagagtaggactggcaagttctgcgaagtggagcaggcctctgcagctcggcgccccgggcctcgccaggacccctccctgccggggccttctgtagagggggttgaattggggcttgctctgagagcaagtaagactttaaaggttgtctcatttcaagtaactgcgtcttcctctgtagacacttaaagaatcctgtaatagcacagaagatccagaagctgatggatgtgggtctgattgcaattcggtgatgacttgttcatccccc

SEQ ID NO: 187046 - DNA, 1900 bp, Homo sapiens
  Payload ID: 16828
  Gene Symbol: STIP1
  Gene Name: stress-induced phosphoprotein 1
  Uniprot ID: P31948
  ENST ID: ENST00000538945
  CDS Start-End: 59-1618
ggttgggaacgcggagcggacggattcgattcaacggggttccggaccgcgctgcgctatggagcaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggcttaaaacacgaggcaaataaccctcaactgaaagagggtttacagaatatggaggccaggttggcagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgaaactacaagatccccggatcatgaccactctcagcgtcctccttggggtcgatctgggcagtatggatgaggaggaagagattgcaacacctccaccaccaccccctcccaaaaaggagaccaagccagagccaatggaagaagatcttccagagaataagaagcaggcactgaaagaaaaagagctggggaacgatgcctacaagaagaaagactttgacacagccttgaagcattacgacaaagccaaggagctggaccccactaacatgacttacattaccaatcaagcagcggtatactttgaaaagggcgactacaataagtgccgggagctttgtgagaaggccattgaagtggggagagaaaaccgagaagactatcgacagattgccaaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttgg

SEQ ID NO: 187047 - DNA, 3265 bp, Homo sapiens
  Payload ID: 16829
  Gene Symbol: STRIP1
  Gene Name: striatin interacting protein 1
  Uniprot ID: Q5VSL9
  ENST ID: ENST00000369795
  CDS Start-End: 23-2536
ctgggggtgtggagcagccaagatggagccggcagtcggcggtccgggcccactgatcgtgaacaacaaacagccccagcccccgccacctccgccgccggcagccgcacagccaccacccggggcaccgcgggccgccgcgggcctcctgcctgggggcaaagcccgcgagttcaaccgcaaccagcgcaaagactcagagggctattcggagtcaccagacctggagtttgagtatgctgacacagacaagtgggctgcagagctctcggagctttacagctacacggaagggccagaattcctgatgaatcgaaaatgctttgaggaggacttccggatccatgtgacagacaagaagtggactgagctggataccaaccagcaccggacccatgccatgaggctcctggatggcttggaagtcactgccagggagaagagactcaaggtggctcgagcaattctctatgttgctcaaggcacgtttggggagtgcagctcggaggcagaggtgcagtcctggatgcgctacaacatctttctcctcctggaggtgggcacgttcaatgctttggtggagcttctgaacatggaaatagacaacagtgccgcctgcagcagtgctgtgaggaagcctgccatctccctggctgacagcacagacctcagggtcctgctcaacatcatgtacctgatagtggagaccgttcatcaggagtgtgagggtgacaaggctgagtggaggaccatgcggcagaccttcagagccgagctgggctccccgctgtacaacaatgagccatttgccatcatgctgtttgggatggtgaccaaattttgcagtggtcacgcccctcactttcccatgaagaaagttctcttgctgctctggaagacagtattgtgcacgctaggcggctttgaggagctgcagagcatgaaggctgagaagcgcagcatcctgggcctccccccgcttcctgaggacagcatcaaagtgattcgcaacatgagagcagcctctccaccagcatctgcttcagacttgattgagcagcagcagaaacggggccgccgagagcacaaggctctgataaagcaggacaacctagatgccttcaacgagcgggatccctacaaggctgatgactctcgagaagaggaagaggagaatgatgatgacaacagtctggagggggagacgtttcccctggaacgggatgaagtgatgcctcccccgctacagcacccacagactgacaggctgacttgccccaaagggctcccgtgggctcccaaggtcagagagaaagacattgagatgttccttgagtccagccgcagcaaatttataggttacactctaggcagtgacacgaacacagtggtggggctgcccaggccaatccacgaaagcatcaagactctgaaacagcacaagtacacgtcgattgcagaggtccaggcacagatggaggaggaatacctccgctcccctctctcagggggagaagaagaagttgagcaagtccctgcagaaaccctctaccaaggcttgctccccagcctgcctcagtatatgattgccctcctgaagatcctgttggctgcagcacccacctcaaaagccaaaacagactcaatcaacatcctagcggacgtcttgcctgaggagatgcccaccacagtgttgcagagcatgaagctgggggtggatgtaaaccgccacaaagaggtcattgttaaggccatttctgctgtcctgctgctgctgctcaagcactttaagttgaaccatgtctaccagtttgaatacatggcccagcacctggtgtttgccaactgcattcctttgatcctaaagttcttcaatcaaaacatcatgtcctacatcactgccaagaacagcatttctgtcctggattaccctcactgcgtggtgcatgagctgccagagctgacggcggagagtttggaagcaggtgacagtaaccaattttgctggaggaacctcttttcttgtatcaatctgcttcggatcttgaacaagctgacaaagtggaagcattcaaggacaatgatgctggtggtgttcaagtcagcccccatcttgaagcgggccctaaaggtgaaacaagccatgatgcagctctatgtgctgaagctgctcaaggtacagaccaaatacttggggcggcagtggcgaaagagcaacatgaagaccatgtctgccatctaccagaaggtgcggcatcggctgaacgacgactgggcatacggcaatgatcttgatgcccggccttgggacttccaggcagaggagtgtgcccttcgtgccaacattgaacgcttcaacgcccggcgctatgaccgggcccacagcaaccctgacttcctgccagtggacaactgcctgcagagtgtcctgggccaacgggtggacctccctgaggactttcagatgaactatgacctctggttagaaagggaggtcttctccaagcccatttcctgggaagagctgctgcagtgaggctgttggttaggggactgaaatggagagaaaagatgatctgaaggtacctgtgggactgtcctagttcattgctgcagtgctcccatcccccaccaggtggcagcacagccccactgtgtcttccgcagtctgtcctgggcttgggtgagcccagcttgacctccccttggttcccagggtcctgctccgaagcagtcatctctgcctgagatccattcttcctttacttcccccaccctcctctcttggatatggttggttttggctcatttcacaatcagcccaaggctgggaaagctggaatgggatgggaacccctccgccgtgcatctgaatttcaggggtcatgctgatgcctctcgagacatacaaatccttgctttgtcagcttgcaaaggaggagagtttaggattagggccagggccagaaagtcggtatcttggttgtgctctggggtgggggtggggtgtttctgatgttattccagcctcctgctacattatatccagaagtaattgcggaggctccttcagctgcctcagcactttgattttggacagggacaaggtaggaagagaagcttcccttaaccagaggggccatttttccttttggctttcgagggcctgtaaatatctatatataattctgtgtgtattctgtgtcatgttggggtttttaatgtgattgtgtattctgtttacattaaaaagaagcaaaaataa

SEQ ID NO: 187048 - DNA, 3125 bp, Homo sapiens
  Payload ID: 16829
  Gene Symbol: STRIP1
  Gene Name: striatin interacting protein 1
  Uniprot ID: Q5VSL9
  ENST ID: ENST00000369796
  CDS Start-End: 170-2398
attttacccagcccctgttcaagatggagttgctgtggttcacacatctctgacaaaaatacagggctattcggagtcaccagacctggagtttgagtatgctgacacagacaagtgggctgcagagctctcggagctttacagctacacggaagggccagaattcctgatgaatcgaaaatgctttgaggaggacttccggatccatgtgacagacaagaagtggactgagctggataccaaccagcaccggacccatgccatgaggctcctggatggcttggaagtcactgccagggagaagagactcaaggtggctcgagcaattctctatgttgctcaaggcacgtttggggagtgcagctcggaggcagaggtgcagtcctggatgcgctacaacatctttctcctcctggaggtgggcacgttcaatgctttggtggagcttctgaacatggaaatagacaacagtgccgcctgcagcagtgctgtgaggaagcctgccatctccctggctgacagcacagacctcagggtcctgctcaacatcatgtacctgatagtggagaccgttcatcaggagtgtgagggtgacaaggctgagtggaggaccatgcggcagaccttcagagccgagctgggctccccgctgtacaacaatgagccatttgccatcatgctgtttgggatggtgaccaaattttgcagtggtcacgcccctcactttcccatgaagaaagttctcttgctgctctggaagacagtattgtgcacgctaggcggctttgaggagctgcagagcatgaaggctgagaagcgcagcatcctgggcctccccccgcttcctgaggacagcatcaaagtgattcgcaacatgagagcagcctctccaccagcatctgcttcagacttgattgagcagcagcagaaacggggccgccgagagcacaaggctctgataaagcaggacaacctagatgccttcaacgagcgggatccctacaaggctgatgactctcgagaagaggaagaggagaatgatgatgacaacagtctggagggggagacgtttcccctggaacgggatgaagtgatgcctcccccgctacagcacccacagactgacaggctgacttgccccaaagggctcccgtgggctcccaaggtcagagagaaagacattgagatgttccttgagtccagccgcagcaaatttataggttacactctaggcagtgacacgaacacagtggtggggctgcccaggccaatccacgaaagcatcaagactctgaaacagcacaagtacacgtcgattgcagaggtccaggcacagatggaggaggaatacctccgctcccctctctcagggggagaagaagaagttgagcaagtccctgcagaaaccctctaccaaggcttgctccccagcctgcctcagtatatgattgccctcctgaagatcctgttggctgcagcacccacctcaaaagccaaaacagactcaatcaacatcctagcggacgtcttgcctgaggagatgcccaccacagtgttgcagagcatgaagctgggggtggatgtaaaccgccacaaagaggtcattgttaaggccatttctgctgtcctgctgctgctgctcaagcactttaagttgaaccatgtctaccagtttgaatacatggcccagcacctggtgtttgccaactgcattcctttgatcctaaagttcttcaatcaaaacatcatgtcctacatcactgccaagaacagcatttctgtcctggattaccctcactgcgtggtgcatgagctgccagagctgacggcggagagtttggaagcaggtgacagtaaccaattttgctggaggaacctcttttcttgtatcaatctgcttcggatcttgaacaagctgacaaagtggaagcattcaaggacaatgatgctggtggtgttcaagtcagcccccatcttgaagcgggccctaaaggtgaaacaagccatgatgcagctctatgtgctgaagctgctcaaggtacagaccaaatacttggggcggcagtggcgaaagagcaacatgaagaccatgtctgccatctaccagaaggtgcggcatcggctgaacgacgactgggcatacggcaatgatcttgatgcccggccttgggacttccaggcagaggagtgtgcccttcgtgccaacattgaacgcttcaacgcccggcgctatgaccgggcccacagcaaccctgacttcctgccagtggacaactgcctgcagagtgtcctgggccaacgggtggacctccctgaggactttcagatgaactatgacctctggttagaaagggaggtcttctccaagcccatttcctgggaagagctgctgcagtgaggctgttggttaggggactgaaatggagagaaaagatgatctgaaggtacctgtgggactgtcctagttcattgctgcagtgctcccatcccccaccaggtggcagcacagccccactgtgtcttccgcagtctgtcctgggcttgggtgagcccagcttgacctccccttggttcccagggtcctgctccgaagcagtcatctctgcctgagatccattcttcctttacttcccccaccctcctctcttggatatggttggttttggctcatttcacaatcagcccaaggctgggaaagctggaatgggatgggaacccctccgccgtgcatctgaatttcaggggtcatgctgatgcctctcgagacatacaaatccttgctttgtcagcttgcaaaggaggagagtttaggattagggccagggccagaaagtcggtatcttggttgtgctctggggtgggggtggggtgtttctgatgttattccagcctcctgctacattatatccagaagtaattgcggaggctccttcagctgcctcagcactttgattttggacagggacaaggtaggaagagaagcttcccttaaccagaggggccatttttccttttggctttcgagggcctgtaaatatctatatataattctgtgtgtattctgtgtcatgttggggtttttaatgtgattgtgtattctgtttacattaaaaagaagcaaaaat

SEQ ID NO: 187049 - DNA, 3363 bp, Homo sapiens
  Payload ID: 16829
  Gene Symbol: STRIP1
  Gene Name: striatin interacting protein 1
  Uniprot ID: Q5VSL9
  ENST ID: ENST00000485775
  CDS Start-End: 7-645
gccaagatggagccggcagtcggcggtccgggcccactgatcgtgaacaacaaacagccccagcccccgccacctccgccgccggcagccgcacagccaccacccggggcaccgcgggccgccgcgggcctcctgcctgggggcaaagcccgcgagttcaaccgcaaccagcgcaaagactcagagggctattcggagtcaccagacctggagtttgagtatgctgacacagacaagtgggctgcagagctctcggagctttacagctacacggaagggccagaattcctgatgaatcgaaaatgctttgaggaggacttccggatccatgtgacagacaagaagtggactgagctggataccaaccagcaccggacccatgccatgaggctcctggatggcttggaagtcactgccagggagaagagactcaaggtggctcgagcaattctctatgttgctcaaggcacgtttggggagtgcagctcggaggcagaggtgcagtcctggatgcgctacaacatctttctcctcctggaggtgggcacgttcaatgctttggtggagcttctgaacatggaaatagaacactgctgtgttcgccctgcagtttccgccttggcaggaggccaggcacaagactgacatatgggctcaaccagtgcctggccttgcctgtgtcacctttgtccagtggacagcaacagtgccgcctgcagcagtgctgtgaggaagcctgccatctccctggctgacagcacagacctcagggtcctgctcaacatcatgtacctgatagtggagaccgttcatcaggagtgtgagggtgacaaggctgagtggaggaccatgcggcagaccttcagagccgagctgggctccccgctgtacaacaatgagccatttgccatcatgctgtttgggatggtgaccaaattttgcagtggtcacgcccctcactttcccatgaagaaagttctcttgctgctctggaagacagtattgtgcacgctaggcggctttgaggagctgcagagcatgaaggctgagaagcgcagcatcctgggcctccccccgcttcctgaggacagcatcaaagtgattcgcaacatgagagcagcctctccaccagcatctgcttcagacttgattgagcagcagcagaaacggggccgccgagagcacaaggctctgataaagcaggacaacctagatgccttcaacgagcgggatccctacaaggctgatgactctcgagaagaggaagaggagaatgatgatgacaacagtctggagggggagacgtttcccctggaacgggatgaagtgatgcctcccccgctacagcacccacagactgacaggctgacttgccccaaagggctcccgtgggctcccaaggtcagagagaaagacattgagatgttccttgagtccagccgcagcaaatttataggttacactctaggcagtgacacgaacacagtggtggggctgcccaggccaatccacgaaagcatcaagactctgaaacagcacaagtacacgtcgattgcagaggtccaggcacagatggaggaggaatacctccgctcccctctctcagggggagaagaagaagttgagcaagtccctgcagaaaccctctaccaaggcttgctccccagcctgcctcagtatatgattgccctcctgaagatcctgttggctgcagcacccacctcaaaagccaaaacagactcaatcaacatcctagcggacgtcttgcctgaggagatgcccaccacagtgttgcagagcatgaagctgggggtggatgtaaaccgccacaaagaggtcattgttaaggccatttctgctgtcctgctgctgctgctcaagcactttaagttgaaccatgtctaccagtttgaatacatggcccagcacctggtgtttgccaactgcattcctttgatcctaaagttcttcaatcaaaacatcatgtcctacatcactgccaagaacagcatttctgtcctggattaccctcactgcgtggtgcatgagctgccagagctgacggcggagagtttggaagcaggtgacagtaaccaattttgctggaggaacctcttttcttgtatcaatctgcttcggatcttgaacaagctgacaaagtggaagcattcaaggacaatgatgctggtggtgttcaagtcagcccccatcttgaagcgggccctaaaggtgaaacaagccatgatgcagctctatgtgctgaagctgctcaaggtacagaccaaatacttggggcggcagtggcgaaagagcaacatgaagaccatgtctgccatctaccagaaggtgcggcatcggctgaacgacgactgggcatacggcaatgatcttgatgcccggccttgggacttccaggcagaggagtgtgcccttcgtgccaacattgaacgcttcaacgcccggcgctatgaccgggcccacagcaaccctgacttcctgccagtggacaactgcctgcagagtgtcctgggccaacgggtggacctccctgaggactttcagatgaactatgacctctggttagaaagggaggtcttctccaagcccatttcctgggaagagctgctgcagtgaggctgttggttaggggactgaaatggagagaaaagatgatctgaaggtacctgtgggactgtcctagttcattgctgcagtgctcccatcccccaccaggtggcagcacagccccactgtgtcttccgcagtctgtcctgggcttgggtgagcccagcttgacctccccttggttcccagggtcctgctccgaagcagtcatctctgcctgagatccattcttcctttacttcccccaccctcctctcttggatatggttggttttggctcatttcacaatcagcccaaggctgggaaagctggaatgggatgggaacccctccgccgtgcatctgaatttcaggggtcatgctgatgcctctcgagacatacaaatccttgctttgtcagcttgcaaaggaggagagtttaggattagggccagggccagaaagtcggtatcttggttgtgctctggggtgggggtggggtgtttctgatgttattccagcctcctgctacattatatccagaagtaattgcggaggctccttcagctgcctcagcactttgattttggacagggacaaggtaggaagagaagcttcccttaaccagaggggccatttttccttttggctttcgagggcctgtaaatatctatatataattctgtgtgtattctgtgtcatgttggggtttttaatgtgattgtgtattctgtttacattaaaaagaagcaaaaataa

SEQ ID NO: 187050 - DNA, 5115 bp, Homo sapiens
  Payload ID: 16830
  Gene Symbol: STRIP2
  Gene Name: striatin interacting protein 2
  Uniprot ID: Q9ULQ0
  ENST ID: ENST00000249344
  CDS Start-End: 41-2545
aaagcgagctgaaccctgaggggagccgctgaccagcagcatggaggaccccgccgcgcctgggaccgggggcccgcccgcaaatggcaatggcaacggcggcggcaaagggaagcaggcggcgcccaagggccgcgaagcgttccgaagccagcggcgggagtcagagggctctgtggactgtcccactctggagtttgagtatggagatgcagatgggcatgcagccgagttgtcagaattgtatagttacactgagaacctggaattcaccaataacaggaggtgctttgaagaagatttcaagactcaagtgcagggcaaggaatggctggagttggaagaagatgcccaaaaggcctatataatgggactcttggaccggctagaggtggtcagtagggaacggcggctgaaggtggcccgggctgttctctacctggcccaaggtacttttggggaatgtgattcagaggtcgatgtgctacactggtccaggtacaactgcttcctgctgtatcagatggggaccttctccaccttcctggagctactccacatggaaattgacaacagccaggcctgtagcagtgcccttcggaaaccagctgtctccatagctgatagcacagagctcagggtgctgctgagtgttatgtacctaatggtggaaaatattcgcctggagcgagagacagacccctgtgggtggagaacagcccgggagaccttccgcactgaattaagcttctccatgcataatgaggagccttttgcccttttactcttctccatggttaccaagttctgcagtggcctggctcctcacttccccataaagaaggtcctgctcctgctctggaaggtggtcatgtttaccctcggtggatttgagcatctgcagactctcaaagtacagaagcgggcagaattgggcctgcctccactggctgaagacagtatccaggtggtgaagagcatgcgtgctgcctccccgccctcttacactcttgacctgggagagtctcagctggcacccccaccctccaagctgcgaggccgccgtggctctcgaaggcaactcctcactaagcaggacagcctggacatctacaatgaaagggatctcttcaagactgaggagcccgccacagaggaggaagaggagtctgctggtgatggagaacgaaccttggatggagagctagacctgctagagcaggaccctctggtgccacctccaccctcacaggcacccctctctgctgagcgggtggcttttcccaagggcctgccctgggccccaaaggtcagacagaaggacattgagcacttcttggagatgagcaggaacaagttcatcggattcaccctggggcaggacacagatacattggttggattacccaggcccatccatgagagtgtgaagaccctaaagcagcacaagtatatctccatcgcagatgtgcagatcaagaatgaagaggagctggagaagtgccctatgtctttgggggaagaggtggtaccagagacgccatgtgaaatcctctaccagggaatgctgtacagccttccgcagtatatgatcgctctgcttaagattctgctggctgcagctcccacctctaaggctaagacagactctatcaatatcctggcagatgtcctacctgaggagatgcccatcactgttctccagagcatgaagctgggcatcgatgtgaacaggcacaaggagattattgtaaagagtatctctaccctgcttctgctactcctcaaacacttcaaactcaaccatatctaccagtttgaatatgtatcgcaacatttggtatttgccaactgcatccccttgatcctgaagttcttcaatcaaaatatcttgtcatacatcactgccaaaaacagcatctcagtcctggattatccttgctgtaccatccaggatttgccggagcttactactgaaagtctggaagctggagacaacagccagttctgctggaggaacctcttttcctgcatcaacctcctgaggctgctcaataaactgaccaaatggaaacattcccggaccatgatgctggtagtgtttaaatcggcaccaatcttaaagcgggccctcaaggtcaaacaggccatgctgcaactttatgtcctaaagctactaaagttacagaccaagtacctggggcgccaatggaggaaaagcaacatgaaaaccatgtcagccatttaccagaaagtgcgtcaccgcatgaacgatgactgggcttacgggaatgacatcgatgccagaccatgggacttccaagcagaagaatgtaccttgagggccaacattgaggcttttaacagccgtcgctatgacagaccccaggactctgagttttcacctgtggataactgcttgcagagcgtactggggcagaggttggatctgcctgaagatttccactattcatatgagctctggctcgagagagaggtgttttcacagcccatctgttgggaggagctgctccagaatcactgactaagttcttgtcaacaagcatcaatagatagaggtcagctccaataaactgtgctctgcctaccctgtccatacaggcgctgttaccagttcagggctcttctgggggctcttgggcctaaagatggtgcaagggtgggatcctgaatcacaataaaatgatcaacttgccctggggtcagttgggtgcccagttggccttggaaatcttttggtggatcaattctagacaagctctttggtaggaccttttcctgctttagtcttggctacaaccaggctagactttgctggctctaaaagaggaaatttgttatggcatttgacccatggcattcatcacagatagtgggaggtacaagtcataaaatagggagaaagttttcttcttgctcacactggattcctaggacttatcagagatttggaaaaaccaactttgaaattaagtttgcattttaaatttcaaatttggaagcctctttctgaaatcattagctctaagattattttagagcacctgcaccttctttgtgaaggatgatgatttactattccctcaatactgcatgttatcgaaaagtgtgttgtgtaaagtgtttttttcctcattctgtaagagatctatattcaatgtgaaaattatttccttgtgtactctgtatagggcatggaatgctctgccatttttaaagagccacaaccaatatgaaataattaggtcctctctaaggatgtttcatgtttttcttaaatgactccagtcttcaaatggctgagcatactgcagaaaattatccttttcatctaattcattttttaaatgacaagttaactacaggaggctttatttattcagatggtatgtccacttgtggtcgtgatcaatatatttttctaattgaaaagtaaaagcatcacagcttaccatttttctttttctgcagtgttgattaatgatttttttcccgtttattgctagcagtttcaaagtgtcatgtggagatttagcaatactgtctctacttaaaagtattgcacatttcattgaaaatgtgagagttgatataccagcctctttatatttctcttttacagcagaatcacatacttctcaagataaacaaggtttttaaaaaagtttctgatttagttaggatcatatgcttttttttttttttttttttttttttttttttttgagacagagtttcgctcttgttgcccaagctggagtgcaatggcacgatctcggctcactgcaacctccgcctcccgggttcaagcgattctcctgcctcagcctcccaaggagctgggattacaggcacgcaccaccatgcctggctaattttttgtatttttagtagaaacagggtttcaccatgttagccaggctgacctcaaactcctgacctcaggtgatccgcccgcctccacctcccagggtgctgggattacaggtgtgagccaccatgcccagcctcttcaagcttttttactatacatgttgcccctctcccccaacttaggcactactgaattttttatgatggcaccaggtcactttatgctgggtgatatagtcaaaatttgcttatttactctgcccctcgtcaaccacagtatcatttcaaggacatgaataaaatacttgacagtatccaaaggagctataccaaaatctaacaagtaaattttggattttgcctctttgtgctttaaagtaccaggatttctgtctctatggataggtcttggagaatgttaagtaatggatgaaactttttaaaataatttgtaaattttacctaagtaggacagtagtccttactgcaatcaaaataatttactgagcacaactcctgtaaattaatctacagtcaggctagtatgattttaatatgatttgagtaaaaagataattttcaaggaaagagtaatcatccatcaatttattataaagccagatagtattcaatttatgtcaagaacaaagaaattgcccttttaaaagcatgtacgtgaatgctttttgaggcacagaagtatgctaagctttaacattttgtatttatttacaacccttttctaagggaaggttacttctcagtgcagatggagaaactgaagcactaaggataaatgattagtttccaatcacatcatttttttccacagacttgctgggactagctttcaggtattgacagccagccccatatattaaggtaaccaggttgaatcttccaatttgagaacccatgtatgggttgcagtgagccgagatcatgccactgcactccatcctgggcaacaagaacgaaactccgtctcaaaaacaaagaaggatataataaagttaatatataaaccatgtatgtggttaggaataaattcaaattcaccagtctccaatggtgattacttttactacatagaaaaacattttagtgacttacagaggatttttatttgtgaatatttcagtaaagtttgtgttgattgttgataacactgttcatctactgaagcactttaataaaaataaaatgagctggaattagaaa

SEQ ID NO: 187051 - DNA, 2866 bp, Homo sapiens
  Payload ID: 16830
  Gene Symbol: STRIP2
  Gene Name: striatin interacting protein 2
  Uniprot ID: Q9ULQ0
  ENST ID: ENST00000435494
  CDS Start-End: 28-2304
ccctgaggggagccgctgaccagcagcatggaggaccccgccgcgcctgggaccgggggcccgcccgcaaatggcaatggcaacggcggcggcaaagggaagcaggcggcgcccaagggccgcgaagcgttccgaagccagcggcgggagtcagagggctctgtggactgtcccactctggagtttgagtatggagatgcagatgggcatgcagccgagttgtcagaattgtatagttacactgagaacctggaattcaccaataacaggaggtgctttgaagaagatttcaagactcaagtgcagggcaaggaatggctggagttggaagaagatgcccaaaaggcctatataatgggactcttggaccggctagaggtggtcagtagggaacggcggctgaaggtggcccgggctgttctctacctggcccaaggtacttttggggaatgtgattcagaggtcgatgtgctacactggtccaggtacaactgcttcctgctgtatcagatggggaccttctccaccttcctggagctactccacatggaaattgacaacagccaggcctgtagcagtgcccttcggaaaccagctgtctccatagctgatagcacagagctcagggtgctgctgagtgttatgtacctaatggtggaaaatattcgcctggagcgagagacagacccctgtgggtggagaacagcccgggagaccttccgcactgaattaagcttctccatgcataatgaggagccttttgcccttttactcttctccatggttaccaagttctgcagtggcctggctcctcacttccccataaagaaggtcctgctcctgctctggaaggtggtcatgtttaccctcggtggatttgagcatctgcagactctcaaagtacagaagcgggcagaattgggcctgcctccactggctgaagacagtatccaggtggtgaagagcatgcgtgctgcctccccgccctcttacactcttgacctgggagagtctcagctggcacccccaccctccaagctgcgaggccgccgtggctctcgaaggcaactcctcactaagcaggacagcctggacatctacaatgaaagggatctcttcaagactgaggagcccgccacagaggaggaagaggagtctgctggtgatggagaacgaaccttggatggagagctagacctgctagagcaggaccctctggtgccacctccaccctcacaggcacccctctctgctgagcgggtggcttttcccaagggcctgccctgggccccaaaggtcagacagaaggacattgagcacttcttggagatgagcaggaacaagttcatcggattcaccctggggcaggacacagatacattggttggattacccaggcccatccatgagagtgtgaagaccctaaagcagcacaagtatatctccatcgcagatgtgcagatcaagaatgaagaggagctggagaagtgccctatgtctttgggggaagaggtggtaccagagacgccatgtgaaatcctctaccagggaatgctgtacagccttccgcagtatatgatcgctctgcttaagattctgctggctgcagctcccacctctaaggctaagacagactctatcaatatcctggcagatgtcctacctgaggagatgcccatcactgttctccagagcatgaagctgggcatcgatgtgaacaggcacaaggagattattgtaaagagtatctctaccctgcttctgctactcctcaaacacttcaaactcaaccatatctaccagtttgaatatgtatcgcaacatttggtatttgccaactgcatccccttgatcctgaagttcttcaatcaaaatatcttgtcatacatcactgccaaaaacagcatctcagtcctggattatccttgctgtaccatccaggatttgccggagcttactactgaaagtctggaagctggagacaacagccagttctgctggaggaacctcttttcctgcatcaacctcctgaggctgctcaataaactgaccaaatggaaacattcccggaccatgatgctggtagtgtttaaatcggcaccaatcttaaagcgggccctcaaggtcaaacaggccatgctgcaactttatgtcctaaagctactaaagttacagaccaagtacctggggcgccaatggaggaaaagcaacatgaaaaccatgtcagccatttaccagaaagtgcgtcaccgcatgaacgatgactgggcttacgggaatggtgagtcttcccaaagctcttgacttcctggagtttcctggggtttagacaaaactaaataaatatttatcactcctcttttggcatgaattgttacatattttagatgaaaaaatatgtgattataggtcaggcgctgatacaccaaactttaaggttatgcctcaaattctagtatgtacccttgtcctatgtaaactatgaaaatccgttttataaaacaagtaaattgagagataattaattgcctttccaaaacattcttttaaatgacagctttctccaaaagatttaaattaaaacaactttttattattacaaagcagttagaaaaaaagatagaaaatacaagtaaacaaacattttactatattatatttatgccatatttgtactatgcagaaattgccaccattaacatcttattgtatattcctccagatctttttctatgcatatacatgcatattttatcaaaatgaaagcaagttatgtatgctattttgtaattttctcttttaacattatctctaccttttcatgtcagtacattttcatttcatctaataaagttcatattcacaa

SEQ ID NO: 187052 - DNA, 8168 bp, Homo sapiens
  Payload ID: 16831
  Gene Symbol: STRN
  Gene Name: striatin, calmodulin binding protein
  Uniprot ID: O43815
  ENST ID: ENST00000263918
  CDS Start-End: 10-2352
gcggccgccatggacgagcaggcgggtcccggcgtcttcttcagcaacaaccacccgggcgccggcggtgccaaggggctcgggcctctggcggaggctgccgcggccggcgacggggcggctgcggcgggggcggcccgagcccagtacagtctcccggggatcctgcacttcctgcagcacgagtgggcccgcttcgaggtggagagagcccagtgggaggtggagcgggcggagctgcaggcccagattgccttcctgcagggagaaaggaagggccaagaaaatttgaagaaggatcttgtgaggaggatcaaaatgttggagtatgctcttaaacaggaaagagccaaataccacaagttgaaatacgggacagaattgaatcagggagatatgaagcctccaagctatgattctgatgaaggtaatgaaacagaagtgcagccacaacaaaacagccagttaatgtggaaacaaggtcgacaactactcagacagtatctacaggaggtgggttatacagatactattctagatgtgaaatctaaacgagtgcgagctttgttgggcttttcaagtgatgtcacggacagggaagatgacaaaaatcaggactcagttgtaaatggcacagaggctgaagttaaagagacagcaatgattgcaaaatctgagttaacagattctgcctccgtgctggataatttcaaattccttgaaagtgcagctgcagatttcagtgatgaagatgaagatgatgatgttgatggaagagagaaaagcgtcattgatacttcaacaattgttaggaaaaaagcattgcctgacagcggtgaagatcgagatacaaaagaagctctaaaggagtttgacttcttggttacatcagaggaaggagacaatgaatctagaagtgcaggcgatggaacagactgggaaaaggaagaccagtgtctcatgcctgaagcctggaatgtggaccagggagtaattaccaaactcaaggaacaatacaaaaaggagagaaaggggaaaaagggggtgaagaggcccaataggtcaaaactacaagatatgcttgctaatttgagagatgttgatgaacttccttcattgcagccatctgtgggttcaccttccagacccagcagctccaggcttcctgaacatgaaattaatagggcagatgaagtggaagcattgacatttcctccttcttctggaaagtcattcatcatgggagcagatgaagcccttgaaagtgaactgggacttggagaactagcaggccttacggtggccaatgaagcagactcactaacttatgatatagcaaacaataaagatgcattgaggaagacatggaaccctaagtttacattgagaagtcactttgatggcatccgagcccttgctttccatcccattgagcctgttttgataacagcatcagaggatcacacattaaaaatgtggaatttacagaaaacagccccagccaaaaagagcacttctcttgatgtagaacctatctatacattcagagcccataaaggtccagtgctttgtgtggtaatgagcagcaatggtgagcagtgttacagtggtggtactgatggactgatccagggctggaataccactaatcccaacatcgacccctatgattcttatgatccttctgttttacgaggccctctgctaggccacacggatgcagtctggggtttggcttatagtgcagcacatcagcgtttgttgtcctgttcagcagatggcactctgcgtttatggaatacaactgaggttgctccagcactaagtgtatttaatgatactaaagaactgggaatccctgcctctgtggatctagtgagcagtgacccgagccatatggtagcatcattcagcaagggatatacaagcatttttaacatggaaacacaacaacgcattctcactttagaatccaatgtagatacaacagccaactcttcctgccaaataaatagagtcatcagtcatcctactcttccgatcagcatcactgctcatgaagacaggcacatcaaattctatgataacaatacaggcaaactgatccactcgatggtagcccacctagaagctgttacaagtttagcagttgatcccaatggcctttacttgatgtctggcagtcatgactgttcaatacgtttatggaatctagaaagtaagacgtgtatccaagaattcacagctcatcgaaaaaagtttgaagaatcgattcatgatgtagctttccacccatccaaatgctatatagccagtgctggagctgacgcactggctaaagtctttgtatgacgcaatgcatcatcttcaccttctagctgtttataagtaatcaactgcacacaagagatacagaagacgagggcaagaatcatctcgtcctgcccttttgttctgctgaaggagcacagagaacatttgttgaagtatagttttgcaattcatatactgttttctaaaactaaggtttgttcaggttgctgcaagctcagctgaatctgtgagcctgaggtctgtttcaaatttctccccaataggcgcctttatttctgaggtggttctaattcgctaggcaggcctgagcgaatacaagtttagcttgtccctgttgagtaagtagggcatgctacaatggataatttaaaagcttgatagctgggactgaatagaagaaaacgggaaacttagaccaagttctcccctgagaaatcttgttaaaacacattaagtagtcaaaatagtaatctttatcatatctgccatattaacccctttgtgtataatgaccaggcagtgttaaactgagtttttaatttgactctcctttcagctgttcacataaagcacctggcaaagcattttacctgttagggggagaaaaatgcaataatatgttaaatatattattattcagaaatgctagacaaatagtttgcaagcagatttctatattgtattacagttttgaaaacagatttggtatcattctaaagtttagctatcaagcactcaccattgtgaagaatagttgatcgactctgcttttactaacagatttaacttattcaggtttgaaattctgtttatttttaagggtaaacagggcatatctctttaataatttctattttaaaattcactttattcatgtgacatttatagtaccagagtgattatttcataccaatgaaatcttacttttcagtgactgaaaagatagaatttatttgctaataatcatttatcaacacccacctaatcatgcttcagatgatctgtgctctttcttctttgtcacgttcaagttatctgacatctaccaagaacagttcataattattaatagcccaaagagtatggttaacttcacgcagctgcttttgcagaagcactaataaaaacaaatattttgtaccctagaagtcctctattaatccctgtaagaatctcctggaaacctggatgaaagagtttaatgccaaatattggctaaaaagttctgtctttctctctccctattcctcccccattgtttaattgagatatacatgttttaatgggcagtggatcagtattgtttctggggaaatccacaccttaaaaggccaggcttccccagcccaacttacctgtgacccacctacatgtgttcaccttttgggattctgaagaccctgctatctagacctagtctcctgtcataaagacattatttctatagtggtttatgtctctcttactctttgtcccaaatgacagagaccaatctagaaattggaaataaattattaacgtccaactttccaccaaaaaacatataaataggctcttagattttaaaaatattaaatctatagatattttaaccaattaaaacaatttctacatattccattccccacattttccatcgtcataacaatgatgcttctcatgatacgtacatctactccttgaaaaagtattctggtggtggtgtggctaatgattgacaaatatttctgtaaaatttctgcctgtttgcctctagaattctgcattatacaggcaaattttctttaaagctagagacttgtgctaaatttgcctgattttcatacagatatgctgtagtaatacagctaccttttcatttcatctttgtgctttggttaacaagcaggctcaagagactgctttgtgtaattaaatgaattgacctaaacatgagctgtcaggtgaatacttaatatttccatgcagatacagaattccatattgtgttcagtaaatttcttttggttcttcacagtgaagaaagaatgtttctaacctaacatttgtagaaggatactggaaaattccttccaggaaggaaggaaggaagatgccattacttggtgtatttatgatggatgaccacaaagctattgttctaccagttattaattaccttctaagatcttcagttactgctttattaatgtcactgaaattctaaaaaccaggacattcttcccccgttcattttatgcttcatggttgaaatttttctgtcagtgagtggaaaataaccatgagatacatagactgtagcgcaaatggaactgttgaaagttccttagaaagccagtgctgtggcattggagactacggagagagtcttctctaccagcactgcatgatctcagcctagaaatgagccaaagctgtcttccaaccagagtagcatatacatgtgtctgacttttcccctagcctgttgaacattcaatgaaaattcacagaatgaacaaattcaatgtttaaacagccattgaaatgctttcatagtgcttcatttgtaaatattttgtttgaaatgtattggaatagtatgaaaattagcgggaggtttggatccctgccttattttcatatgctgtggatacatctctgggagcttgcagcacccttctcaaaactcaactgtcatatggagctcatttgctactcaaaccatagacagattatttaacaaaagtgatataatgaccttcagtatttttctattgaacaagtttaacaacttttgccattaaacaaatacttagttatgcaaaatatttcgcttttataatcattttagttatgactaaaacgggggaaattgagctgcatcactgatgatgaactttgtgagaaattttttttttaatctgactttcattccttcagtattcttgctataaatttcttttggagataatgatgaagatttatttgaaaatgtctaaaatgtatgtatattttataaatatatattatatatattgtaagaatatatataatatataaactatatatatatatatatatatatatatatatatatatatataaaccataggtgcattttactgttttgtattttcatttttggaggtagtatacacagcagataatgatgagtatgatgagtgttgtgctgtttgcttttgcagtataatatatagttctaagtgtttaaattactgtatatacaatattcattataggctagcatgcttgttttaaagactgtcattctagtgtattaaaatctgaatgtaagaaaacctggctattcaaatgtgaattgaaaaatattttattctcagtactgaactatttccattgaacattcagactttttaacaaaaacaaatatcatcaagaaggcaatagctagaaaatgagaggtgcctttaaaaaaaaaaatgcagccttacagtgaggatgaagattgagtttggggagggggtgggagggggggcacagagagagagagagagttagtgtgtgtgtgtgtgtgtgtgtgtgtgtgtgtgtgtgcatgcatgcgtgtgtgtgtgtgtgtgtgtgtttaccaatctgtgaaggtcctgatttgtgaccatcaatgtctttttaatgtatctgctcaacttctaggacttcaggggacatttcatgcgctttgtgctcttctgagcaccatatatactttccaagaattttgaatgtgaattcctagaaatttcagtagagaaaacaatagctattctttaattatagtaaagttcaggtagaaggagaaattatttgttcaccaaaattatgggatctcattaatgttggctaagtaaatgtaattttttaaaggctcactttttaatacttcatatatttccctcttacaaaacagcatgtcatgaagttcttatgtggtaaagattcaactagtaaatatttttaggttaaatacctgaactagttaaaattccacctaagaatagtcttaaaatatttaaaaagcatctctcatatctacctctttgtcattgctgccattttaactgaagcaaatctttatgacatctgaaatgatggttggatgcaattaaaaaaaaatctatgttggtgcttttctcaggctttgtcatttaagttatattgtattaagatgtcacaaatcagactgaaaggcttagaattaattttgtttttctttgaaagaattgcttaaaattaaccatcaatgtttttagcgagtggagataatgaatctttggttggtgtctgtctgtgtgatgttttcaaccaatagccaaataattattgaacttacatgaaaaagagtgctaagtataattttatttagattactttattctttgaaagtgactacaaggctattaagtacataatcattcattttatttactcagaagttgcctctccattactgttaacttgtttagtaatttatataattgcagtacttttaagtgttggacactgggattcaggttgtatacaaagtagtagctgacgaaaaatatgtatatttttgtgaaatgtatcaagccctaaagttcattttagagaaaggcccagaaaaacgtatctgtgtttaaaaacaaaggacaggtcattcgtcaatttgaatcatttttacttttgccactacaaactttttaattggcaatatccatcatccaactggatcttcatgtcagtgtcagggatgccaggttgacaaagtatttaacagatcctttcagtttttgttttgtttttttaattctaaaaaaaacaaatgttaggccaaacagatccctagatcccactcattgattctggcggtattcctaaagtggtgcttagggggtcagaattttctggatctttgctaatccaagctttagatttaatttaaccaggaccacatgcttgtcatctctctgatgcaaattttcaaaatcattttaatttagattctaatgtctgcctgggtttttaacaggctgtgaaccagtgagtgccttgttaatgtagaatgatttttcccccctgggtgggtgttagttagctcctctctgaaaatgtctcagagaatggtattttaattgacttgtagagagctgctaaatttgttattatcagcaatcagaaagtctttggtctaccacacatctccctccctactatctcttcattgtttggctgaagtttgcctcttgtgagaaaacaatacaactccccttctccacacactttttttccagcccagattaataggtatcccctaccctaatcccaactctatgatctaataccttttttaggaggaaccacttctttttaatattgaaatctgctggttactttatgttttctcaagttcagttgactagagctgaccacagggtgtcatcaattcagattcctaaataaccctttctctccacacccagtcctccagctggtgagccctgggccagattgtttgatcttcaggtattttaaattttagttacatcaattaatgtaaattaatccaaatgctaatttttgtggtgcaagaagtttcttatgtaaattcagggtatggataagctaattaagatatccatctttggtggctctaagtgtattatttgtttttaaataaagtgtacaaatatagataacatgctataggtgtctcatgaattggaatatttgtcagatttgggatctagctgtggctttacagtaatcagttaaattaacatagtctgatttggggcttttgggggaggagttgtagaggggtgcagagaaataaaaggatattagacaaagta

SEQ ID NO: 187053 - DNA, 2254 bp, Homo sapiens
  Payload ID: 16831
  Gene Symbol: STRN
  Gene Name: striatin, calmodulin binding protein
  Uniprot ID: O43815
  ENST ID: ENST00000379213
  CDS Start-End: 9-2204
cggccgccatggacgagcaggcgggtcccggcgtcttcttcagcaacaaccacccgggcgccggcggtgccaaggggctcgggcctctggcgggggcggcccgagcccagtacagtctcccggggatcctgcacttcctgcagcacgagtgggcccgcttcgaggtggagagagcccagtgggaggtggagcgggcggagctgcaggcccagattgccttcctgcagggagaaaggaagggccaagaaaatttgaagaaggatcttgtgaggaggatcaaaatgttggagtatgctcttaaacaggaaagagccaaataccacaagttgaaatacgggacagaattgaatcagggagatatgaagcctccaagctatgattctgatgaaggtaatgaaacagaagtgcagccacaacaaaacagccagttaatgtggaaacaaggtcgacaactactcagacagtatctacaggaggtgggttatacagatactattctagatgtgaaatctaaacgagtgcgagctttgttgggcttttcaagtgatgtcacggacagggaagatgacaaaaatcaggactcagttgtaaatggcacagaggctgaagttaaagagacagcaatgattgcaaaatctgagttaacagattctgcctccgtgctggataatttcaaattccttgaaagtgcagctgcagatttcagtgatgaagatgaagatgatgatgttgatggaagagagaaaagcgtcattgatacttcaacaattgttaggaaaaaagcattgcctgacagcggtgaagatcgagatacaaaagaagctctaaaggagtttgacttcttggttacatcagaggaaggagacaatgaatctagaagtgcaggcgatggaacagactgggggcccaataggtcaaaactacaagatatgcttgctaatttgagagatgttgatgaacttccttcattgcagccatctgtgggttcaccttccagacccagcagctccaggcttcctgaacatgaaattaatagggcagatgaagtggaagcattgacatttcctccttcttctggaaagtcattcatcatgggagcagatgaagcccttgaaagtgaactgggacttggagaactagcaggccttacggtggccaatgaagcagactcactaacttatgatatagcaaacaataaagatgcattgaggaagacatggaaccctaagtttacattgagaagtcactttgatggcatccgagcccttgctttccatcccattgagcctgttttgataacagcatcagaggatcacacattaaaaatgtggaatttacagaaaacagccccagccaaaaagagcacttctcttgatgtagaacctatctatacattcagagcccataaaggtccagtgctttgtgtggtaatgagcagcaatggtgagcagtgttacagtggtggtactgatggactgatccagggctggaataccactaatcccaacatcgacccctatgattcttatgatccttctgttttacgaggccctctgctaggccacacggatgcagtctggggtttggcttatagtgcagcacatcagcgtttgttgtcctgttcagcagatggcactctgcgtttatggaatacaactgaggttgctccagcactaagtgtatttaatgatactaaagaactgggaatccctgcctctgtggatctagtgagcagtgacccgagccatatggtagcatcattcagcaagggatatacaagcatttttaacatggaaacacaacaacgcattctcactttagaatccaatgtagatacaacagccaactcttcctgccaaataaatagagtcatcagtcatcctactcttccgatcagcatcactgctcatgaagacaggcacatcaaattctatgataacaatacaggcaaactgatccactcgatggtagcccacctagaagctgttacaagtttagcagttgatcccaatggcctttacttgatgtctggcagtcatgactgttcaatacgtttatggaatctagaaagtaagacgtgtatccaagaattcacagctcatcgaaaaaagtttgaagaatcgattcatgatgtagctttccacccatccaaatgctatatagccagtgctggagctgacgcactggctaaagtctttgtatgacgcaatgcatcatcttcaccttctagctgtttataagtaatcaactgcac

SEQ ID NO: 187054 - DNA, 3970 bp, Homo sapiens
  Payload ID: 16832
  Gene Symbol: STRN3
  Gene Name: striatin, calmodulin binding protein 3
  Uniprot ID: Q13033
  ENST ID: ENST00000355683
  CDS Start-End: 217-2358
aaagtgagtgagtgagacgggcagatggaggagggattgtaatggcggcagccggcagctccctgctctgacccacggcaggcacacagcaacgaccccttccccgcccctctcccggccggcctccgccccgcagccagcgcggggccaccctctccggcccttcccccagctgtcggcgtctcgccctgcgccccggccggggccccacacacaatggacgagcttgccggaggcggtggtggcggcccggggatggcggcccctccccggcagcagcagggacctggggggaacctgggcctttcgcccggggggaacggagcggcgggcggcgggggtcctccggcctccgagggagcgggtcccgcggcaggccccgagctgtcccggccgcagcagtacactatcccggggatactgcactacatccagcacgagtgggctcggttcgagatggagcgggcgcactgggaggtggaacgggccgaactgcaggcccggattgcatttctacaaggcgaaagaaaaggtcaagagaacctgaagaaggacttagtaagaagaataaagatgttagagtatgcattaaaacaagaaagggcaaaatatcacaaattaaaatatggcacggaactgaaccaaggtgacttgaaaatgccaacctttgagtcagaagaaaccaaagacacagaggctcccacagcacctcagaatagccagttaacgtggaagcaaggcagacagcttttaagacagtatcttcaggaagtaggttatacagatacaatattagatgtacggtctcagcgggtaaggtcattacttggactatctaattcagaaccaaatggatcagtagaaacaaagaatttagaacagatcctgaatggaggtgaatctcctaagcaaaagggacaagaaataaaaaggtcctctggtgatgttcttgagacgttcaatttcttagaaaatgccgatgacagtgatgaagatgaggaaaatgacatgatcgaaggcatcccagaaggaaaagacaaacatcggatgaataaacataaaataggtaatgaaggtttagctgctgacctaactgacgatcctgatactgaggaagcactgaaagaatttgattttttagtgactgctgaagatggtgaaggagctggagaagcacggagttcgggggatggcacagaatgggctgaaccaataacgtttccatctggaggaggcaagtcatttattatgggttctgatgatgttttgttaagtgtactgggccttggagaccttgcagacttgacggtaacaaatgatgcagactatagttatgatttgcctgctaataaagatgcctttcgaaagacatggaatcccaagtatacactacgtagccattttgatggagtacgggcattagcttttcatcctgtagaacctgtgctggttactgcttctgaggaccataccctgaaactttggaacctgcaaaaaacagttcctgccaaaaagagtgcctctttagatgtagagcctatctacacatttagggcccacatcggccctgttctgtcattagctattagttctaatggagaacagtgttttagtggtggtattgatgcaaccatccagtggtggaatatgccgagtcccagtgtagatccatatgatacatatgagccaaatgttctagctggcactttagttggtcatacagatgcagtttggggtcttgcttatagtggcataaaaaatcaattactgtcttgttcagcagatggcactgttaggttatggaatccacaagaaaaattgccatgtatttgcacttacaatggagataaaaagcatggaatacctacatcagttgactttataggctgtgatccagctcatatggtaacctctttcaacactggtagtgcagtaatttatgatttagaaacatcacagtcattggtgatactttcatcacaggtagattctggtttacaatctaataatcatatcaacagagtagtaagtcatcccacacttcctgttacaataactgctcatgaagatagacacatcaaattttttgacaataaaacgggtaaaatgatccattctatggtagctcacttggatgctgttacaagtctagcagtagatcctaatggaatctatttgatgtctggaagccatgactgttccatcagattatggaatttagacagcaagacatgtgtgcaagaaataacagctcacagaaagaaattggatgaatcaatttatgatgttgctttccactcgtcaaaagcatatatagctagtgcaggagctgatgctcttgccaaagtatttgtatgaatcaacaaaaacttgcatcgtaacaagatttgcttggacagaaagagggtctgcatcactgccatcagaaaggttactgatatgacactacatgtgatctgcctggtgaaggctatctggggcaggcacaaattggtggaaatcacatcttaatgtcaagctcattaagttaactgtaattactgtattttgtgggacaaagaaaaaaggactccagtatttgtggcctgtactggatgtgaactgagcgtatatctgtttttaggtgtctttaagccaatgtggagtctgatctttcaaaaaagtttttttttttctcttcttcttcttcttttttttttttttttttttttttttggactctgtgtgctgccttaggggttaggaatgtggtgctcttgttgggggaagtgagctccaagagtagctttttttcatctcttagtgatcttctgtttatcggttgaatgccacagattcccttttaaacttattttgctttaaaaaaaaaaaaaaagaaaaagaaaatttaacttaaaatattttagcattagttgcacaaaatgtttggataaaattctagtttttataagtctttttatatatttagcctgtcacaacagtgctcaagattgtattgaagtttttctgcattatacaaccctaaaacacagagatctcactgacccgttgccctgtaaccactttctttccttcttttgcctaatacagctcagctaagtccttccataaagatgctaaataactttcatcatcacataaatgtcttcataaaccaaggactattaagtgtattaaaatgaaacagtggggtttagtactccaaatgaactcttaaagaaaaaaactaatcttggcatcctatcactatgtgatattttgtacatcttactgtatttacaagtttatttatcaaggattatccatcttgctaatggcctattatttatttcactttttgttggtctttatatccttttattaatgtgctaaaggaacctgtatatctattttggaactctttgaatagtctaaaatagactaaaaatggagtattttatagtttaaattacaaaccaaggtggttccccctaagatatatatcttggtttaccatgattccaaacaaaactaacttgtttaaaaatatttggagtaaagttttatttgcattacaaataggatacaaaaatagttgaatcaggatacagaaatctgctgtgttttgactagttatccctgttttatttttttagatgtgcttaattttatggtgtaactaaagattttgtttgtgtaatgcatgattaagacaataaagtattttttctagtcttccgagaaacttttctgatcagtttgcgagttttgatgagttttgtaaggtttttgttttacaaactatgaatcagcaaatttttaagattgtaccacatagcaaacatacagctgttgaaaaataatgtatataaaatgcatataataaatattaaattgtgtacctgtatgttactgttggctacatcattttgtgttgaataataaagtgcaatactttattctccataattaaactaggaaatggagattt

SEQ ID NO: 187055 - DNA, 2799 bp, Homo sapiens
  Payload ID: 16832
  Gene Symbol: STRN3
  Gene Name: striatin, calmodulin binding protein 3
  Uniprot ID: Q13033
  ENST ID: ENST00000357479
  CDS Start-End: 198-2591
ggcagatggaggagggattgtaatggcggcagccggcagctccctgctctgacccacggcaggcacacagcaacgaccccttccccgcccctctcccggccggcctccgccccgcagccagcgcggggccaccctctccggcccttcccccagctgtcggcgtctcgccctgcgccccggccggggccccacacacaatggacgagcttgccggaggcggtggtggcggcccggggatggcggcccctccccggcagcagcagggacctggggggaacctgggcctttcgcccggggggaacggagcggcgggcggcgggggtcctccggcctccgagggagcgggtcccgcggcaggccccgagctgtcccggccgcagcagtacactatcccggggatactgcactacatccagcacgagtgggctcggttcgagatggagcgggcgcactgggaggtggaacgggccgaactgcaggcccggattgcatttctacaaggcgaaagaaaaggtcaagagaacctgaagaaggacttagtaagaagaataaagatgttagagtatgcattaaaacaagaaagggcaaaatatcacaaattaaaatatggcacggaactgaaccaaggtgacttgaaaatgccaacctttgagtcagaagaaaccaaagacacagaggctcccacagcacctcagaatagccagttaacgtggaagcaaggcagacagcttttaagacagtatcttcaggaagtaggttatacagatacaatattagatgtacggtctcagcgggtaaggtcattacttggactatctaattcagaaccaaatggatcagtagaaacaaagaatttagaacagatcctgaatggaggtgaatctcctaagcaaaagggacaagaaataaaaaggtcctctggtgatgttcttgagacgttcaatttcttagaaaatgccgatgacagtgatgaagatgaggaaaatgacatgatcgaaggcatcccagaaggaaaagacaaacatcggatgaataaacataaaataggtaatgaaggtttagctgctgacctaactgacgatcctgatactgaggaagcactgaaagaatttgattttttagtgactgctgaagatggtgaaggagctggagaagcacggagttcgggggatggcacagaatgggataaagatgacctctccccaactgctgaggtttgggatgtagaccagggactaataagtaaactgaaggaacagtacaagaaggaacgaaaggggaagaaaggggtgaagagggccaacaggacaaaactctacgacatgatagctgatctgggagatgatgagctgccccacatcccttcaggaatcattaatcagtctaggtcagcctctactagaatgactgatcatgaaggtgcaagagcagaggaagctgaaccaataacgtttccatctggaggaggcaagtcatttattatgggttctgatgatgttttgttaagtgtactgggccttggagaccttgcagacttgacggtaacaaatgatgcagactatagttatgatttgcctgctaataaagatgcctttcgaaagacatggaatcccaagtatacactacgtagccattttgatggagtacgggcattagcttttcatcctgtagaacctgtgctggttactgcttctgaggaccataccctgaaactttggaacctgcaaaaaacagttcctgccaaaaagagtgcctctttagatgtagagcctatctacacatttagggcccacatcggccctgttctgtcattagctattagttctaatggagaacagtgttttagtggtggtattgatgcaaccatccagtggtggaatatgccgagtcccagtgtagatccatatgatacatatgagccaaatgttctagctggcactttagttggtcatacagatgcagtttggggtcttgcttatagtggcataaaaaatcaattactgtcttgttcagcagatggcactgttaggttatggaatccacaagaaaaattgccatgtatttgcacttacaatggagataaaaagcatggaatacctacatcagttgactttataggctgtgatccagctcatatggtaacctctttcaacactggtagtgcagtaatttatgatttagaaacatcacagtcattggtgatactttcatcacaggtagattctggtttacaatctaataatcatatcaacagagtagtaagtcatcccacacttcctgttacaataactgctcatgaagatagacacatcaaattttttgacaataaaacgggtaaaatgatccattctatggtagctcacttggatgctgttacaagtctagcagtagatcctaatggaatctatttgatgtctggaagccatgactgttccatcagattatggaatttagacagcaagacatgtgtgcaagaaataacagctcacagaaagaaattggatgaatcaatttatgatgttgctttccactcgtcaaaagcatatatagctagtgcaggagctgatgctcttgccaaagtatttgtatgaatcaacaaaaacttgcatcgtaacaagatttgcttggacagaaagagggtctgcatcactgccatcagaaaggttactgatatgacactacatgtgatctgcctggtgaaggctatctggggcaggcacaaattggtggaaatcacatcttaatgtcaagctcattaagttaactgtaattactgtattttgtgggacaaagaaaaaa

SEQ ID NO: 187056 - DNA, 2208 bp, Homo sapiens
  Payload ID: 16832
  Gene Symbol: STRN3
  Gene Name: striatin, calmodulin binding protein 3
  ENST ID: ENST00000555358
  CDS Start-End: 135-1133
cacacagcaacgaccccttccccgcccctctcccggccggcctccgccccgcagccagcgcggggccaccctctccggcccttcccccagctgtcggcgtctcgccctgcgccccggccggggccccacacacaatggacgagcttgccggaggcggtggtggcggcccggggatggcggcccctccccggcagcagcagggacctggggggaacctgggcctttcgcccggggggaacggagcggcgggcggcgggggtcctccggcctccgagggagcgggtcccgcggcaggccccgagctgtcccggccgcagcagtacactatcccggggatactgcactacatccagcacgagtgggctcggttcgagatggagcgggcgcactgggaggtggaacgggccgaactgcaggcccggattgcatttctacaaggcgaaagaaaaggtcaagagaacctgaagaaggacttagtaagaagaataaagatgttagagtatgcattaaaacaagaaagggcaaaatatcacaaattaaaatatggcacggaactgaaccaaggtgacttgaaaatgccaacctttgagtcagaagaaaccaaagacacagaggctcccacagcacctcagaatagccagttaacgtggaagcaaggcagacagcttttaagacagtatcttcaggaagtaggttatacagatacaatattagatgtacggtctcagcgggtaaggtcattacttggactatctaattcagaaccaaatggatcagtagaaacaaagaatttagaacagatcctgaatggaggtgaatctcctaagcaaaagggacaagaaataaaaaggtcctctggtgatgttcttgagacgttcaatttcttagaaaatgccgatgacagtgatgaagatgaggaaaatgacatgatcgaaggcatcccagaaggaaaagacaaacatcggatgaataaacataaaataggtaatgaaggtttagctgctgacctaactgacgatcctgatactgaggaagcactgaaagaatttgattttttagtgactgctgaagatggtgaaggagctggagaagcacggagttcgggggatggcacagaatgggttgcctgctaataaagatgcctttcgaaagacatggaatcccaagtatacactacgtagccattttgatggagtacgggcattagcttttcatcctgtagaacctgtgctggttactgcttctgaggaccataccctgaaactttggaacctgcaaaaaacagttcctgccaaaaagagtgcctctttagatgtagagcctatctacacatttagggcccacatcggccctgttctgtcattagctattagttctaatggagaacagtgttttagtggtggtattgatgcaaccatccagtggtggaatatgccgagtcccagtgtagatccatatgatacatatgagccaaatgttctagctggcactttagttggtcatacagatgcagtttggggtcttgcttatagtggcataaaaaatcaattactgtcttgttcagcagatggcactgttaggttatggaatccacaagaaaaattgccatgtatttgcacttacaatggagataaaaagcatggaatacctacatcagttgactttataggctgtgatccagctcatatggtaacctctttcaacactggtagtgcagtaatttatgatttagaaacatcacagtcattggtgatactttcatcacaggtagattctggtttacaatctaataatcatatcaacagagtagtaagtcatcccacacttcctgttacaataactgctcatgaagatagacacatcaaattttttgacaataaaacgggtaaaatgatccattctatggtagctcacttggatgctgttacaagtctagcagtagatcctaatggaatctatttgatgtctggaagccatgactgttccatcagattatggaatttagacagcaagacatgtgtgcaagaaataacagctcacagaaagaaattggatgaatcaatttatgatgttgctttccactcgtcaaaagcatatatagctagtgcaggagctgatgctcttgccaaagtatttgtatgaatcaacaaaaacttgcatcgtaacaagatttgcttggacagaaagagggtctgcatcactgccatc

SEQ ID NO: 187057 - DNA, 567 bp, Homo sapiens
  Payload ID: 16832
  Gene Symbol: STRN3
  Gene Name: striatin, calmodulin binding protein 3
  ENST ID: ENST00000555152
  CDS Start-End: 231-567
attttaatatttctcctgttcttcaatttgtatatccactgcaacaattgctgcaaaacctgctattccaatgggggacaaatggtgcctctttagctttttggatatgtttggatccctgatcatcatatgaagaaagagaaacatctgtgttggcccggattgcatttctacaaggcgaaagaaaaggtcaagagaacctgaagaaggacttagtaagaagaataaagatgttagagtatgcattaaaacaagaaagggcaaaatatcacaaattaaaatatggcacggaactgaaccaaggtgacttgaaaatgccaacctttgagtcagaagaaaccaaagacacagaggctcccacagcacctcagaatagccagttaacgtggaagcaaggcagacagcttttaagacagtatcttcaggaagtaggttatacagatacaatattagatgtacggtctcagcgggtaaggtcattacttggactatctaattcagaaccaaatggatcagtagaaacaaagaatttagaacagatcctgaatggaggtgaatctcctaagc

SEQ ID NO: 187058 - DNA, 514 bp, Homo sapiens
  Payload ID: 16832
  Gene Symbol: STRN3
  Gene Name: striatin, calmodulin binding protein 3
  ENST ID: ENST00000556577
  CDS Start-End: 1-514
ctctggtgatgttcttgagacgttcaatttcttagaaaatgccgatgacagtgatgaagatgaggaaaatgacatgatcgaaggcatcccagaaggaaaagacaaacatcggatgaataaacataaaataggtaatgaaggtttagctgctgacctaactgacgatcctgatactgaggaagcactgaaagaatttgattttttagtgactgctgaagatggtgaaggagctggagaagcacggagttcgggggatggcacagaatgggataaagatgacctctccccaactgctgaggtttgggatgtagaccagggactaataagtaaactgaaggaacagtacaagaaggaacgaaaggggaagaaaggggtgaagactgaaccaataacgtttccatctggaggaggcaagtcatttattatgggttctgatgatgttttgttaagtgtactgggccttggagaccttgcagacttgacggtaacaaatgatgcagactatagttatgat

SEQ ID NO: 187059 - DNA, 417 bp, Homo sapiens
  Payload ID: 16832
  Gene Symbol: STRN3
  Gene Name: striatin, calmodulin binding protein 3
  ENST ID: ENST00000554991
  CDS Start-End: 1-417
ataggtaatgaaggtttagctgctgacctaactgacgatcctgatactgaggaagcactgaaagaatttgattttttagtgactgctgaagatggtgaaggagctggagaagcacggagttcgggggatggcacagaatggggggccaacaggacaaaactctacgacatgatagctgatctgggagatgatgagctgccccacatcccttcaggaatcattaatcagtctaggtcagcctctactagaatgactgatcatgaaggtgcaagagcagaggaagctgaaccaataacgtttccatctggaggaggcaagtcatttattatgggttctgatgatgttttgttaagtgtactgggccttggagaccttgcagacttgacggtaacaaatgatgcagactatagttatgat

SEQ ID NO: 187060 - DNA, 3210 bp, Homo sapiens
  Payload ID: 16833
  Gene Symbol: STRN4
  Gene Name: striatin, calmodulin binding protein 4
  Uniprot ID: Q9NRL3
  ENST ID: ENST00000263280
  CDS Start-End: 51-2312
gcgcaggcgcgcgaggcacagcgggcgcgcaggccggccccggggcctccatgatggaggagcgagcggccgccgcggtcgccgccgccgcctcctcctgccgtccgctcggctcaggcgcgggccctggccccactggggcggccccggtctccgcccctgcccccgggccgggcccggcaggtaagggaggcggcggcggaggcagccccgggcccacggcgggcccggagcccctgagcctgccggggatcctgcactttatccagcacgagtgggcgcgcttcgaagccgagaaagcccgctgggaggccgagcgcgccgagttacaggctcaggtggccttccttcagggagagaggaaagggcaggagaatctaaagacggacctggtgcggcggatcaagatgctagagtatgcgctgaagcaggaaagggccaaatatcataaactgaagtttgggacagacctgaaccagggggagaagaaagcagatgtgtcagaacaagtctccaatggccccgtggaatcggtcaccctggagaacagcccgttggtgtggaaggaggggcggcagcttctccgacagtacctggaagaggtgggctacacagacaccatcctcgacatgcggtccaagcgcgtccgttccctgctgggccgctcgctggagctcaacggggcagtggagccgagtgaaggggcccccagggctccaccaggccctgcagggctcagtggtggggagtcgctgctggtgaaacagatcgaggagcagataaagaggaacgcggcaggcaaagatggcaaagagcgcttgggcggctcagtgctggggcagatccccttcctgcagaactgcgaggacgaagacagcgacgaggacgatgagctggacagcgtgcagcacaagaagcagcgtgtgaagctcccatccaaggctctggtgcccgaaatggaagacgaggatgaggaagacgactctgaggatgctatcaatgagtttgatttcctgggctcaggagaggatggggaaggggctccagaccctcggcggtgcactgtggatgggagcccccatgagctggaaagccgtcgggtcaaactccaaggcattctggctgacctgcgggatgtggatgggctgcccccaaaagtgactggcccgcctcctggcacaccccagccccggccacatgaagacgtcttcatcatggacactatcgggggcggggaggtgagcctgggggacttggcagatctcaccgtcaccaacgacaacgacctcagctgcgatctgtctgacagcaaagatgcttttaagaagacgtggaaccccaagttcaccctgcgctcgcactacgacggcattcgttccctggccttccaccacagccagtcggctctgctcaccgcctccgaggacggcacgctcaagctctggaacctgcagaaggcggtcacggccaagaagaatgcggcgctagatgtggaacctatacatgctttccgggctcacaggggcccagtgttggctgtggctatgggcagcaacagtgaatactgctacagtggcggggcagatgcctgcatccatagttggaagattccagacctcagcatggatccctatgatggctacgacccaagcgtgctgagccacgtcctggagggccacggggacgccgtgtggggcctggccttcagtcccacctcccagcgcctggcctcctgttctgctgatggcaccgtccgcatctgggaccccagcagcagcagcccggcctgcctctgcaccttccccacagccagcgagcacggggtccccacctcagtggccttcaccagcaccgagcctgcccacatcgtggcctccttccgctctggcgacaccgtcttgtatgacatggaggttggcagtgccctcctcacgctggagtcccggggcagcagcggtccaacccagatcaaccaagtggtgagtcatccaaaccagcctctcaccatcaccgcccacgacgacaggggcatccgcttcctggacaatcggacaggtaagccggtgcactccatggttgcacacctggacgcagtcacctgcctagccgtggaccccaacggcgcattcctgatgtcaggaagccatgactgctccctgcgtctctggagcctggacaacaaaacgtgcgtgcaggagatcacggcccaccgcaagaagcacgaggaggccatccacgctgttgcctgccaccccagcaaggccctcattgccagtgctggcgctgatgccctggccaaggtcttcgtatgatgcccacctggccctgccctggccgccacgctggctggggtgtagggccgggcaggtggggctgaggggactcccagcctcgctggaggtgcagaggcctggcctctgtctgtttgccatggagcctggtggtgctaacggccctttccccaggaatccctccccaacggctgccttccccaagcatccagcctggggatgggcccctttcaggaatcacccccgaggatggcctcggggtttccccctgtgccctgacagccgctcctggtatcagagctgctttccagagggcagcacagccagggccgggtgtctttagggatcagtttttccaagactccagaaggtgccaggttctccccttgagctcctgctcccccatcccccatcctcccagacctgggcaggagctgtgctgggagaaagggtggcagccgggagcctcagagctgagccccggcctggctgcccctcccctccggccctctccactgctttccagacactaaccaaggcttccaggccagggattgcccaacactcctagggcagccctcccagcgccccatggggtcgcccatgggtagagacggctttcttgtgcccctccctggggcatggagggtggagtgggcctcgggtccccctgaactccctgtatatctgtataaataacgggattttcatggcgccgccccacccgcattatcactgtgtgatggtctcagtcagtctcctccctgtctccactctttccctctatttatttcactctcttgtttggttctaccctgcaccctcggtccccttccaggttcctgtttataagccccaacccctctgtccccatcttgtatgtgaaaacttgtctcaataaaccctttggagtaagatg

SEQ ID NO: 187061 - DNA, 3628 bp, Homo sapiens
  Payload ID: 16833
  Gene Symbol: STRN4
  Gene Name: striatin, calmodulin binding protein 4
  Uniprot ID: Q9NRL3
  ENST ID: ENST00000391910
  CDS Start-End: 452-2734
agggttaccatgacaaccaacctggccggcaatcagagaggatggggccactgctggtcgccctttctctcagagtaaaagtaattgtccaggagagtggtgtttgggtgtggaaggggtaaggctctttctctggggcgaagtgggaggaggggggcagaaagcggccccttcctcagtctcactccagcgagggggaccgtcgcgcggggcctgggtctccctcgccctcctcggggcgcgatctcccacccgccggcccccgcgcgggcacgctacccttcggtgtagacccgggtgggcgaggctcgcgctcgccgccggccccccttcctactgtcccccgccgggcgcgcgcgcggtggttgcggcgggggaggggggggggtgttggcgcggccgcgcaggcgcgcgaggcacagcgggcgcgcaggccggccccggggcctccatgatggaggagcgagcggccgccgcggtcgccgccgccgcctcctcctgccgtccgctcggctcaggcgcgggccctggccccactggggcggccccggtctccgcccctgcccccgggccgggcccggcaggtaagggaggcggcggcggaggcagccccgggcccacggcgggcccggagcccctgagcctgccggggatcctgcactttatccagcacgagtgggcgcgcttcgaagccgagaaagcccgctgggaggccgagcgcgccgagttacaggctcaggtggccttccttcagggagagaggaaagggcaggagaatctaaagacggacctggtgcggcggatcaagatgctagagtatgcgctgaagcaggaaagggccaaatatcataaactgaagtttgggacagacctgaaccagggggagaagaaagcagatgtgtcagaacaagtctccaatggccccgtggaatcggtcaccctggagaacagcccgttggtgtggaaggaggggcggcagcttctccgacagtacctggaagaggtgggctacacagacaccatcctcgacatgcggtccaagcgcgtccgttccctgctgggccgctcgctggagctcaacggggcagtggagccgagtgaaggggcccccagggctccaccaggccctgcagggctcagtggtggggagtcgctgctggtgaaacagatcgaggagcagataaagaggaacgcggcaggcaaagatggcaaagagcgcttgggcggctcagtgctggggcagatccccttcctgcagaactgcgaggacgaagacagcgacgaggacgatgagctggacagcgtgcagcacaagaagcagcgtgtgaagctcccatccaaggctctggtgcccgaaatggaagacgaggatgaggaagacgactctgaggatgctatcaatgagtttgatttcctgggctcaggagaggatggggaaggggctccagaccctcggcggtgcactgtggatgggagcccccatgagctggaaagccgtcgggtcaaactccaaggcattctggctgacctgcgggatgtggatgggctgcccccaaaagtgactggcccgcctcctggcacaccccagccccggccacatgaaggttcctttggcttctcctcagacgtcttcatcatggacactatcgggggcggggaggtgagcctgggggacttggcagatctcaccgtcaccaacgacaacgacctcagctgcgatctgtctgacagcaaagatgcttttaagaagacgtggaaccccaagttcaccctgcgctcgcactacgacggcattcgttccctggccttccaccacagccagtcggctctgctcaccgcctccgaggacggcacgctcaagctctggaacctgcagaaggcggtcacggccaagaagaatgcggcgctagatgtggaacctatacatgctttccgggctcacaggggcccagtgttggctgtggctatgggcagcaacagtgaatactgctacagtggcggggcagatgcctgcatccatagttggaagattccagacctcagcatggatccctatgatggctacgacccaagcgtgctgagccacgtcctggagggccacggggacgccgtgtggggcctggccttcagtcccacctcccagcgcctggcctcctgttctgctgatggcaccgtccgcatctgggaccccagcagcagcagcccggcctgcctctgcaccttccccacagccagcgagcacggggtccccacctcagtggccttcaccagcaccgagcctgcccacatcgtggcctccttccgctctggcgacaccgtcttgtatgacatggaggttggcagtgccctcctcacgctggagtcccggggcagcagcggtccaacccagatcaaccaagtggtgagtcatccaaaccagcctctcaccatcaccgcccacgacgacaggggcatccgcttcctggacaatcggacaggtaagccggtgcactccatggttgcacacctggacgcagtcacctgcctagccgtggaccccaacggcgcattcctgatgtcaggaagccatgactgctccctgcgtctctggagcctggacaacaaaacgtgcgtgcaggagatcacggcccaccgcaagaagcacgaggaggccatccacgctgttgcctgccaccccagcaaggccctcattgccagtgctggcgctgatgccctggccaaggtcttcgtatgatgcccacctggccctgccctggccgccacgctggctggggtgtagggccgggcaggtggggctgaggggactcccagcctcgctggaggtgcagaggcctggcctctgtctgtttgccatggagcctggtggtgctaacggccctttccccaggaatccctccccaacggctgccttccccaagcatccagcctggggatgggcccctttcaggaatcacccccgaggatggcctcggggtttccccctgtgccctgacagccgctcctggtatcagagctgctttccagagggcagcacagccagggccgggtgtctttagggatcagtttttccaagactccagaaggtgccaggttctccccttgagctcctgctcccccatcccccatcctcccagacctgggcaggagctgtgctgggagaaagggtggcagccgggagcctcagagctgagccccggcctggctgcccctcccctccggccctctccactgctttccagacactaaccaaggcttccaggccagggattgcccaacactcctagggcagccctcccagcgccccatggggtcgcccatgggtagagacggctttcttgtgcccctccctggggcatggagggtggagtgggcctcgggtccccctgaactccctgtatatctgtataaataacgggattttcatggcgccgccccacccgcattatcactgtgtgatggtctcagtcagtctcctccctgtctccactctttccctctatttatttcactctcttgtttggttctaccctgcaccctcggtccccttccaggttcctgtttataagccccaacccctctgtccccatcttgtatgtgaaaacttgtctcaataaaccctttggagtaa

SEQ ID NO: 187062 - DNA, 2608 bp, Homo sapiens
  Payload ID: 16833
  Gene Symbol: STRN4
  Gene Name: striatin, calmodulin binding protein 4
  ENST ID: ENST00000539396
  CDS Start-End: 370-2274
accttagcaaccttctcctggtgcagagtcctaagaggtttggggctccataaccacaaaggtggaagcgaggggaaggctgctccccaccacctcgcccccaccgctggggaagggttaccatgacaaccaacctggccggcaatcagagaggatggggccactgctggtcgccctttctctcagagtaaaagtaattgtccaggagagtggtgtttgggtgtggaagggcacgagtgggcgcgcttcgaagccgagaaagcccgctgggaggccgagcgcgccgagttacaggctcaggtggccttccttcagggagagaggaaagggcaggagaatctaaagacggacctggtgcggcggatcaagatgctagagtatgcgctgaagcaggaaagggccaaatatcataaactgaagtttgggacagacctgaaccagggggagaagaaagcagatgtgtcagaacaagtctccaatggccccgtggaatcggtcaccctggagaacagcccgttggtgtggaaggaggggcggcagcttctccgacagtacctggaagaggtgggctacacagacaccatcctcgacatgcggtccaagcgcgtccgttccctgctgggccgctcgctggagctcaacggggcagtggagccgagtgaaggggcccccagggctccaccaggccctgcagggctcagtggtggggagtcgctgctggtgaaacagatcgaggagcagataaagaggaacgcggcaggcaaagatggcaaagagcgcttgggcggctcagtgctggggcagatccccttcctgcagaactgcgaggacgaagacagcgacgaggacgatgagctggacagcgtgcagcacaagaagcagcgtgtgaagctcccatccaaggctctggtgcccgaaatggaagacgaggatgaggaagacgactctgaggatgctatcaatgagtttgatttcctgggctcaggagaggatggggaaggggctccagaccctcggcggtgcactgtggatgggagcccccatgagctggaaagccgtcgggtcaaactccaaggcattctggctgacctgcgggatgtggatgggctgcccccaaaagtgactggcccgcctcctggcacaccccagccccggccacatgaagacgtcttcatcatggacactatcgggggcggggaggtgagcctgggggacttggcagatctcaccgtcaccaacgacaacgacctcagctgcgatctgtctgacagcaaagatgcttttaagaagacgtggaaccccaagttcaccctgcgctcgcactacgacggcattcgttccctggccttccaccacagccagtcggctctgctcaccgcctccgaggacggcacgctcaagctctggaacctgcagaaggcggtcacggccaagaagaatgcggcgctagatgtggaacctatacatgctttccgggctcacaggggcccagtgttggctgtggctatgggcagcaacagtgaatactgctacagtggcggggcagatgcctgcatccatagttggaagattccagacctcagcatggatccctatgatggctacgacccaagcgtgctgagccacgtcctggagggccacggggacgccgtgtggggcctggccttcagtcccacctcccagcgcctggcctcctgttctgctgatggcaccgtccgcatctgggaccccagcagcagcagcccggcctgcctctgcaccttccccacagccagcgagcacggggtccccacctcagtggccttcaccagcaccgagcctgcccacatcgtggcctccttccgctctggcgacaccgtcttgtatgacatggaggttggcagtgccctcctcacgctggagtcccggggcagcagcggtccaacccagatcaaccaagtggtgagtcatccaaaccagcctctcaccatcaccgcccacgacgacaggggcatccgcttcctggacaatcggacaggtaagccggtgcactccatggttgcacacctggacgcagtcacctgcctagccgtggaccccaacggcgcattcctgatgtcaggaagccatgactgctccctgcgtctctggagcctggacaacaaaacgtgcgtgcaggagatcacggcccaccgcaagaagcacgaggaggccatccacgctgttgcctgccaccccagcaaggccctcattgccagtgctggcgctgatgccctggccaaggtcttcgtatgatgcccacctggccctgccctggccgccacgctggctggggtgtagggccgggcaggtggggctgaggggactcccagcctcgctggaggtgcagaggcctggcctctgtctgtttgccatggagcctggtggtgctaacggccctttccccaggaatccctccccaacggctgccttccccaagcatccagcctggggatgggcccctttcaggaatcacccccgaggatggcctcggggtttccccctgtgccctgacagccgctcctggtatcagagctgctttccagagggcagcacagccagggccgggtgtctttagggatcagttttt

SEQ ID NO: 187063 - DNA, 560 bp, Homo sapiens
  Payload ID: 16833
  Gene Symbol: STRN4
  Gene Name: striatin, calmodulin binding protein 4
  ENST ID: ENST00000596012
  CDS Start-End: 342-560
ataaccacaaaggtggaagcgaggggaaggctgctccccaccacctcgcccccaccgctggggaagggttaccatgacaaccaacctggccggcaatcagagaggatggggccactgctggtcgccctttctctcagagtaaaaacgaagtctggctctgtcgcccaggctggagtgcagtggcacgatcttggcccactgcaatctccacttcccaggttcaagcgattctcctgcctcagcctcccgagtagctgggactacaggctcaggtggccttccttcagggagagaggaaagggcaggagaatctaaagacggacctggtgcggcggatcaagatgctagagtatgcgctgaagcaggaaagggccaaatatcataaactgaagtttgggacagacctgaaccagggggagaagaaagcagatgtgtcagaacaagtctccaatggccccgtggaatcggtcaccctggagaacagcccgttggtgtggaaggaggggcggcagcttctccgacagtacctggaagaggtgggctacacagacaccatcctc

SEQ ID NO: 187064 - DNA, 570 bp, Homo sapiens
  Payload ID: 16833
  Gene Symbol: STRN4
  Gene Name: striatin, calmodulin binding protein 4
  ENST ID: ENST00000597063
  CDS Start-End: 227-570
agcacgctggccgcggggctcctgagagaggcgactcgagccctggaggggaggctaagagaactcgggaaagggagccgagccgagccacccactcttgtccctaagctccagaagtagcttcccacgcctcccagagacagatgctctggctcaggtggccttccttcagggagagaggaaagggcaggagaatctaaagacggacctggtgcggcggatcaagatgctagagtatgcgctgaagcaggaaagggccaaatatcataaactgaagtttgggacagacctgaaccagggggagaagaaagcagatgtgtcagaacaagtctccaatggccccgtggaatcggtcaccctggagaacagcccgttggtgtggaaggaggggcggcagcttctccgacagtacctggaagaggtgggctacacagacaccatcctcgacatgcggtccaagcgcgtccgttccctgctgggccgctcgctggagctcaacggggcagtggagccgagtgaaggggcccccagggctccaccaggccctgcagggctcagtggtggggagtc

SEQ ID NO: 187065 - DNA, 951 bp, Homo sapiens
  Payload ID: 16833
  Gene Symbol: STRN4
  Gene Name: striatin, calmodulin binding protein 4
  ENST ID: ENST00000594287
  CDS Start-End: 1-951
tggatgggctgcccccaaaagtgactggcccgcctcctggcacaccccagccccggccacatgaagctgtgattcttcatcttgtcctctccccgtctctctctcttgctctttatctctttctctgcctctctctgtcattctctctctccctggccctctctgcccctccctcccctccccctaccaggttcctttggcttctcctcagacgtcttcatcatggacactatcgggggcggggaggtgagcctgggggacttggcagatctcaccgtcaccaacgacaacgacctcagctgcgatatgcttttaagaagacgtggaaccccaagttcaccctgcgctcgcactacgacggcattcgttccctggccttccaccacagccagtcggctctgctcaccgcctccgaggacggcacgctcaagctctggaacctgcagaaggcggtcacggccaagaagaatgcggcgctagatgtggaacctatacatgctttccgggctcacaggggcccagtgttggctgtggctatgggcagcaacagtgaatactgctacagtggcggggcagatgcctgcatccatagttggaagattccagacctcagcatggatccctatgatggctacgacccaagcgtgctgagccacgtcctggagggccacggggacgccgtgtggggcctggccttcagtcccacctcccagcgcctggcctcctgttctgctgatggcaccgtccgcatctgggaccccagcagcagcagcccggcctgcctctgcaccttccccacagccagcgagcacggggtccccacctcagtggccttcaccagcaccgagcctgcccacatcgtggcctccttccgctctggcgacaccgtcttgtatgacatggaggttggcagtgccctcctcacgctggagtcccggggcagcagcggtc

SEQ ID NO: 187066 - DNA, 675 bp, Homo sapiens
  Payload ID: 16833
  Gene Symbol: STRN4
  Gene Name: striatin, calmodulin binding protein 4
  ENST ID: ENST00000593979
  CDS Start-End: 258-675
ataaccacaaaggtggaagcgaggggaaggctgctccccaccacctcgcccccaccgctggggaagggttaccatgacaaccaacctggccggcaatcagagaggatggggccactgctggtcgccctttctctcagagtaaaagtaattgtccaggagagtggtgtttgggtgtggaaggggctcaggtggccttccttcagggagagaggaaagggcaggagaatctaaagacggacctggtgcggcggatcaagatgctagagtatgcgctgaagcaggaaagggccaaatatcataaactgaagtttgggacagacctgaaccagggggagaagaaagcagatgtgtcagaacaagtctccaatggccccgtggaatcggtcaccctggagaacagcccgttggtgtggaaggaggggcggcagcttctccgacagtacctggaagaggtgggctacacagacaccatcctcgacatgcggtccaagcgcgtccgttccctgctgggccgctcgctggagctcaacggggcagtggagccgagtgaaggggcccccagggctccaccaggccctgcagggctcagtggtggggagtcgctgctggtgaaacagatcgaggagcagataaagaggaacgcggcaggcaaagatggcaaagagcgcttgggcg

SEQ ID NO: 187067 - DNA, 913 bp, Homo sapiens
  Payload ID: 16833
  Gene Symbol: STRN4
  Gene Name: striatin, calmodulin binding protein 4
  ENST ID: ENST00000594704
  CDS Start-End: 1-542
cggtcgccgccgccgcctcctcctgccgtccgctcggctcaggcgcgggccctggccccactggggcggccccggtctccgcccctgcccccgggccgggcccggcaggtaagggaggcggcggcggaggcagccccgggcccacggcgggcccggagcccctgagcctgccggggatcctgcactttatccagcacgagtgggcgcgcttcgaagccgagaaagcccgctgggaggccgagcgcgccgagttacaggctcaggtggccttccttcagggagagaggaaagggcaggagaatctaaagacggacctggtgcggcggatcaagatgctagagtatgcgctgaagcaggaaagggccaaatatcataaactgaagtttgggacagacctgaaccagggggagaagaaagcagatgtgtcagaacaagtctccaatggccccgtggaatcggtcaccctggagaacagcccgttggtgtggaaggaggggcggcagcttctccgacatccagtcccagctggcttcagtttttaaattgcagaagtaataagtgctcatttgtagaagtacctggaagaggtgggctacacagacaccatcctcgacatgcggtccaagcgcgtccgttccctgctgggccgctcgctggagctcaacggggcagtggagccgagtgaaggggcccccagggctccaccaggccctgcagggctcagtggtggggagtcgctgctggtgaaacagatcgaggagcagataaagaggaacgcggcaggcaaagatggcaaagagcgcttgggcggctcagtgctggggcagatccccttcctgcagaactgcgaggacgaagacagcgacgaggacgatgagctggacagcgtgcagcacaagaagcagcgtgtgaa

SEQ ID NO: 187068 - DNA, 582 bp, Homo sapiens
  Payload ID: 16833
  Gene Symbol: STRN4
  Gene Name: striatin, calmodulin binding protein 4
  ENST ID: ENST00000597021
  CDS Start-End: 274-582
gtgcttggcaggaacccggggtcgtgtctgtggcacatttctctcacaccctgggcggaatgcagtgggacggctggtccccacagcgggcttggcttgtaaagcttttctattggagcaggagccgagccgagccacccactcttgtccctaagctccagaagtagcttcccacgcctcccagagacagatgctctggctcaggtggccttccttcagggagagaggaaagggcaggagaatctaaagacggacctggtgcggcggatcaagatgctagagtatgcgctgaagcaggaaagggccaaatatcataaactgaagtttgggacagacctgaaccagggggagaagaaagcagatgtgtcagaacaagtctccaatggccccgtggaatcggtcaccctggagaacagcccgttggtgtggaaggaggggcggcagcttctccgacagtacctggaagaggtgggctacacagacaccatcctcgacatgcggtccaagcgcgtccgttccctgctgggccgctcgctggagctcaacggggcagtggagccgagtgaaggggcccccagggct

SEQ ID NO: 187069 - DNA, 788 bp, Homo sapiens
  Payload ID: 16833
  Gene Symbol: STRN4
  Gene Name: striatin, calmodulin binding protein 4
  ENST ID: ENST00000600615
  CDS Start-End: 1-595
ccagcgcctggcctcctgttctgctgatggcaccgtccgcatctgggaccccagcagcagcagcccggcctgcctctgcaccttccccacagccagcgagcacggggtccccacctcagtggccttcaccagcaccgagcctgcccacatcgtggcctccttccgctctggcgacaccgtcttgtatgacatggaggttggcagtgccctcctcacgctggagtcccggggcagcagcggtccaacccagatcaaccaagtggtgagtcatccaaaccagcctctcaccatcaccgcccacgacgacaggggcatccgcttcctggacaatcggacaggtaagccggtgcactccatggttgcacacctggacgcagtcacctgcctagccgtggaccccaacggcgcattcctgatgtcaggaagccatgactgctccctgcgtctctggagcctggacaacaaaacgtgcgtgcaggagatcacggcccaccgcaagaagcacgaggaggccatccacgctgttgcctgccaccccagcaaggccctcattgccagtgctggcgctgatgccctggccaaggtcttcgtatgatgcccacctggccctgccctggccgccacgctggctggggtgtagggccgggcaggtggggctgaggtgagggcagaaaccccgcattctgagtctctgcacgcccatgcctagtactgccaggtgtgctgagccccgcagtccagtcaggggcgtcctgtgagaatcactgggggagccctgggcatgcagg

SEQ ID NO: 187070 - DNA, 1267 bp, Homo sapiens
  Payload ID: 16833
  Gene Symbol: STRN4
  Gene Name: striatin, calmodulin binding protein 4
  ENST ID: ENST00000600358
  CDS Start-End: 1-950
cagaacaagtctccaatggccccgtggaatcggtcaccctggagaacagcccgttggtgtggaaggaggggcggcagcttctccgacagtacctggaagaggtgggctacacagacaccatcctcgacatgcggtccaagcgcgtccgttccctgctgggccgctcgctggagctcaacggggcagtggagccgagtgaaggggcccccagggctccaccaggccctgcagggctcagtggtggggagtcgctgctggtgaaacagatcgaggagcagataaagaggaacgcggcaggcaaagatggcaaagagcgcttgggcggctcagtgctggggcagatccccttcctgcagaactgcgaggacgaagacagcgacgaggacgatgagctggacagcgtgcagcacaagaagcagcgtgtgaagctcccatccaaggctctggtgcccgaaatggaagacgaggatgaggaagacgactctgaggatgctatcaatgagtttgatttcctgggctcaggagaggatggggaaggggctccagaccctcggcggtgcactgtggatgggagcccccatgagctggaaagccgtcgggtcaaactccaaggcattctggctgacctgcgggatgtggatgggctgcccccaaaagtgactggcccgcctcctggcacaccccagccccggccacatgaagctgtgattcttcatcttgtcctctccccgtctctctctcttgctctttatctctttctctgcctctctctgtcattctctctctccctggccctctctgcccctccctcccctccccctaccaggttcctttggcttctcctcagacgtcttcatcatggacactatcgggggcggggaggtgagcctgggggacttggcagatctcaccgtcaccaacgacaacgacctcagctgcgatctgtctgacagcaaagatgcttttaagaagacgtggaaccccaagttcaccctgcgctcgcactacgacggcattcgttccctggccttccaccacagccagtcggctctgctcaccgcctccgaggacggcacgctcaagctctggaacctgcagaaggcggtcacggccaagaagaatgcggcgctagatgtggaacctatacatgctttccgggctcacaggggcccagtgttggctgtggctatgggcagcaacagtgaatactgctacagtggcggggcagatgcctgcatccatagttggaagattccagacctcagca

SEQ ID NO: 187071 - DNA, 1551 bp, Homo sapiens
  Payload ID: 16833
  Gene Symbol: STRN4
  Gene Name: striatin, calmodulin binding protein 4
  Uniprot ID: Q9NRL3
  ENST ID: ENST00000435164
  CDS Start-End: 298-1071
aacctggccggcaatcagagaggatggggccactgctggtcgccctttctctcagagtaaaagtaattgtccaggagagtggtgtttgggtgtggaagggacgaagtctggctctgtcgcccaggctggagtgcagtggcacgatcttggcccactgcaatctccacttcccaggttcaagcgattctcctgcctcagcctcccgagtagctgggactacaggctcaggtggccttccttcagggagagaggaaagggcaggagaatctaaagacggacctggtgcggcggatcaagatgctagagtatgcgctgaagcaggaaagggccaaatatcataaactgaagtttgggacagacctgaaccagggggagaagaaagcagatgtgtcagaacaagtctccaatggccccgtggaatcggtcaccctggagaacagcccgttggtgtggaaggaggggcggcagcttctccgacagtacctggaagaggtgggctacacagacaccatcctcgacatgcggtccaagcgcgtccgttccctgctgggccgctcgctggagctcaacggggcagtggagccgagtgaaggggcccccagggctccaccaggccctgcagggctcagtggtggggagtcgctgctggtgaaacagatcgaggagcagataaagaggaacgcggcaggcaaagatggcaaagagcgcttgggcggctcagtgctggggcagatccccttcctgcagaactgcgaggacgaagacagcgacgaggacgatgagctggacagcgtgcagcacaagaagcagcgtgtgaagctcccatccaaggctctggtgcccgaaatggaagacgaggatgaggaagacgactctgaggatgctatcaatgagtttgatttcctgggctcaggagaggatggggaaggggctccagaccctcggcggtgcactgtggatgggagcccccatgagctggggccagagcttcacagccccacagagtggcagggggccctcagtgtggggaaggcgtcacctatgccagactgggttggaactgctgggtgactccggccctatgcctcgaccctgcagaaagccgtcgggtcaaactccaaggcattctggctgacctgcgggatgtggatgggctgcccccaaaagtgactggcccgcctcctggcacaccccagccccggccacatgaaggttcctttggcttctcctcagacgtcttcatcatggacactatcgggggcggggaggtgagcctgggggacttggcagatctcaccgtcaccaacgacaacgacctcagctgcgatctgtctgacagcaaagatgcttttaagaagacgtggaaccccaagttcaccctgcgctcgcactacgacggcattcgttccctggccttccaccacagccagtcggctctgctcaccgcctccgaggacggcacgctcaagctctggaacctgcagaaggcggtcacggccaagaagaatgcggcgctagatgtggaacctatacatgctttccgggctcaca

SEQ ID NO: 187072 - DNA, 5951 bp, Homo sapiens
  Payload ID: 16834
  Gene Symbol: STAG1
  Gene Name: stromal antigen 1
  Uniprot ID: Q8WVM7
  ENST ID: ENST00000236698
  CDS Start-End: 268-3933
attggcgtgtggaaaatgccaccagatggcgggttaggattgcagctccgttgaaggcgcggcccccgctcccgaacccccggcgaccaccccgtaacaacccccccacatcgggaataacacaccggagacttttggggggaaactaggtcgatggtcggcggcgcccggatgggcagctgaggattgcctttgaggttattttaaaagttttgagttgtacagcacttgattattttgctgcattgtgaaaggacctctccagcaatgattacttcagaattaccagtgttacaggattcaactaatgaaactactgcccattccgatgctggcagcgagcttgaagaaacagaggtcaaaggaaaaagaaaaaggggtcgtcctggccggcctccatctacaaataagaaacctcgaaaatctccaggtgagaagagcagaattgaagctggaattagaggagcaggccgtggaagagctaatggacaccctcaacagaatggggaaggggagcctgtcacattatttgaggtggtgaaactggggaaaagtgcaatgcagtccgtggtggatgactggattgaatcatataaacaagacagggacatcgcacttctggatttaatcaacttttttatccagtgttcaggatgtcgaggtactgtgagaatagagatgtttcgaaatatgcagaatgcagaaatcatcagaaaaatgactgaagaatttgatgaggacagtggtgattatcctcttaccatgcctggacctcagtggaaaaaatttcgttcaaacttttgtgaatttattggagtcctgattcgacagtgtcagtatagcataatttatgatgagtatatgatggacacagtaatctcccttttgacgggtttgtcagactcccaggtcagagcttttaggcatacaagtaccctggctgccatgaagctcatgactgctctggtgaatgttgccttaaacctcagtattcatcaggataatacccagagacaatatgaagccgagagaaataaaatgattgggaagagagccaatgaaaggttggagttactacttcagaaacgcaaagagctgcaagaaaatcaggatgaaatcgaaaatatgatgaactctatttttaagggtatatttgttcatagataccgtgatgctattgctgagattagagccatttgtattgaagaaattggagtatggatgaaaatgtatagtgatgccttcctaaatgacagttacctaaaatatgttggctggactcttcatgacaggcaaggggaagtcaggctgaagtgtttgaaagctctgcagagtctatataccaatagagaattattccccaaattggaactattcactaaccgattcaaggatcgcattgtatcaatgacacttgataaagaatatgatgttgctgtggaagctattcgattggttactctgatacttcatggaagtgaagaagctctttccaatgaagactgtgaaaatgtttaccacttggtgtactcggcacatcgccctgttgctgtggcagctggagagttccttcacaaaaagctatttagcagacatgacccacaagcagaagaagcattagcaaagaggaggggaagaaacagcccgaatggaaacctcattaggatgctggttcttttctttcttgaaagtgagttacatgaacatgcagcctacttggtggacagtttatgggagagctctcaagaactgttgaaagactgggaatgtatgacagagttgctattagaagaacctgttcaaggagaggaagcaatgtctgatcgtcaagagagtgctcttatagagctaatggtttgtacaattcgtcaagctgctgaggcacatcctccagtgggaaggggtaccggcaagagagtgctaactgccaaagaaaggaaaactcaaattgatgatagaaacaaattgactgaacattttattattacacttcctatgttactgtcaaagtattctgcagatgcagagaaggtagcaaacttgctacaaatcccacagtattttgatttagaaatctacagcacaggtagaatggaaaagcatctggatgctttattaaaacagattaagtttgttgtggagaaacacgtagaatcagatgttctagaagcctgcagtaaaacctatagtatcttatgcagtgaagaatataccatccagaacagagttgacatagctcgaagccagctgattgatgagtttgtagatcgattcaatcattctgtggaagacctattgcaagagggagaagaagctgatgatgatgacatttacaatgttctttctacattaaagcggttaacttcttttcacaatgcacatgatctcacaaaatgggatctctttggtaattgctacagattattgaagactggaattgaacatggagccatgccagaacagatagtcgtgcaagcactgcagtgttcccattattcgattctttggcagttggtgaaaattactgatggctctccttccaaagaggatttgttggtattgaggaaaacggtgaaatcctttttggctgtttgccagcagtgcctgtctaatgttaatactccagtgaaagaacaggctttcatgttactctgtgatcttctgatgattttcagccaccaattaatgacaggtggcagagagggccttcagcctttggtgttcaatccagatactggactccaatctgaactcctcagttttgtgatggatcacgtttttattgaccaagacgaggagaaccagagcatggagggtgatgaagaagatgaagctaataaaattgaggccttacataaaagaaggaatctacttgctgctttcagcaaacttatcatttatgacattgttgacatgcatgcagctgcagacatcttcaaacactacatgaagtattacaatgactatggtgatattattaaggaaacactgagtaaaaccaggcagattgataaaattcagtgtgccaagactctcattctcagtttgcaacagttatttaatgaacttgttcaagagcaaggtcccaacctagataggacatctgcccatgtcagtggcattaaagaactggcacgtcgctttgcccttacatttggattggaccagattaagacacgagaagcagttgccacacttcacaaggatggcatagagtttgcatttaaataccaaaatcagaaaggacaagagtatccacctcctaatctggcttttcttgaagtactaagtgaattttcttctaaacttcttcgacaggacaaaaagacagttcattcatacctagagaaattccttaccgagcagatgatggaaaggagggaggatgtatggcttccactcatctcctatagaaattcattagtcactgggggtgaagatgatagaatgtctgtgaacagtggaagtagcagcagcaaaacctcatcagtaaggaataagaaaggacgacctccacttcataaaaaacgagtagaagatgagagtctggataacacatggctaaacaggactgacaccatgattcagactcctggccccctgccagcaccacaactcacatccactgtactgcgggagaacagtcggcccatgggagaccagattcaagaacctgagtctgaacatggttctgaaccagactttttacacaatcggggtctaatggaggaagatgctgagcccatctttgaagatgtgatgatgtcatcccgaagccagttagaagatatgaatgaagaatttgaggacaccatggttattgatctgcctccatcaagaaatcggcgagagagagctgagctaaggccagacttctttgactctgcagctatcatagaagatgattcaggatttggaatgcctatgttctgaagtctgaagaaaatttacaaatctggaactctattatttagagctagaggcctatatactgtgatagcttgtatggggaaaaacacttttgatgtgatctgatttgttttttaatcaaatgattaaggtcaatccctttttgcagtgacagaagaggagcatgtaaattacccaagggaatgttggtgaatgtcaactcagaaagactgacctgaaaatcatttgtgtcctactattggacttatcccaatacagatgtgtgtgtttttctggagggaggaagaaattttaaatttttaaaacagctgtcaagataaacactgttatacacctgttttatgaaaactcaacattgagtaaaaaaaaacatatttttaactttattttcctgttgtacaatttaaaaaccgttttaacattttgcctttttatgttttaaaagctaaccatttttattaaacctatgagtaagcagctcatcctaattgcgaagagtgttttggagttcactggatttggttgacctttgtggaacacaaataatgaaggagcagaacattgacaagctaagatgaaattctgacatagtacatctctgccaaaaaccacacaccctctgtggatatggatatgaattcccagattttatatactcttgaataaaaggtttatttttatttataagtgggcataaaataagaaatgtccatgcagccatttttccaacagatgctgtacaccgttcattttatatagactagggagattcaaatacagtgcattttctattggtatttgttctgtgcatttttagcaacttctaccagcaaataaagtattctcagtaaaacgaaaatgattctcaagttatcagtttgctgtttttaccacttatttcatgccctgccaaattcaagttacacagacttccattttcttaagataatcaatcatgaagaaatcctttatcaatcattcaaaagtaattttaagtgtaacataactgtgtttacttcccatgcacttaatacccttatgcgctaattttgtgaattaagtttactgattatagaagtatgtgctgcatagaagtctgtgcttagagggtgaagttcctaagcttaccttgaattacagctacatttcagtgttaaatgtgcatattaagaataattcttttggggaaagaaattatgaatcttcaggacagtctacaatggtttagagttacattctgcctagacttttatgacttgctgctattgttttaaaaaccccacttagtctctctcttcctttctgatttctaaagtaagcctcagaatttccaaaccaattcatccacagctgtttctgggctggtttttaaagtagctgcaacagaatcatgaggctttccctttttatcaaatacgaaaaacattttttaaaattctgcacacccagtgatcatcttttgtgcgggaaagcaagatgatgatggatgattttattcatccttttagtaaagacacaaaacatttttctcaacatttgtacagttctgaaaaaaacctggtcaccaaaaatatcttctctgctaattcagcaattcttgggctccagttaggggagctggggcctcactttctcccagaattgtgggcttcactggaagtgaaggtgcaggaatgactggactgtccaccccagccctgcctgcctgtggttttggccagggagcaagccatgaggtgccctggcacatgcacaaattgatcctttgcgtgacagtcttgtatggaaaacagatgctgacagaattgtagactaccatgccacacaaaaaggctaaatatctactccaatgggtttccagttcagtttgaagtcaatcaaatttttgtattttcggtgtctccttgattggttttgctagtaattctgtaaattgtacatttgcaatatgaggttttttttccttttgtacaatttgaaactgatgcttcacctttcctttaataaactattcaaaatca

SEQ ID NO: 187073 - DNA, 6055 bp, Homo sapiens
  Payload ID: 16834
  Gene Symbol: STAG1
  Gene Name: stromal antigen 1
  Uniprot ID: Q8WVM7
  ENST ID: ENST00000383202
  CDS Start-End: 258-4034
ggaaaatgccaccagatggcgggttaggattgcagctccgttgaaggcgcggcccccgctcccgaacccccggcgaccaccccgtaacaacccccccacatcgggaataacacaccggagacttttggggggaaactaggtcgatggtcggcggcgcccggatgggcagctgaggattgcctttgaggttattttaaaagttttgagttgtacagcacttgattattttgctgcattgtgaaaggacctctccagcaatgattacttcagaattaccagtgttacaggattcaactaatgaaactactgcccattccgatgctggcagcgagcttgaagaaacagaggtcaaaggaaaaagaaaaaggggtcgtcctggccggcctccatctacaaataagaaacctcgaaaatctccaggtgagaagagcagaattgaagctggaattagaggagcaggccgtggaagagctaatggacaccctcaacagaatggggaaggggagcctgtcacattatttgaggtggtgaaactggggaaaagtgcaatgcagtccgtggtggatgactggattgaatcatataaacaagacagggacatcgcacttctggatttaatcaacttttttatccagtgttcaggatgtcgaggtactgtgagaatagagatgtttcgaaatatgcagaatgcagaaatcatcagaaaaatgactgaagaatttgatgaggacagtggtgattatcctcttaccatgcctggacctcagtggaaaaaatttcgttcaaacttttgtgaatttattggagtcctgattcgacagtgtcagtatagcataatttatgatgagtatatgatggacacagtaatctcccttttgacgggtttgtcagactcccaggtcagagcttttaggcatacaagtaccctggctgccatgaagctcatgactgctctggtgaatgttgccttaaacctcagtattcatcaggataatacccagagacaatatgaagccgagagaaataaaatgattgggaagagagccaatgaaaggttggagttactacttcagaaacgcaaagagctgcaagaaaatcaggatgaaatcgaaaatatgatgaactctatttttaagggtatatttgttcatagataccgtgatgctattgctgagattagagccatttgtattgaagaaattggagtatggatgaaaatgtatagtgatgccttcctaaatgacagttacctaaaatatgttggctggactcttcatgacaggcaaggggaagtcaggctgaagtgtttgaaagctctgcagagtctatataccaatagagaattattccccaaattggaactattcactaaccgattcaaggatcgcattgtatcaatgacacttgataaagaatatgatgttgctgtggaagctattcgattggttactctgatacttcatggaagtgaagaagctctttccaatgaagactgtgaaaatgtttaccacttggtgtactcggcacatcgccctgttgctgtggcagctggagagttccttcacaaaaagctatttagcagacatgacccacaagcagaagaagcattagcaaagaggaggggaagaaacagcccgaatggaaacctcattaggatgctggttcttttctttcttgaaagtgagttacatgaacatgcagcctacttggtggacagtttatgggagagctctcaagaactgttgaaagactgggaatgtatgacagagttgctattagaagaacctgttcaaggagaggaagcaatgtctgatcgtcaagagagtgctcttatagagctaatggtttgtacaattcgtcaagctgctgaggcacatcctccagtgggaaggggtaccggcaagagagtgctaactgccaaagaaaggaaaactcaaattgatgatagaaacaaattgactgaacattttattattacacttcctatgttactgtcaaagtattctgcagatgcagagaaggtagcaaacttgctacaaatcccacagtattttgatttagaaatctacagcacaggtagaatggaaaagcatctggatgctttattaaaacagattaagtttgttgtggagaaacacgtagaatcagatgttctagaagcctgcagtaaaacctatagtatcttatgcagtgaagaatataccatccagaacagagttgacatagctcgaagccagctgattgatgagtttgtagatcgattcaatcattctgtggaagacctattgcaagagggagaagaagctgatgatgatgacatttacaatgttctttctacattaaagcggttaacttcttttcacaatgcacatgatctcacaaaatgggatctctttggtaattgctacagattattgaagactggaattgaacatggagccatgccagaacagatagtcgtgcaagcactgcagtgttcccattattcgattctttggcagttggtgaaaattactgatggctctccttccaaagaggatttgttggtattgaggaaaacggtgaaatcctttttggctgtttgccagcagtgcctgtctaatgttaatactccagtgaaagaacaggctttcatgttactctgtgatcttctgatgattttcagccaccaattaatgacaggtggcagagagggccttcagcctttggtgttcaatccagatactggactccaatctgaactcctcagttttgtgatggatcacgtttttattgaccaagacgaggagaaccagagcatggagggtgatgaagaagatgaagctaataaaattgaggccttacataaaagaaggaatctacttgctgctttcagcaaacttatcatttatgacattgttgacatgcatgcagctgcagacatcttcaaacactacatgaagtattacaatgactatggtgatattattaaggaaacactgagtaaaaccaggcagattgataaaattcagtgtgccaagactctcattctcagtttgcaacagttatttaatgaacttgttcaagagcaaggtcccaacctagataggacatctgcccatgtcagtggcattaaagaactggcacgtcgctttgcccttacatttggattggaccagattaagacacgagaagcagttgccacacttcacaaggatggcatagagtttgcatttaaataccaaaatcagaaaggacaagagtatccacctcctaatctggcttttcttgaagtactaagtgaattttcttctaaacttcttcgacaggacaaaaagacagttcattcatacctagagaaattccttaccgagcagatgatggaaaggagggaggatgtatggcttccactcatctcctatagaaattcattagtcactgggggtgaagatgatagaatgtctgtgaacagtggaagtagcagcagcaaaacctcatcagtaaggaataagaaaggacgacctccacttcataaaaaacgagtagaagatgagagtctggataacacatggctaaacaggactgacaccatgattcagactcctggccccctgccagcaccacaactcacatccactgtactgcgggagaacagtcggcccatgggagaccagattcaagaacctgagtctgaacatggttctgaaccagactttttacacaatcctcagatgcagatctcttggttaggccagccgaagttagaagacttaaatcggaaggacagaacaggaatgaactacatgaaagtgagaactggagtgaggcatgctgttcggggtctaatggaggaagatgctgagcccatctttgaagatgtgatgatgtcatcccgaagccagttagaagatatgaatgaagaatttgaggacaccatggttattgatctgcctccatcaagaaatcggcgagagagagctgagctaaggccagacttctttgactctgcagctatcatagaagatgattcaggatttggaatgcctatgttctgaagtctgaagaaaatttacaaatctggaactctattatttagagctagaggcctatatactgtgatagcttgtatggggaaaaacacttttgatgtgatctgatttgttttttaatcaaatgattaaggtcaatccctttttgcagtgacagaagaggagcatgtaaattacccaagggaatgttggtgaatgtcaactcagaaagactgacctgaaaatcatttgtgtcctactattggacttatcccaatacagatgtgtgtgtttttctggagggaggaagaaattttaaatttttaaaacagctgtcaagataaacactgttatacacctgttttatgaaaactcaacattgagtaaaaaaaaacatatttttaactttattttcctgttgtacaatttaaaaaccgttttaacattttgcctttttatgttttaaaagctaaccatttttattaaacctatgagtaagcagctcatcctaattgcgaagagtgttttggagttcactggatttggttgacctttgtggaacacaaataatgaaggagcagaacattgacaagctaagatgaaattctgacatagtacatctctgccaaaaaccacacaccctctgtggatatggatatgaattcccagattttatatactcttgaataaaaggtttatttttatttataagtgggcataaaataagaaatgtccatgcagccatttttccaacagatgctgtacaccgttcattttatatagactagggagattcaaatacagtgcattttctattggtatttgttctgtgcatttttagcaacttctaccagcaaataaagtattctcagtaaaacgaaaatgattctcaagttatcagtttgctgtttttaccacttatttcatgccctgccaaattcaagttacacagacttccattttcttaagataatcaatcatgaagaaatcctttatcaatcattcaaaagtaattttaagtgtaacataactgtgtttacttcccatgcacttaatacccttatgcgctaattttgtgaattaagtttactgattatagaagtatgtgctgcatagaagtctgtgcttagagggtgaagttcctaagcttaccttgaattacagctacatttcagtgttaaatgtgcatattaagaataattcttttggggaaagaaattatgaatcttcaggacagtctacaatggtttagagttacattctgcctagacttttatgacttgctgctattgttttaaaaaccccacttagtctctctcttcctttctgatttctaaagtaagcctcagaatttccaaaccaattcatccacagctgtttctgggctggtttttaaagtagctgcaacagaatcatgaggctttccctttttatcaaatacgaaaaacattttttaaaattctgcacacccagtgatcatcttttgtgcgggaaagcaagatgatgatggatgattttattcatccttttagtaaagacacaaaacatttttctcaacatttgtacagttctgaaaaaaacctggtcaccaaaaatatcttctctgctaattcagcaattcttgggctccagttaggggagctggggcctcactttctcccagaattgtgggcttcactggaagtgaaggtgcaggaatgactggactgtccaccccagccctgcctgcctgtggttttggccagggagcaagccatgaggtgccctggcacatgcacaaattgatcctttgcgtgacagtcttgtatggaaaacagatgctgacagaattgtagactaccatgccacacaaaaaggctaaatatctactccaatgggtttccagttcagtttgaagtcaatcaaatttttgtattttcggtgtctccttgattggttttgctagtaattctgtaaattgtacatttgcaatatgaggttttttttccttttgtacaatttgaaactgatgcttcacctttcctttaataaactattcaaaatcaggc

SEQ ID NO: 187074 - DNA, 5064 bp, Homo sapiens
  Payload ID: 16834
  Gene Symbol: STAG1
  Gene Name: stromal antigen 1
  ENST ID: ENST00000434713
  CDS Start-End: 971-3967
ccggacccaagtctgcagcggcgccattggcgtgtggaaaatgccaccagatggcgggttaggattgcagctccgttgaaggcgcggcccccgctcccgaacccccggcgaccaccccgtaacaacccccccacatcgggaataacacaccggagacttttggggggaaactaggtcgatggtcggcggcgcccggatgggcagctgaggattgcctttgaggttattttaaaagttttgagttgtacagcacttgattattttgctgcattgtgaaaggacctctccagcaatgattacttcagaattaccagtgttacaggattcaactaatgaaactactgcccattccgatgctggcagcgagcttgaagaaacagaggtcaaaggaaaaagaaaaaggggtcgtcctggccggcctccatctacaaataagaaacctcgaaaatctccaggtgagaagagcagaattgaagctggaattagaggagcaggccgtggaagagctaatggacaccctcaacagaatggggaaggggagcctgtcacattatttgaggtggtgaaactggggaaaagtgcaatgcagtccgtggtggatgactggattgaatcatataaacaagacagggacatcgcacttctggatttaatcaacttttttatccagtgttcaggatgtcgaggtactgtgagaatagagatgtttcgaaatatgcagaatgcagaaatcatcagaaaaatgactgaagaatttgatgaggacagtggtgattatcctcttaccatgcctggacctcagtggaaaaaatttcgttcaaacttttgtgaatttattggagtcctgattcgacagtgtcagtatagcataatttatgatgagtatatgatggacacagtaatctcccttttgacgggtttgtcagactcccaggtcagagcttttaggcatacaagtaccctggctgccatgaagctcatgactgctctggtgaatgttgccttaaacctcagtattcatcaggataatacccagagacaatatgaagccgagagaaataaaatgattgggaagagagccaatgaaaggttggagttactacttcagaaacgcaaagagctgcaagaaaatcaggatgaaatcgaaaatatgatgaactctatttttaagggtatatttgttcatagataccgtgatgctattgctgagattagagccatttgtattgaagaaattggagtatggatgaaaatgtatagtgatgccttcctaaatgacagttacctaaaatatgttggctggactcttcatgacaggcaaggggaagtcaggctgaagtgtttgaaagctctgcagagtctatataccaatagagaattattccccaaattggaactattcactaaccgattcaaggatcgcattgtatcaatgacacttgataaagaatatgatgttgctgtggaagctattcgattggttactctgatacttcatggaagtgaagaagctctttccaatgaagactgtgaaaatgtttaccacttggtgtactcggcacatcgccctgttgctgtggcagctggagagttccttcacaaaaagctatttagcagacatgacccacaagcagaagaagcattagcaaagaggaggggaagaaacagcccgaatggaaacctcattaggatgctggttcttttctttcttgaaagtgagttacatgaacatgcagcctacttggtggacagtttatgggagagctctcaagaactgttgaaagactgggaatgtatgacagagttgctattagaagaacctgttcaaggagaggaagcaatgtctgatcgtcaagagagtgctcttatagagctaatggtttgtacaattcgtcaagctgctgaggcacatcctccagtgggaaggggtaccggcaagagagtgctaactgccaaagaaaggaaaactcaaattgatgatagaaacaaattgactgaacattttattattacacttcctatgttactgtcaaagtattctgcagatgcagagaaggtagcaaacttgctacaaatcccacagtattttgatttagaaatctacagcacaggtagaatggaaaagcatctggatgctttattaaaacagattaagtttgttgtggagaaacacgtagaatcagatgttctagaagcctgcagtaaaacctatagtatcttatgcagtgaagaatataccatccagaacagagttgacatagctcgaagccagctgattgatgagtttgtagatcgattcaatcattctgtggaagacctattgcaagagggagaagaagctgatgatgatgacatttacaatgttctttctacattaaagcggttaacttcttttcacaatgcacatgatctcacaaaatgggatctctttggtaattgctacagattattgaagactggaattgaacatggagccatgccagaacagatagtcgtgcaagcactgcagtgttcccattattcgattctttggcagttggtgaaaattactgatggctctccttccaaagaggatttgttggtattgaggaaaacggtgaaatcctttttggctgtttgccagcagtgcctgtctaatgttaatactccagtgaaagaacaggctttcatgttactctgtgatcttctgatgattttcagccaccaattaatgacaggtggcagagagggccttcagcctttggtgttcaatccagatactggactccaatctgaactcctcagttttgtgatggatcacgtttttattgaccaagacgaggagaaccagagcatggagggtgatgaagaagatgaagctaataaaattgaggccttacataaaagaaggaatctacttgctgctttcagcaaacttatcatttatgacattgttgacatgcatgcagctgcagacatcttcaaacactacatgaagttatttaatgaacttgttcaagagcaaggtcccaacctagataggacatctgcccatgtcagtggcattaaagaactggcacgtcgctttgcccttacatttggattggaccagattaagacacgagaagcagttgccacacttcacaaggatggcatagagtttgcatttaaataccaaaatcagaaaggacaagagtatccacctcctaatctggcttttcttgaagtactaagtgaattttcttctaaacttcttcgacaggacaaaaagacagttcattcatacctagagaaattccttaccgagcagatgatggaaaggagggaggatgtatggcttccactcatctcctatagaaattcattagtcactgggggtgaagatgatagaatgtctgtgaacagtggaagtagcagcagcaaaacctcatcagtaaggaataagaaaggacgacctccacttcataaaaaacgagtagaagatgagagtctggataacacatggctaaacaggactgacaccatgattcagactcctggccccctgccagcaccacaactcacatccactgtactgcgggagaacagtcggcccatgggagaccagattcaagaacctgagtctgaacatggttctgaaccagactttttacacaatcctcagatgcagatctcttggttaggccagccgaagttagaagacttaaatcggaaggacagaacaggaatgaactacatgaaagtgagaactggagtgaggcatgctgttcggggtctaatggaggaagatgctgagcccatctttgaagatgtgatgatgtcatcccgaagccagttagaagatatgaatgaagaatttgaggacaccatggttattgatctgcctccatcaagaaatcggcgagagagagctgagctaaggccagacttctttgactctgcagctatcatagaagatgattcaggatttggaatgcctatgttctgaagtctgaagaaaatttacaaatctggaactctattatttagagctagaggcctatatactgtgatagcttgtatggggaaaaacacttttgatgtgatctgatttgttttttaatcaaatgattaaggtcaatccctttttgcagtgacagaagaggagcatgtaaattacccaagggaatgttggtgaatgtcaactcagaaagactgacctgaaaatcatttgtgtcctactattggacttatcccaatacagatgtgtgtgtttttctggagggaggaagaaattttaaatttttaaaacagctgtcaagataaacactgttatacacctgttttatgaaaactcaacattgagtaaaaaaaaacatatttttaactttattttcctgttgtacaatttaaaaaccgttttaacattttgcctttttatgttttaaaagctaaccatttttattaaacctatgagtaagcagctcatcctaattgcgaagagtgttttggagttcactggatttggttgacctttgtggaacacaaataatgaaggagcagaacattgacaagctaagatgaaattctgacatagtacatctctgccaaaaaccacacaccctctgtggatatggatatgaattcccagattttatatactcttgaataaaaggtttatttttatttataagtgggcataaaataagaaatgtccatgcagccatttttccaacagatgctgtacaccgttcattttatatagactagggagattcaaatacagtgcattttctattggtatttgttctgtgcatttttagcaacttctaccagcaaataaagtattctcagtaaaacgaaaatgattctcaagttatcagtttgctgtttttaccacttatttcatgccctgccaaattcaagttacacagacttccattttcttaagataatcaatcatgaagaaatcctttatcaatcattcaaaagtaattttaagtgtaacataactgtgtttacttcccatgcacttaatacccttatgcgctaattttgtgaattaagtttactgattatagaagtatgtgctgcatagaagtctgt

SEQ ID NO: 187075 - DNA, 2914 bp, Homo sapiens
  Payload ID: 16834
  Gene Symbol: STAG1
  Gene Name: stromal antigen 1
  ENST ID: ENST00000487065
  CDS Start-End: 267-752
ttggcgtgtggaaaatgccaccagatggcgggttaggattgcagctccgttgaaggcgcggcccccgctcccgaacccccggcgaccaccccgtaacaacccccccacatcgggaataacacaccggagacttttggggggaaactaggtcgatggtcggcggcgcccggatgggcagctgaggattgcctttgaggttattttaaaagttttgagttgtacagcacttgattattttgctgcattgtgaaaggacctctccagcaatgattacttcagaattaccagtgttacaggattcaactaatgaaactactgcccattccgatgctggcagcgagcttgaagaaacagaggtcaaaggaaaaagaaaaaggggtcgtcctggccggcctccatctacaaataagaaacctcgaaaatctccaggtgagaagagcagaattgaagctggaattagaggagcaggccgtggaagagctaatggacaccctcaacagaatggggaaggggagcctgtcacattatttgaggtggtgaaactggggaaaagtgcaatgcagagccttcatgttgtttgcattcacttggttggaaggggagagagaaagagaagcagtgtctacttcttagaagcctttggcccctctatttacattccattgatgggaacttaccacatactcagtccgtggtggatgactggattgaatcatataaacaagacagggacatcgcacttctggatttaatcaacttttttatccagtgttcaggatgtcgaggtactgtgagaatagagatgtttcgaaatatgcagaatgcagaaatcatcagaaaaatgactgaagaatttgatgaggacagtggtgattatcctcttaccatgcctggacctcagtggaaaaaatttcgttcaaacttttgtgaatttattggagtcctgattcgacagtgtcagtatagcataatttatgatgagtatatgatggacacagtaatctcccttttgacgggtttgtcagactcccaggtcagagcttttaggcatacaagtaccctggctgccatgaagctcatgactgctctggtgaatgttgccttaaacctcagtattcatcaggataatacccagagacaatatgaagccgagagaaataaaatgattgggaagagagccaatgaaaggttggagttactacttcagaaacgcaaagagctgcaagaaaatcaggatgaaatcgaaaatatgatgaactctatttttaagggtatatttgttcatagataccgtgatgctattgctgagattagagccatttgtattgaagaaattggagtatggatgaaaatgtatagtgatgccttcctaaatgacagttacctaaaatatgttggctggactcttcatgacaggcaaggggaagtcaggctgaagtgtttgaaagctctgcagagtctatataccaatagagaattattccccaaattggaactattcactaaccgattcaaggatcgcattgtatcaatgacacttgataaagaatatgatgttgctgtggaagctattcgattggttactctgatacttcatggaagtgaagaagctctttccaatgaagactgtgaaaatgtttaccacttggtgtactcggcacatcgccctgttgctgtggcagctggagagttccttcacaaaaagctatttagcagacatgacccacaagcagaagaagcattagcaaagaggaggggaagaaacagcccgaatggaaacctcattaggatgctggttcttttctttcttgaaagtgagttacatgaacatgcagcctacttggtggacagtttatgggagagctctcaagaactgttgaaagactgggaatgtatgacagagttgctattagaagaacctgttcaaggagaggaagcaatgtctgatcgtcaagagagtgctcttatagagctaatggtttgtacaattcgtcaagctgctgaggcacatcctccagtgggaaggggtaccggcaagagagtgctaactgccaaagaaaggaaaactcaaattgatgatagaaacaaattgactgaacattttattattacacttcctatgttactgtcaaagtattctgcagatgcagagaaggtagcaaacttgctacaaatcccacagtattttgatttagaaatctacagcacaggtagaatggaaaagcatctggatgctttattaaaacagattaagtttgttgtggagaaacacgtagaatcagatgttctagaagcctgcagtaaaacctatagtatcttatgcagtgaagaatataccatccagaacagagttgacatagctcgaagccagctgattgatgagtttgtagatcgattcaatcattctgtggaagacctattgcaagagggagaagaagctgatgatgatgacatttacaatgttctttctacattaaagcggttaacttcttttcacaatgcacatgatctcacaaaatgggatctctttggtaattgctacagattattgaagactggaattgaacatggagccatgccagaacaggtaggagtttattggtattccttctgtatgactctagaaagttgtttttctgaagtcatatgattatcagaagccttttatagaaagtaattgacgattcattagggcagctgcctcttttgagagaattattgctgtagtaattaaatgttattgataggtgtattatactggcttatgtgttaagagtagaaaaaacttttgctataacatatcttaaaaattttactgttaaggtagacttttctctattaggagaaataccattaatatctatggcagcaattttaaaactttggataatgaaaattgatgatgggtatattc

SEQ ID NO: 187076 - DNA, 5206 bp, Homo sapiens
  Payload ID: 16834
  Gene Symbol: STAG1
  Gene Name: stromal antigen 1
  ENST ID: ENST00000483235
  CDS Start-End: 268-573
attggcgtgtggaaaatgccaccagatggcgggttaggattgcagctccgttgaaggcgcggcccccgctcccgaacccccggcgaccaccccgtaacaacccccccacatcgggaataacacaccggagacttttggggggaaactaggtcgatggtcggcggcgcccggatgggcagctgaggattgcctttgaggttattttaaaagttttgagttgtacagcacttgattattttgctgcattgtgaaaggacctctccagcaatgattacttcagaattaccagtgttacaggattcaactaatgaaactactgcccattccgatgctggcagcgagcttgaagaaacagaggtcaaaggaaaaagaaaaaggggtcgtcctggccggcctccatctacaaataagaaacctcgaaaatctccaggtgagaagagcagaattgaagctggaattagaggagcaggccgtggaagagctaatggacaccctcaacagaatggggaaggggagcctgtcacattatttgaggtggtgaaactggggaaaagtgcaatgcagagatgttgacctttcaaataggtcagtgttgtccaggctgacctcgaacttctgggcccaagtgatcctccccggcctgagcctctcgagtagctgggactacagagccttcatgttgtttgcattcacttggttggaaggggagagagaaagagaagcagtgtctacttcttagaagcctttggcccctctatttacattccattgatgggaacttaccacatactcagtccgtggtggatgactggattgaatcatataaacaagacagggacatcgcacttctggatttaatcaacttttttatccagtgttcaggatgtcgaggtactgtgagaatagagatgtttcgaaatatgcagaatgcagaaatcatcagaaaaatgactgaagaatttgatgaggacagtggtgattatcctcttaccatgcctggacctcagtggaaaaaatttcgttcaaacttttgtgaatttattggagtcctgattcgacagtgtcagtatagcataatttatgatgagtatatgatggacacagtaatctcccttttgacgggtttgtcagactcccaggtcagagcttttaggcatacaagtaccctggctggacaagtcttggggactagataaaatgggcaggaacatttaatcctctgcttcaaagactatgtgcatggacagttacaaggcagttatggccagatatgattatcggctttggaataaaatgctccttgacattgcttaaatcttagctgagaagagagacaatcagccatgaagctcatgactgctctggtgaatgttgccttaaacctcagtattcatcaggataatacccagagacaatatgaagccgagagaaataaaatgattgggaagagagccaatgaaaggttggagttactacttcagaaacgcaaagagctgcaagaaaatcaggatgaaatcgaaaatatgatgaactctatttttaagggtatatttgttcatagataccgtgatgctattgctgagattagagccatttgtattgaagaaattggagtatggatgaaaatgtatagtgatgccttcctaaatgacagttacctaaaatatgttggctggactcttcatgacaggcaaggggaagtcaggctgaagtgtttgaaagctctgcagagtctatataccaatagagaattattccccaaattggaactattcactaaccgattcaaggatcgcattgtatcaatgacacttgataaagaatatgatgttgctgtggaagctattcgattggttactctgatacttcatggaagtgaagaagctctttccaatgaagactgtgaaaatgtttaccacttggtgtactcggcacatcgccctgttgctgtggcagctggagagttccttcacaaaaagctatttagcagacatgacccacaagcagaagaagcattagcaaagaggaggggaagaaacagcccgaatggaaacctcattaggatgctggttcttttctttcttgaaagtgagttacatgaacatgcagcctacttggtggacagtttatgggagagctctcaagaactgttgaaagactgggaatgtatgacagagttgctattagaagaacctgttcaaggagaggaagcaatgtctgatcgtcaagagagtgctcttatagagctaatggtttgtacaattcgtcaagctgctgaggcacatcctccagtgggaaggggtaccggcaagagagtgctaactgccaaagaaaggaaaactcaaattgatgatagaaacaaattgactgaacattttattattacacttcctatgttactgtcaaagtattctgcagatgcagagaaggtagcaaacttgctacaaatcccacagtattttgatttagaaatctacagcacaggtagaatggaaaagcatctggatgctttattaaaacagattaagtttgttgtggagaaacacgtagaatcagatgttctagaagcctgcagtaaaacctatagtatcttatgcagtgaagaatataccatccagaacagagttgacatagctcgaagccagctgattgatgagtttgtagatcgattcaatcattctgtggaagacctattgcaagagggagaagaagctgatgatgatgacatttacaatgttctttctacattaaagcggttaacttcttttcacaatgcacatgatctcacaaaatgggatctctttggtaattgctacagattattgaagactggaattgaacatggagccatgccagaacagatagtcgtgcaagcactgcagtgttcccattattcgattctttggcagttggtgaaaattactgatggctctccttccaaagaggatttgttggtattgaggaaaacggtgaaatcctttttggctgtttgccagcagtgcctgtctaatgttaatactccagtgaaagaacaggctttcatgttactctgtgatcttctgatgattttcagccaccaattaatgacaggtggcagagagggccttcagcctttggtgttcaatccagatactggactccaatctgaactcctcagttttgtgatggatcacgtttttattgaccaagacgaggagaaccagagcatggagggtgatgaagaagatgaagctaataaaattgaggccttacataaaagaaggaatctacttgctgctttcagcaaacttatcatttatgacattgttgacatgcatgcagctgcagacatcttcaaacactacatgaagttatttaatgaacttgttcaagagcaaggtcccaacctagataggacatctgcccatgtcagtggcattaaagaactggcacgtcgctttgcccttacatttggattggaccagattaagacacgagaagcagttgccacacttcacaaggatggcatagagtttgcatttaaataccaaaatcagaaaggacaagagtatccacctcctaatctggcttttcttgaagtactaagtgaattttcttctaaacttcttcgacaggacaaaaagacagttcattcatacctagagaaattccttaccgagcagatgatggaaaggagggaggatgtatggcttccactcatctcctatagaaattcattagtcactgggggtgaagatgatagaatgtctgtgaacagtggaagtagcagcagcaaaacctcatcagtaaggaataagaaaggacgacctccacttcataaaaaacgagtagaagatgagagtctggataacacatggctaaacaggactgacaccatgattcagactcctggccccctgccagcaccacaactcacatccactgtactgcgggagaacagtcggcccatgggagaccagattcaagaacctgagtctgaacatggttctgaaccagactttttacacaatcctcagatgcagatctcttggttaggccagccgaagttagaagacttaaatcggaaggacagaacaggaatgaactacatgaaagtgagaactggagtgaggcatgctgttcggggtctaatggaggaagatgctgagcccatctttgaagatgtgatgatgtcatcccgaagccagttagaagatatgaatgaagaatttgaggacaccatggttattgatctgcctccatcaagaaatcggcgagagagagctgagctaaggccagacttctttgactctgcagctatcatagaagatgattcaggatttggaatgcctatgttctgaagtctgaagaaaatttacaaatctggaactctattatttagagctagaggcctatatactgtgatagcttgtatggggaaaaacacttttgatgtgatctgatttgttttttaatcaaatgattaaggtcaatccctttttgcagtgacagaagaggagcatgtaaattacccaagggaatgttggtgaatgtcaactcagaaagactgacctgaaaatcatttgtgtcctactattggacttatcccaatacagatgtgtgtgtttttctggagggaggaagaaattttaaatttttaaaacagctgtcaagataaacactgttatacacctgttttatgaaaactcaacattgagtaaaaaaaaacatatttttaactttattttcctgttgtacaatttaaaaaccgttttaacattttgcctttttatgttttaaaagctaaccatttttattaaacctatgagtaagcagctcatcctaattgcgaagagtgttttggagttcactggatttggttgacctttgtggaacacaaataatgaaggagcagaacattgacaagctaagatgaaattctgacatagtacatctctgccaaaaaccacacaccctctgtggatatggatatgaattcccagattttatatactcttgaataaaaggtttatttttatttataagtgggcataaaataagaaatgtccatgcagccatttttccaacagatgctgtacaccgttcattttatatagactagggagattcaaatacagtgcattttctattggtatttgttctgtgcatttttagcaacttctaccagcaaataaagtattctcagtaaaacgaaaatgattctcaa

SEQ ID NO: 187077 - DNA, 570 bp, Homo sapiens
  Payload ID: 16834
  Gene Symbol: STAG1
  Gene Name: stromal antigen 1
  ENST ID: ENST00000492318
  CDS Start-End: 1-570
tgcagagtctatataccaatagagaattattccccaaattggaactattcactaaccgattcaaggatcgcattgtatcaatgacacttgataaagaatatgatgttgctgtggaagctattcgattggttactctgatacttcagctatttagcagacatgacccacaagcagaagaagcattagcaaagaggaggggaagaaacagcccgaatggaaacctcattaggatgctggttcttttctttcttgaaagtgagttacatgaacatgcagcctacttggtggacagtttatgggagagctctcaagaactgttgaaagactgggaatgtatgacagagttgctattagaagaacctgttcaaggagaggaagcaatgtctgatcgtcaagagagtgctcttatagagctaatggtttgtacaattcgtcaagctgctgaggcacatcctccagtgggaaggggtaccggcaagagagtgctaactgccaaagaaaggaaaactcaaattgatgatagaaacaaattgactgaacattttattattacacttcctatgttactgt

SEQ ID NO: 187078 - DNA, 1304 bp, Homo sapiens
  Payload ID: 16834
  Gene Symbol: STAG1
  Gene Name: stromal antigen 1
  ENST ID: ENST00000480733
  CDS Start-End: 256-954
aaaatgccaccagatggcgggttaggattgcagctccgttgaaggcgcggcccccgctcccgaacccccggcgaccaccccgtaacaacccccccacatcgggaataacacaccggagacttttggggggaaactaggtcgatggtcggcggcgcccggatgggcagctgaggattgcctttgaggttattttaaaagttttgagttgtacagcacttgattattttgctgcattgtgaaaggacctctccagcaatgattacttcagaattaccagtgttacaggattcaactaatgaaactactgcccattccgatgctggcagcgagcttgaagaaacagaggtcaaaggaaaaagaaaaaggggtcgtcctggccggcctccatctacaaataagaaacctcgaaaatctccaggtgagaagagcagaattgaagctggaattagaggagcaggccgtggaagagctaatggacaccctcaacagaatggggaaggggagcctgtcacattatttgaggtggtgaaactggggaaaagtgcaatgcagtccgtggtggatgactggattgaatcatataaacaagacagggacatcgcacttctggatttaatcaacttttttatccagtgttcaggatgtcgaggtactgtgagaatagagatgtttcgaaatatgcagaatgcagaaatcatcagaaaaatgactgaagaatttgatgaggacagtggtgattatcctcttaccatgcctggacctcagtggaaaaaatttcgttcaaacttttgtgaatttattggagtcctgattcgacagtgtcagtatagcataatttatgatgagtatatgatggacacagtaatctcccttttgacgggtttgtcagactcccaggtcagagcttttaggcatacaagtaccctggctggacaagtcttggggactagataaaatgggcaggaacatttaatcctctgcttcaaagactatgtgcatggacagttacaaggcagttatggccagatatgattatcggctttggaataaaatgctccttgacattgcttaaatcttagctgagaagagagacaatcaggttagttattttgtagggtacagatgtgatgagttccagagcttcataagtcatcagagtggtcttatcagtagtatttttaatctgttttccaaatatcccattttcctgttatgaattcaatatgtgtccctgttgtcagtgtttatgcattgcatttaattgtatacttttacatttttattaaaagttttttttatcatta

SEQ ID NO: 187079 - DNA, 4322 bp, Homo sapiens
  Payload ID: 16834
  Gene Symbol: STAG1
  Gene Name: stromal antigen 1
  ENST ID: ENST00000629124
  CDS Start-End: 262-747
gtgtggaaaatgccaccagatggcgggttaggattgcagctccgttgaaggcgcggcccccgctcccgaacccccggcgaccaccccgtaacaacccccccacatcgggaataacacaccggagacttttggggggaaactaggtcgatggtcggcggcgcccggatgggcagctgaggattgcctttgaggttattttaaaagttttgagttgtacagcacttgattattttgctgcattgtgaaaggacctctccagcaatgattacttcagaattaccagtgttacaggattcaactaatgaaactactgcccattccgatgctggcagcgagcttgaagaaacagaggtcaaaggaaaaagaaaaaggggtcgtcctggccggcctccatctacaaataagaaacctcgaaaatctccaggtgagaagagcagaattgaagctggaattagaggagcaggccgtggaagagctaatggacaccctcaacagaatggggaaggggagcctgtcacattatttgaggtggtgaaactggggaaaagtgcaatgcagagccttcatgttgtttgcattcacttggttggaaggggagagagaaagagaagcagtgtctacttcttagaagcctttggcccctctatttacattccattgatgggaacttaccacatactcagtccgtggtggatgactggattgaatcatataaacaagacagggacatcgcacttctggatttaatcaacttttttatccagtgttcaggatgtcgaggtactgtgagaatagagatgtttcgaaatatgcagaatgcagaaatcatcagaaaaatgactgaagaatttgatgaggacagtggtgattatcctcttaccatgcctggacctcagtggaaaaaatttcgttcaaacttttgtgaatttattggagtcctgattcgacagtgtcagtatagcataatttatgatgagtatatgatggacacagtaatctcccttttgacgggtttgtcagactcccaggtcagagcttttaggcatacaagtaccctggctgccatgaagctcatgactgctctggtgaatgttgccttaaacctcagtattcatcaggataatacccagagacaatatgaagccgagagaaataaaatgattgggaagagagccaatgaaaggttggagttactacttcagaaacgcaaagagctgcaagaaaatcaggatgaaatcgaaaatatgatgaactctatttttaagggtatatttgttcatagataccgtgatgctattgctgagattagagccatttgtattgaagaaattggagtatggatgaaaatgtatagtgatgccttcctaaatgacagttacctaaaatatgttggctggactcttcatgacaggcaaggggaagtcaggctgaagtgtttgaaagctctgcagagtctatataccaatagagaattattccccaaattggaactattcactaaccgattcaaggatcgcattgtatcaatgacacttgataaagaatatgatgttgctgtggaagctattcgattggttactctgatacttcatggaagtgaagaagctctttccaatgaagactgtgaaaatgtttaccacttggtgtactcggcacatcgccctgttgctgtggcagctggagagttccttcacaaaaagctatttagcagacatgacccacaagcagaagaagcattagcaaagaggaggggaagaaacagcccgaatggaaacctcattaggatgctggttcttttctttcttgaaagtgagttacatgaacatgcagcctacttggtggacagtttatgggagagctctcaagaactgttgaaagactgggaatgtatgacagagttgctattagaagaacctgttcaaggagaggaagcaatgtctgatcgtcaagagagtgctcttatagagctaatggtttgtacaattcgtcaagctgctgaggcacatcctccagtgggaaggggtaccggcaagagagtgctaactgccaaagaaaggaaaactcaaattgatgatagaaacaaattgactgaacattttattattacacttcctatgttactgtcaaagtattctgcagatgcagagaaggtagcaaacttgctacaaatcccacagtattttgatttagaaatctacagcacaggtagaatggaaaagcatctggatgctttattaaaacagattaagtttgttgtggagaaacacgtagaatcagatgttctagaagcctgcagtaaaacctatagtatcttatgcagtgaagaatataccatccagaacagagttgacatagctcgaagccagctgattgatgagtttgtagatcgattcaatcattctgtggaagacctattgcaagagggagaagaagctgatgatgatgacatttacaatgttctttctacattaaagcggttaacttcttttcacaatgcacatgatctcacaaaatgggatctctttggtaattgctacagattattgaagactggaattgaacatggagccatgccagaacagatagtcgtgcaagcactgcagtgttcccattattcgattctttggcagttggtgaaaattactgatggctctccttccaaagaggatttgttggtattgaggaaaacggtgaaatcctttttggctgtttgccagcagtgcctgtctaatgttaatactccagtgaaagaacaggctttcatgttactctgtgatcttctgatgattttcagccaccaattaatgacaggtggcagagagggccttcagcctttggtgttcaatccagatactggactccaatctgaactcctcagttttgtgatggatcacgtttttattgaccaagacgaggagaaccagagcatggagggtgatgaagaagatgaagctaataaaattgaggccttacataaaagaaggaatctacttgctgctttcagcaaacttatcatttatgacattgttgacatgcatgcagctgcagacatcttcaaacactacatgaagtattacaatgactatggtgatattattaaggaaacactgagtaaaaccaggcagattgataaaattcagtgtgccaagactctcattctcagtttgcaacagttatttaatgaacttgttcaagagcaaggtcccaacctagataggacatctgcccatgtcagtggcattaaagaactggcacgtcgctttgcccttacatttggattggaccagattaagacacgagaagcagttgccacacttcacaaggatggcatagagtttgcatttaaataccaaaatcagaaaggacaagagtatccacctcctaatctggcttttcttgaagtactaagtgaattttcttctaaacttcttcgacaggacaaaaagacagttcattcatacctagagaaattccttaccgagcagatgatggaaaggagggaggatgtatggcttccactcatctcctatagaaattcattagtcactgggggtgaagatgatagaatgtctgtgaacagtggaagtagcagcagcaaaacctcatcagtaaggaataagaaaggacgacctccacttcataaaaaacgagtagaagatgagagtctggataacacatggctaaacaggactgacaccatgattcagactcctggccccctgccagcaccacaactcacatccactgtactgcgggagaacagtcggcccatgggagaccagattcaagaacctgagtctgaacatggttctgaaccagactttttacacaatcctcagatgcagatctcttggttaggccagccgaagttagaagacttaaatcggaaggacagaacaggaatgaactacatgaaagtgagaactggagtgaggcatgctgttcggggtctaatggaggaagatgctgagcccatctttgaagatgtgatgatgtcatcccgaagccagttagaagatatgaatgaagaatttgaggacaccatggttattgatctgcctccatcaagaaatcggcgagagagagctgagctaaggccagacttctttgactctgcagctatcatagaagatgattcaggatttggaatgcctatgttctgaagtctgaagaaaatttacaaatctggaactctattatttagagctagaggcctatatactgtgatagcttgtatggggaaaaacacttttgatgtgatctgatttgttttttaatcaaatgattaaggtcaatccctttttgcagtgacagaagaggag

SEQ ID NO: 187080 - DNA, 5218 bp, Homo sapiens
  Payload ID: 16835
  Gene Symbol: STAG2
  Gene Name: stromal antigen 2
  Uniprot ID: Q8N3U4
  ENST ID: ENST00000218089
  CDS Start-End: 511-4317
gtggccgacagatggcgcctgcgcgttccattcgcctccaagtcgccgaagagcgaacaccccaaacaatcccgaagcgccaccaaaaaaaaaaaaaaaaaaaaaaaaaaaaaaaaaaaaaaaaagaaaaaaaaccccgccggatccgaccgccactttcaaaaccccccaccgctctagaaccgcgggagcttccgtccctgagtagaattcgagggtgtaaagaagaggaaggggaaaaatatcttgtaccagcccaggggtgaagaagcccccggcctgagaaagaaggaggagtgggggaggcgaacagtctcgttgctgcctctgtgtacgctgaggggggaggtggccaccgagtactaaattcacttgggaataaaagaaaaacataagaaaattataagagaaaggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagagcttcaggaaaatcaagatgaaatagaaaatatgatgaatgcaatatttaaaggagtgtttgtacatagataccgtgatgcgatagctgaaattcgagctatttgcattgaagagattggcatttggatgaagatgtatagtgatgcctttcttaatgacagttatttaaaatatgttggttggactatgcatgataagcaaggtgaagtaagactcaaatgtcttactgctctacaagggctttattataacaaagagcttaattccaaactggaactttttaccagtcggttcaaggatagaattgtgtctatgacccttgacaaagaatatgatgttgcagtacaagcaataaaattactcactcttgttttacagagtagtgaagaagttctcactgcagaagattgtgaaaatgtctatcatctggtttattcagctcaccggccagtagcagtagcagctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgcttacagcaaaggagaagaagacacagttggatgataggacaaaaatcactgagctttttgccgtggcccttcctcagttattagcaaaatactctgtagatgcagaaaaggtgactaacttgttgcagttgcctcagtactttgatttggaaatatataccactggacgattagaaaagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagagggtgaagaacctgatgaagatgatgcatatcaggtattgtcaacattgaagaggatcactgcttttcataatgcccatgacctttcaaagtgggatttatttgcttgtaattacaaactcttgaaaactggaatcgaaaatggagacatgcctgagcagattgttattcacgcactgcagtgtactcactatgtaatcctttggcaacttgctaagataactgaaagcagctctacaaaggaggacttgctgcgtttaaagaaacaaatgagagtattttgtcagatatgtcaacattacctgaccaacgtgaatactactgttaaggaacaggccttcactattctgtgtgatattttgatgatcttcagccatcagattatgtcaggagggcgtgacatgttagagccattagtgtatacccctgattcttcattgcagtctgagttgctcagctttattttggatcatgtcttcattgaacaggatgatgataataatagtgcagatggtcagcaagaggatgaagccagtaaaattgaagctctgcacaagagaagaaatttacttgcagcattttgtaagctaattgtatatactgtggtggagatgaatacagctgcagatatcttcaaacagtatatgaagtattataatgactatggagatatcatcaaagaaacaatgagtaaaacaaggcagatagacaaaattcagtgtgctaagacccttattctcagtctgcaacagctttttaatgaaatgatacaagaaaatggctataattttgatagatcatcctctacatttagtggcataaaagaacttgctcgacgttttgctttaacttttggacttgatcagttgaaaacaagagaagccattgccatgctacacaaagatggcatagaatttgcttttaaagagcctaatccgcaaggggagagccatccacctttaaatttggcatttcttgatattctgagtgaattttcttctaaactacttcgacaagacaaaagaacagtgtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcactgaagaaagtagtagtagtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatcaaacacctcttgattataacacgcaggtaacatggatgttagctcaaagacaacaagaggaagcaaggcaacagcaggagagagcagcaatgagctatgttaaactgcgaactaatcttcagcatgccattcggcgtggcacaagcctaatggaagatgatgaagagccaattgtggaagatgttatgatgtcctcagaagggaggattgaggatcttaatgagggaatggattttgacaccatggatatagatttgccaccatcaaagaacagacgagagagaacagaactgaagcctgatttctttgatccagcttcaattatggatgaatcagttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaaacaaaataacaatctgaagaggcatttggtacagatatgaattctcttacatttatttactggttgtactaaataatgatgacctctgctggatttctgtttacatccagaaaacaatgttaaggatgtatttattcccctaccctgaagaaagtgtaggatagaattgtttttagcattctaaatttaaatgcttaaaacgtcaatcaacaaaactttgttttaaatattgtaattgtggagaaaagtaaacttataagcagaacttttacaattttttcatctaaaagtattttaagatatttttaaaatccaagagcttctctatacttttcagaaatatccagatgcagtgaactgccagaaggtaaccagtctcaaacatgcttatcccattatcaaccctgaaagtttgcttgtcctttaagataaaaatgtaatgttgtgatattccttccagtaatgccactgtattttgtctccaaataaaagaagcttattgtagtatgtttgcagaaaaattctaaacaaaaattatacagcttattagagtgtgggaatagggatctaaattttaaataaaattatatatatatataaa

SEQ ID NO: 187081 - DNA, 4281 bp, Homo sapiens
  Payload ID: 16835
  Gene Symbol: STAG2
  Gene Name: stromal antigen 2
  Uniprot ID: Q8N3U4
  ENST ID: ENST00000371144
  CDS Start-End: 281-3976
ttcatgtgacgggcccctctgcttctcccccgccccatcatctccagcgcgtggtgggggaactgctggggaaggcgattggcatcgatctctccatcccttccgaggcccgacttcggtggccaccgagtactaaattcacttgggaataaaagaaaaacataagaaaattataagagaaaggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagagcttcaggaaaatcaagatgaaatagaaaatatgatgaatgcaatatttaaaggagtgtttgtacatagataccgtgatgcgatagctgaaattcgagctatttgcattgaagagattggcatttggatgaagatgtatagtgatgcctttcttaatgacagttatttaaaatatgttggttggactatgcatgataagcaaggtgaagtaagactcaaatgtcttactgctctacaagggctttattataacaaagagcttaattccaaactggaactttttaccagtcggttcaaggatagaattgtgtctatgacccttgacaaagaatatgatgttgcagtacaagcaataaaattactcactcttgttttacagagtagtgaagaagttctcactgcagaagattgtgaaaatgtctatcatctggtttattcagctcaccggccagtagcagtagcagctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgcttacagcaaaggagaagaagacacagttggatgataggacaaaaatcactgagctttttgccgtggcccttcctcagttattagcaaaatactctgtagatgcagaaaaggtgactaacttgttgcagttgcctcagtactttgatttggaaatatataccactggacgattagaaaagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagagggtgaagaacctgatgaagatgatgcatatcaggtattgtcaacattgaagaggatcactgcttttcataatgcccatgacctttcaaagtgggatttatttgcttgtaattacaaactcttgaaaactggaatcgaaaatggagacatgcctgagcagattgttattcacgcactgcagtgtactcactatgtaatcctttggcaacttgctaagataactgaaagcagctctacaaaggaggacttgctgcgtttaaagaaacaaatgagagtattttgtcagatatgtcaacattacctgaccaacgtgaatactactgttaaggaacaggccttcactattctgtgtgatattttgatgatcttcagccatcagattatgtcaggagggcgtgacatgttagagccattagtgtatacccctgattcttcattgcagtctgagttgctcagctttattttggatcatgtcttcattgaacaggatgatgataataatagtgcagatggtcagcaagaggatgaagccagtaaaattgaagctctgcacaagagaagaaatttacttgcagcattttgtaagctaattgtatatactgtggtggagatgaatacagctgcagatatcttcaaacagtatatgaagtattataatgactatggagatatcatcaaagaaacaatgagtaaaacaaggcagatagacaaaattcagtgtgctaagacccttattctcagtctgcaacagctttttaatgaaatgatacaagaaaatggctataattttgatagatcatcctctacatttagtggcataaaagaacttgctcgacgttttgctttaacttttggacttgatcagttgaaaacaagagaagccattgccatgctacacaaagatggcatagaatttgcttttaaagagcctaatccgcaaggggagagccatccacctttaaatttggcatttcttgatattctgagtgaattttcttctaaactacttcgacaagacaaaagaacagtgtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcactgaagaaagtagtagtagtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatcaaacacctcttgattataatcggcgtggcacaagcctaatggaagatgatgaagagccaattgtggaagatgttatgatgtcctcagaagggaggattgaggatcttaatgagggaatggattttgacaccatggatatagatttgccaccatcaaagaacagacgagagagaacagaactgaagcctgatttctttgatccagcttcaattatggatgaatcagttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaaacaaa

SEQ ID NO: 187082 - DNA, 4393 bp, Homo sapiens
  Payload ID: 16835
  Gene Symbol: STAG2
  Gene Name: stromal antigen 2
  Uniprot ID: Q8N3U4
  ENST ID: ENST00000371145
  CDS Start-End: 282-4088
attcatgtgacgggcccctctgcttctcccccgccccatcatctccagcgcgtggtgggggaactgctggggaaggcgattggcatcgatctctccatcccttccgaggcccgacttcggtggccaccgagtactaaattcacttgggaataaaagaaaaacataagaaaattataagagaaaggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagagcttcaggaaaatcaagatgaaatagaaaatatgatgaatgcaatatttaaaggagtgtttgtacatagataccgtgatgcgatagctgaaattcgagctatttgcattgaagagattggcatttggatgaagatgtatagtgatgcctttcttaatgacagttatttaaaatatgttggttggactatgcatgataagcaaggtgaagtaagactcaaatgtcttactgctctacaagggctttattataacaaagagcttaattccaaactggaactttttaccagtcggttcaaggatagaattgtgtctatgacccttgacaaagaatatgatgttgcagtacaagcaataaaattactcactcttgttttacagagtagtgaagaagttctcactgcagaagattgtgaaaatgtctatcatctggtttattcagctcaccggccagtagcagtagcagctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgcttacagcaaaggagaagaagacacagttggatgataggacaaaaatcactgagctttttgccgtggcccttcctcagttattagcaaaatactctgtagatgcagaaaaggtgactaacttgttgcagttgcctcagtactttgatttggaaatatataccactggacgattagaaaagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagagggtgaagaacctgatgaagatgatgcatatcaggtattgtcaacattgaagaggatcactgcttttcataatgcccatgacctttcaaagtgggatttatttgcttgtaattacaaactcttgaaaactggaatcgaaaatggagacatgcctgagcagattgttattcacgcactgcagtgtactcactatgtaatcctttggcaacttgctaagataactgaaagcagctctacaaaggaggacttgctgcgtttaaagaaacaaatgagagtattttgtcagatatgtcaacattacctgaccaacgtgaatactactgttaaggaacaggccttcactattctgtgtgatattttgatgatcttcagccatcagattatgtcaggagggcgtgacatgttagagccattagtgtatacccctgattcttcattgcagtctgagttgctcagctttattttggatcatgtcttcattgaacaggatgatgataataatagtgcagatggtcagcaagaggatgaagccagtaaaattgaagctctgcacaagagaagaaatttacttgcagcattttgtaagctaattgtatatactgtggtggagatgaatacagctgcagatatcttcaaacagtatatgaagtattataatgactatggagatatcatcaaagaaacaatgagtaaaacaaggcagatagacaaaattcagtgtgctaagacccttattctcagtctgcaacagctttttaatgaaatgatacaagaaaatggctataattttgatagatcatcctctacatttagtggcataaaagaacttgctcgacgttttgctttaacttttggacttgatcagttgaaaacaagagaagccattgccatgctacacaaagatggcatagaatttgcttttaaagagcctaatccgcaaggggagagccatccacctttaaatttggcatttcttgatattctgagtgaattttcttctaaactacttcgacaagacaaaagaacagtgtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcactgaagaaagtagtagtagtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatcaaacacctcttgattataacacgcaggtaacatggatgttagctcaaagacaacaagaggaagcaaggcaacagcaggagagagcagcaatgagctatgttaaactgcgaactaatcttcagcatgccattcggcgtggcacaagcctaatggaagatgatgaagagccaattgtggaagatgttatgatgtcctcagaagggaggattgaggatcttaatgagggaatggattttgacaccatggatatagatttgccaccatcaaagaacagacgagagagaacagaactgaagcctgatttctttgatccagcttcaattatggatgaatcagttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaaacaaa

SEQ ID NO: 187083 - DNA, 5991 bp, Homo sapiens
  Payload ID: 16835
  Gene Symbol: STAG2
  Gene Name: stromal antigen 2
  Uniprot ID: Q8N3U4
  ENST ID: ENST00000371157
  CDS Start-End: 237-3932
cttcctagagagggaacaacattcatgtgacgggcccctctgcttctcccccgccccatcatctccagcgcgtggtgggggaactgctggggaaggcgattggcatcgatctctccatcccttccgaggcccgacttcggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagagcttcaggaaaatcaagatgaaatagaaaatatgatgaatgcaatatttaaaggagtgtttgtacatagataccgtgatgcgatagctgaaattcgagctatttgcattgaagagattggcatttggatgaagatgtatagtgatgcctttcttaatgacagttatttaaaatatgttggttggactatgcatgataagcaaggtgaagtaagactcaaatgtcttactgctctacaagggctttattataacaaagagcttaattccaaactggaactttttaccagtcggttcaaggatagaattgtgtctatgacccttgacaaagaatatgatgttgcagtacaagcaataaaattactcactcttgttttacagagtagtgaagaagttctcactgcagaagattgtgaaaatgtctatcatctggtttattcagctcaccggccagtagcagtagcagctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgcttacagcaaaggagaagaagacacagttggatgataggacaaaaatcactgagctttttgccgtggcccttcctcagttattagcaaaatactctgtagatgcagaaaaggtgactaacttgttgcagttgcctcagtactttgatttggaaatatataccactggacgattagaaaagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagagggtgaagaacctgatgaagatgatgcatatcaggtattgtcaacattgaagaggatcactgcttttcataatgcccatgacctttcaaagtgggatttatttgcttgtaattacaaactcttgaaaactggaatcgaaaatggagacatgcctgagcagattgttattcacgcactgcagtgtactcactatgtaatcctttggcaacttgctaagataactgaaagcagctctacaaaggaggacttgctgcgtttaaagaaacaaatgagagtattttgtcagatatgtcaacattacctgaccaacgtgaatactactgttaaggaacaggccttcactattctgtgtgatattttgatgatcttcagccatcagattatgtcaggagggcgtgacatgttagagccattagtgtatacccctgattcttcattgcagtctgagttgctcagctttattttggatcatgtcttcattgaacaggatgatgataataatagtgcagatggtcagcaagaggatgaagccagtaaaattgaagctctgcacaagagaagaaatttacttgcagcattttgtaagctaattgtatatactgtggtggagatgaatacagctgcagatatcttcaaacagtatatgaagtattataatgactatggagatatcatcaaagaaacaatgagtaaaacaaggcagatagacaaaattcagtgtgctaagacccttattctcagtctgcaacagctttttaatgaaatgatacaagaaaatggctataattttgatagatcatcctctacatttagtggcataaaagaacttgctcgacgttttgctttaacttttggacttgatcagttgaaaacaagagaagccattgccatgctacacaaagatggcatagaatttgcttttaaagagcctaatccgcaaggggagagccatccacctttaaatttggcatttcttgatattctgagtgaattttcttctaaactacttcgacaagacaaaagaacagtgtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcactgaagaaagtagtagtagtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatcaaacacctcttgattataatcggcgtggcacaagcctaatggaagatgatgaagagccaattgtggaagatgttatgatgtcctcagaagggaggattgaggatcttaatgagggaatggattttgacaccatggatatagatttgccaccatcaaagaacagacgagagagaacagaactgaagcctgatttctttgatccagcttcaattatggatgaatcagttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaaacaaaataacaatctgaagaggcatttggtacagatatgaattctcttacatttatttactggttgtactaaataatgatgacctctgctggatttctgtttacatccagaaaacaatgttaaggatgtatttattcccctaccctgaagaaagtgtaggatagaattgtttttagcattctaaatttaaatgcttaaaacgtcaatcaacaaaactttgttttaaatattgtaattgtggagaaaagtaaacttataagcagaacttttacaattttttcatctaaaagtattttaagatatttttaaaatccaagagcttctctatacttttcagaaatatccagatgcagtgaactgccagaaggtaaccagtctcaaacatgcttatcccattatcaaccctgaaagtttgcttgtcctttaagataaaaatgtaatgttgtgatattccttccagtaatgccactgtattttgtctccaaataaaagaagcttattgtagtatgtttgcagaaaaattctaaacaaaaattatacagcttattagagtgtgggaatagggatctaaattttaaataaaattatatatatatataaattggtgctgattttataattgcgcagtttgtttagttttttcttacttttaaattccaacttaaaattatgaggtttcagaaatatattgaaagtttaacaatgtttaaaaatagaaaagcatgagtgttcatgctttaaaatgatttttaaatttgtattttatattgttttatctatctgtctttgcaagcagtcttcaggttaaagatacttctaacaggttacagtacatttcctctgtatgtaaattagatgggataatagaattcataacccataatattctttgaaagctaagctttaaacttcattttatgtcctttcacaaataaattagtttaaaacagaaagtggctacttgccattttgacatcaactcattttgcgaggcttaggcagctagacatcgtttaaaacaaaatattaacttatattacatgtgtatctatctattgtcagtcgtctctcagttcttgaggtatattattttaatcattccatgccttaatatgcttgcaatacaagaatatcttcagatgggtgaataccaaaaggctttcagtttttagtcagaaatcaagcattgggctgtggtagccaaaaaccataggttagctaaaaagatcatgatacaattattttattaagtcatggttaataacaaatgaatccagacttgtctaacagattttccatcaacaaatattgttatgtgcaaaagtattgcctatgttgttttacacaccactgcattaactagaactgctgagaggactgtatatatgattttaaacctaagttgattttttttctcactcttgaaaggagtacttctttgtgaaagcagttcttacagctttgttttcaaccagctaaaaatgttttatatattactctaacctgttgtcctccacattctattgtcctaattgtactgttttctgatttgtatttatgtcttgagacagtaactttttgaataaaaataaacctacagtatgttgtatgttttctcttgtactcaaagggggagggtggctataaatggtttgcaaatttatatctattatcacatcttttaatgtgtttggggaataatttatagagaataccatcagtttatatttttaataaatcatatgtatttacaatgaaa

SEQ ID NO: 187084 - DNA, 6045 bp, Homo sapiens
  Payload ID: 16835
  Gene Symbol: STAG2
  Gene Name: stromal antigen 2
  Uniprot ID: Q8N3U4
  ENST ID: ENST00000371160
  CDS Start-End: 291-3986
gggtggcccaaaatggagaacgcggagcagcgcaagatggaggctccgcttctctgtgtagcagtagatttaggttccttttctccggcaggctcctaagcctaggagagcccgaactggagcgcgtggtgggggaactgctggggaaggcgattggcatcgatctctccatcccttccgaggcccgacttcggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagagcttcaggaaaatcaagatgaaatagaaaatatgatgaatgcaatatttaaaggagtgtttgtacatagataccgtgatgcgatagctgaaattcgagctatttgcattgaagagattggcatttggatgaagatgtatagtgatgcctttcttaatgacagttatttaaaatatgttggttggactatgcatgataagcaaggtgaagtaagactcaaatgtcttactgctctacaagggctttattataacaaagagcttaattccaaactggaactttttaccagtcggttcaaggatagaattgtgtctatgacccttgacaaagaatatgatgttgcagtacaagcaataaaattactcactcttgttttacagagtagtgaagaagttctcactgcagaagattgtgaaaatgtctatcatctggtttattcagctcaccggccagtagcagtagcagctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgcttacagcaaaggagaagaagacacagttggatgataggacaaaaatcactgagctttttgccgtggcccttcctcagttattagcaaaatactctgtagatgcagaaaaggtgactaacttgttgcagttgcctcagtactttgatttggaaatatataccactggacgattagaaaagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagagggtgaagaacctgatgaagatgatgcatatcaggtattgtcaacattgaagaggatcactgcttttcataatgcccatgacctttcaaagtgggatttatttgcttgtaattacaaactcttgaaaactggaatcgaaaatggagacatgcctgagcagattgttattcacgcactgcagtgtactcactatgtaatcctttggcaacttgctaagataactgaaagcagctctacaaaggaggacttgctgcgtttaaagaaacaaatgagagtattttgtcagatatgtcaacattacctgaccaacgtgaatactactgttaaggaacaggccttcactattctgtgtgatattttgatgatcttcagccatcagattatgtcaggagggcgtgacatgttagagccattagtgtatacccctgattcttcattgcagtctgagttgctcagctttattttggatcatgtcttcattgaacaggatgatgataataatagtgcagatggtcagcaagaggatgaagccagtaaaattgaagctctgcacaagagaagaaatttacttgcagcattttgtaagctaattgtatatactgtggtggagatgaatacagctgcagatatcttcaaacagtatatgaagtattataatgactatggagatatcatcaaagaaacaatgagtaaaacaaggcagatagacaaaattcagtgtgctaagacccttattctcagtctgcaacagctttttaatgaaatgatacaagaaaatggctataattttgatagatcatcctctacatttagtggcataaaagaacttgctcgacgttttgctttaacttttggacttgatcagttgaaaacaagagaagccattgccatgctacacaaagatggcatagaatttgcttttaaagagcctaatccgcaaggggagagccatccacctttaaatttggcatttcttgatattctgagtgaattttcttctaaactacttcgacaagacaaaagaacagtgtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcactgaagaaagtagtagtagtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatcaaacacctcttgattataatcggcgtggcacaagcctaatggaagatgatgaagagccaattgtggaagatgttatgatgtcctcagaagggaggattgaggatcttaatgagggaatggattttgacaccatggatatagatttgccaccatcaaagaacagacgagagagaacagaactgaagcctgatttctttgatccagcttcaattatggatgaatcagttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaaacaaaataacaatctgaagaggcatttggtacagatatgaattctcttacatttatttactggttgtactaaataatgatgacctctgctggatttctgtttacatccagaaaacaatgttaaggatgtatttattcccctaccctgaagaaagtgtaggatagaattgtttttagcattctaaatttaaatgcttaaaacgtcaatcaacaaaactttgttttaaatattgtaattgtggagaaaagtaaacttataagcagaacttttacaattttttcatctaaaagtattttaagatatttttaaaatccaagagcttctctatacttttcagaaatatccagatgcagtgaactgccagaaggtaaccagtctcaaacatgcttatcccattatcaaccctgaaagtttgcttgtcctttaagataaaaatgtaatgttgtgatattccttccagtaatgccactgtattttgtctccaaataaaagaagcttattgtagtatgtttgcagaaaaattctaaacaaaaattatacagcttattagagtgtgggaatagggatctaaattttaaataaaattatatatatatataaattggtgctgattttataattgcgcagtttgtttagttttttcttacttttaaattccaacttaaaattatgaggtttcagaaatatattgaaagtttaacaatgtttaaaaatagaaaagcatgagtgttcatgctttaaaatgatttttaaatttgtattttatattgttttatctatctgtctttgcaagcagtcttcaggttaaagatacttctaacaggttacagtacatttcctctgtatgtaaattagatgggataatagaattcataacccataatattctttgaaagctaagctttaaacttcattttatgtcctttcacaaataaattagtttaaaacagaaagtggctacttgccattttgacatcaactcattttgcgaggcttaggcagctagacatcgtttaaaacaaaatattaacttatattacatgtgtatctatctattgtcagtcgtctctcagttcttgaggtatattattttaatcattccatgccttaatatgcttgcaatacaagaatatcttcagatgggtgaataccaaaaggctttcagtttttagtcagaaatcaagcattgggctgtggtagccaaaaaccataggttagctaaaaagatcatgatacaattattttattaagtcatggttaataacaaatgaatccagacttgtctaacagattttccatcaacaaatattgttatgtgcaaaagtattgcctatgttgttttacacaccactgcattaactagaactgctgagaggactgtatatatgattttaaacctaagttgattttttttctcactcttgaaaggagtacttctttgtgaaagcagttcttacagctttgttttcaaccagctaaaaatgttttatatattactctaacctgttgtcctccacattctattgtcctaattgtactgttttctgatttgtatttatgtcttgagacagtaactttttgaataaaaataaacctacagtatgttgtatgttttctcttgtactcaaagggggagggtggctataaatggtttgcaaatttatatctattatcacatcttttaatgtgtttggggaataatttatagagaataccatcagtttatatttttaataaatcatatgtatttacaatgaaa

SEQ ID NO: 187085 - DNA, 385 bp, Homo sapiens
  Payload ID: 16835
  Gene Symbol: STAG2
  Gene Name: stromal antigen 2
  ENST ID: ENST00000394477
  CDS Start-End: 175-385
tcccctcgacaccccactaaagacagaagaaccgcggctcgatcgggtccgcggcggaagcgcggccaaacgaatgagaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatga

SEQ ID NO: 187086 - DNA, 676 bp, Homo sapiens
  Payload ID: 16835
  Gene Symbol: STAG2
  Gene Name: stromal antigen 2
  ENST ID: ENST00000394478
  CDS Start-End: 330-676
attcctggctctagcagggcctgctcgggagctgctggtgtttgttactgtcctcgcagcacttttctgccaaccttctctctctgcgtattggttaggagcaaaagcaggaggcggtctcctaattctgtctgtagcctagcgcgttgcgtttaagggtatatctgaacttattttgttaaaaaaaaggctctgggaagtggatgcatttgtttaatgacatataattcaggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttga

SEQ ID NO: 187087 - DNA, 798 bp, Homo sapiens
  Payload ID: 16835
  Gene Symbol: STAG2
  Gene Name: stromal antigen 2
  ENST ID: ENST00000435215
  CDS Start-End: 176-798
atccttgccccaggtggccaccgagtactaaattcacttgggaataaaagaaaaacataagaaaattataagagaaaggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtc

SEQ ID NO: 187088 - DNA, 2089 bp, Homo sapiens
  Payload ID: 16835
  Gene Symbol: STAG2
  Gene Name: stromal antigen 2
  ENST ID: ENST00000455404
  CDS Start-End: 446-2089
gtggccgacagatggcgcctgcgcgttccattcgcctccaagtcgccgaagagcgaacaccccaaacaatcccgaagcgccaccaaaaaaaaaaaaaaaaaaaaaaaaaaaaaaaaaaaaaaaaagaaaaaaaaccccgccggatccgaccgccactttcaaaaccccccaccgctctagaaccgcgggagcttccgtccctgagtagaattcgagggtgtaaagaagaggaaggggaaaaatatcttgtaccagcccaggggtgaagaagcccccggcctgagaaagaaggaggagtgggggaggcgaacagtctcgttgctgcctctgtgtacgctgaggggggaggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagagcttcaggaaaatcaagatgaaatagaaaatatgatgaatgcaatatttaaaggagtgtttgtacatagataccgtgatgcgatagctgaaattcgagctatttgcattgaagagattggcatttggatgaagatgtatagtgatgcctttcttaatgacagttatttaaaatatgttggttggactatgcatgataagcaaggtgaagtaagactcaaatgtcttactgctctacaagggctttattataacaaagagcttaattccaaactggaactttttaccagtcggttcaaggatagaattgtgtctatgacccttgacaaagaatatgatgttgcagtacaagcaataaaattactcactcttgttttacagagtagtgaagaagttctcactgcagaagattgtgaaaatgtctatcatctggtttattcagctcaccggccagtagcagtagcagctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgctt

SEQ ID NO: 187089 - DNA, 845 bp, Homo sapiens
  Payload ID: 16835
  Gene Symbol: STAG2
  Gene Name: stromal antigen 2
  ENST ID: ENST00000458176
  CDS Start-End: 216-392
ttcatgtgacgggcccctctgcttctcccccgccccatcatctccagcgcgtggtgggggaactgctggggaaggcgattggcatcgatctctccatcccttccgaggcccgacttcggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaacatttgtttttcaaaatgaattttggatttatattgtctcatgacatactttgaaaaagtcttaacaatacagaagtttacgatgaccaaagtgaaatttttccataatcctatcacctggagacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaag

SEQ ID NO: 187090 - DNA, 296 bp, Homo sapiens
  Payload ID: 16835
  Gene Symbol: STAG2
  Gene Name: stromal antigen 2
  ENST ID: ENST00000458700
  CDS Start-End: 177-296
gaggtaagttataaaatggcggaggcgaagcttctagaagtttggaggggcacccggagggcgcttggcccaccgtgaggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggc

SEQ ID NO: 187091 - DNA, 742 bp, Homo sapiens
  Payload ID: 16835
  Gene Symbol: STAG2
  Gene Name: stromal antigen 2
  ENST ID: ENST00000435103
  CDS Start-End: 281-742
ggcccaaaatggagaacgcggagcagcgcaagatggaggctccgcttctctgtgtagcagtagatttaggttccttttctccggcaggctcctaagcctaggagagcccgaactggaggtggccaccgagtactaaattcacttgggaataaaagaaaaacataagaaaattataagagaaaggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgag

SEQ ID NO: 187092 - DNA, 678 bp, Homo sapiens
  Payload ID: 16835
  Gene Symbol: STAG2
  Gene Name: stromal antigen 2
  ENST ID: ENST00000428941
  CDS Start-End: 172-678
agtgctgcttttcattcccacccccacccgcactgtctttctcaaggcacgaactgagctgatccttgccccaggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaag

SEQ ID NO: 187093 - DNA, 4198 bp, Homo sapiens
  Payload ID: 16836
  Gene Symbol: STAG3
  Gene Name: stromal antigen 3
  Uniprot ID: Q9UJ98
  ENST ID: ENST00000317296
  CDS Start-End: 155-3832
gcgcttttctggaatctttcgcccccggaagggcagcggcgggcgcctgtgtggaaggtggggtggccagagacacccgagggacctgagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaaggcattgtgacccctgagatgttcaagaagatgtccaactcagagatcatccagcacctaacagagcagtttaatgaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaaggggtgctgacggacgcggattgtgagagcgtctacccagttgtgtatgcctctcatcgaggcctggcctctgccgcaggcgaatttctgtactggaaactcttctaccctgagtgcgagataagaatgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacagtcgtccttcctagatgaggatgaggtatataatctggcagccactctgaaacgcctctctgccttctacaacactcatgacctgactcgctgggagctctatgagccatgttgccaactcctgcagaaggctgtggacacaggagaggttcctcaccaggttatcctgccagccttgactcttgtctatttttccattctctggacactaacccacatttctaaatcagatgcttcccagaagcagctgtcgagtttgagggacagaatggtggccttctgtgaactctgccagagttgcctctcagatgtggatactgagatccaggagcaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgattcccaggaggatcatttacagatagagcggctacaccagcggcgccgcctcctagccgggttctgcaagctgttgctttatggggtgctggagatggatgcagcctcagatgttttcaaacactacaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttactgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatcca

SEQ ID NO: 187094 - DNA, 4163 bp, Homo sapiens
  Payload ID: 16836
  Gene Symbol: STAG3
  Gene Name: stromal antigen 3
  Uniprot ID: Q9UJ98
  ENST ID: ENST00000394018
  CDS Start-End: 295-3798
agcccacgtgagagggcaggacgcctgagagcttgaggccacacgaggctgtggagcggcgtgactcaaacgtggcgcgcatcagctcgcacacttccaaacctcgcgatagctactggccctgggcgagccgttgggattgcgcttgcgcacagcgtgtcttgtacgttcccgcgcttttctggaatctttcgcccccggaagggcagcggcgggcgcctgtgtggaagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaaggggtgctgacggacgcggattgtgagagcgtctacccagttgtgtatgcctctcatcgaggcctggcctctgccgcaggcgaatttctgtactggaaactcttctaccctgagtgcgagataagaatgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacagtcgtccttcctagatgaggatgaggtatataatctggcagccactctgaaacgcctctctgccttctacaacactcatgacctgactcgctgggagctctatgagccatgttgccaactcctgcagaaggctgtggacacaggagaggttcctcaccaggttatcctgccagccttgactcttgtctatttttccattctctggacactaacccacatttctaaatcagatgcttcccagaagcagctgtcgagtttgagggacagaatggtggccttctgtgaactctgccagagttgcctctcagatgtggatactgagatccaggagcaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgattcccaggaggatcatttacagatagagcggctacaccagcggcgccgcctcctagccgggttctgcaagctgttgctttatggggtgctggagatggatgcagcctcagatgttttcaaacactacaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttactgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatcc

SEQ ID NO: 187095 - DNA, 3056 bp, Homo sapiens
  Payload ID: 16836
  Gene Symbol: STAG3
  Gene Name: stromal antigen 3
  ENST ID: ENST00000451963
  CDS Start-End: 1-519
cccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggcagtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgagattactgagagtcttccgttactaggtaagtcaccgcatccttataactccaggtgacactgactggggtttatgggatgaaagaggagtgtgtgcttggatgatggggtgtgatagtgaaggggtgaaaggtttcttctcacacatagacatcgtgaggtcttccttgagctctttagagccttccctcgggataggatgaaatactgagatcctagaaaggattcacaaaacgtgtcactcatcagcgcagattcaccgattcacccctagatgtgtgtgggatttggatggcagagagaaacaggcactgaagatttttggtcaggacagggcagagaaataagaagagttgaaaattcaccaaaggatagataaacccagggcgtttagagaaaacctgtagtgtgcaaaggagcccagaatcctggggcaacttggagggaaatatacttaatttgattcactaagttaggcccagtgaagggattgggtggcataggtagaagccgaaaaataaagtatcttgtattgctggagtagcctctgtttctgaggtcacatccaaacttagcgaggcagcttaacctggtgagagacatgggttcaactcctggcttctgcactgctagggcagaggactgctgtttgctgacacaatcttggtgcgttggaagtgaaagggaagaggcactggtggctgtgctttgggcccgagcagccagaagccagttgccatcacctatgacgaggagacagcgcctggggcagagcccagtatggggtgcgttcagggtagatcaggaggtatgagtgggtagtgggcgagccaggctgggggttgtgggggaggcctgcattgcaggtgtaagcgtgggacccacatcagattggtagtgggtcatgcatgctgggctggctctcaggtcctccctgctggcttcccactcccaggggctttctcctccgattccttagctgggtgaggggcgggacagagccctttcttagggaagcccggcaccccttgctgtccagggaaggggagtccttctagcccctgacagcttctctgcccctcccctggcctccccaggcctagccagggctgggttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacctggactggagggggccatggggcaccggaccctggtcctgccctgggtgctgctgaccttgtgtgtcactgcggggaccccggaggtgtgggttcaagttcggatggaggccaccgagctctcgtccttcaccatccgttgtgggttcctggggtctggctccatctccctggtgactgtgagctgggggggccccaacggtgctggggggaccacgctggctgtgttgcacccagaacgtggcatccggcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccaggtggggccggggcgaggggtccaggagggcagggaggggctcgggaactggccacccatctgattcttgtctccgtgcccagggctctctgccccgccgactcctgcccccattctgcgggcagacctggccgggatcttgggggtctcaggagtcctcctctttggctgtgtctacctccttcatctgctgcgccgacataagcaccgccctgcccctaggctccagccgtcccgcaccagcccccaggcaccgagagcacgagcatgggcaccaagccaggcctcccaggctgctcttcacgtcccttatgccactatcaacaccagctgccgcccagctactttggacacagctcacccccatggggggccgtcctggtgggcgtcactccccacccacgctgcacaccggccccagggccctgccgcctgggcctccacacccatccctgcacgtggcagctttgtctctgttgagaatggactctacgctcaggcaggggagaggcctcctcacactggtcccggcctcactcttttccctgaccctcgggggcccagggccatggaaggacccttaggagttcgatgagagagaccatgaggccactgggctttccccctcccaggcctcctgggtgtcacccccttactttaattcttgggcctccaataagtgtcccataggtgtctggccaggcccacctgctgcggatgtggtctctgtgtgtgcgtgtgtgggcacaggtgtgagtgtgtgagtgacagttaccccatttcagtcatttcctgctgcaactaagtcagcaacacagtttctctgatgtcg

SEQ ID NO: 187096 - DNA, 920 bp, Homo sapiens
  Payload ID: 16836
  Gene Symbol: STAG3
  Gene Name: stromal antigen 3
  ENST ID: ENST00000412190
  CDS Start-End: 1-555
ggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggcagtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatcc

SEQ ID NO: 187097 - DNA, 699 bp, Homo sapiens
  Payload ID: 16836
  Gene Symbol: STAG3
  Gene Name: stromal antigen 3
  ENST ID: ENST00000439782
  CDS Start-End: 135-699
gcccccggaagggcagcggcgggcgcctgtgtggaaggtggggtggccagagacacccgagggacctgagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctgg

SEQ ID NO: 187098 - DNA, 4450 bp, Homo sapiens
  Payload ID: 16836
  Gene Symbol: STAG3
  Gene Name: stromal antigen 3
  Uniprot ID: Q9UJ98
  ENST ID: ENST00000426455
  CDS Start-End: 408-4085
gtggcgatccggctcaaaaggcggggcctgggtggaacctagcctatggcaattgagaagccagattaaaggggttactagcagtctggtccaaaacccgcccaatggagtaggagattgagggtagcgggggtgggacctgggtgggggcggggctaaagcgggccgcccgcgtgcccaagcccacgtgagagggcaggacgcctgagagcttgaggccacacgaggctgtggagcggcgtgactcaaacgtggcgcgcatcagctcgcacacttccaaacctcgcgatagctactggccctgggcgagccgttgggattgcgcttgcgcacagcgtgtcttctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaaggcattgtgacccctgagatgttcaagaagatgtccaactcagagatcatccagcacctaacagagcagtttaatgaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaaggggtgctgacggacgcggattgtgagagcgtctacccagttgtgtatgcctctcatcgaggcctggcctctgccgcaggcgaatttctgtactggaaactcttctaccctgagtgcgagataagaatgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacagtcgtccttcctagatgaggatgaggtatataatctggcagccactctgaaacgcctctctgccttctacaacactcatgacctgactcgctgggagctctatgagccatgttgccaactcctgcagaaggctgtggacacaggagaggttcctcaccaggttatcctgccagccttgactcttgtctatttttccattctctggacactaacccacatttctaaatcagatgcttcccagaagcagctgtcgagtttgagggacagaatggtggccttctgtgaactctgccagagttgcctctcagatgtggatactgagatccaggagcaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgattcccaggaggatcatttacagatagagcggctacaccagcggcgccgcctcctagccgggttctgcaagctgttgctttatggggtgctggagatggatgcagcctcagatgttttcaaacactacaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttactgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatcc

SEQ ID NO: 187099 - DNA, 534 bp, Homo sapiens
  Payload ID: 16836
  Gene Symbol: STAG3
  Gene Name: stromal antigen 3
  ENST ID: ENST00000422690
  CDS Start-End: 199-534
atctttcgcccccggaagggcagcggcgggcgcctgtgtggaaggtggggtggccagagacacccgagggacctgaggtggggaccttccctgaaccctgctcggccagaagtcactcttccaggctctgacagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcag

SEQ ID NO: 187100 - DNA, 605 bp, Homo sapiens
  Payload ID: 16836
  Gene Symbol: STAG3
  Gene Name: stromal antigen 3
  ENST ID: ENST00000416412
  CDS Start-End: 172-605
gggcgagccgttgggattgcgcttgcgcacagcgtgtcttgtacgttcccgcgcttttctggaatctttcgcccccggaagggcagcggcgggcgcctgtgtggaagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaagg

SEQ ID NO: 187101 - DNA, 4380 bp, Homo sapiens
  Payload ID: 16836
  Gene Symbol: STAG3
  Gene Name: stromal antigen 3
  ENST ID: ENST00000615138
  CDS Start-End: 328-4008
agcccacgtgagagggcaggacgcctgagagcttgaggccacacgaggctgtggagcggcgtgactcaaacgtggcgcgcatcagctcgcacacttccaaacctcgcgatagctactggccctgggcgagccgttgggattgcgcttgcgcacagcgtgtcttgtacgttcccgcgcttttctggaatctttcgcccccggaagggcagcggcgggcgcctgtgtggaaggtggggtggccagagacacccgagggacctgagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaaggcattgtgacccctgagatgttcaagaagatgtccaactcagagatcatccagcacctaacagagcagtttaatgaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaaggggtgctgacggacgcggattgtgagagcgtctacccagttgtgtatgcctctcatcgaggcctggcctctgccgcaggcgaatttctgtactggaaactcttctaccctgagtgcgagataagaatgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacagtcgtccttcctagatgaggatgaggtatataatctggcagccactctgaaacgcctctctgccttctacaacactcatgacctgactcgctgggagctctatgagccatgttgccaactcctgcagaaggctgtggacacaggagaggttcctcaccaggttatcctgccagccttgactcttgtctatttttccattctctggacactaacccacatttctaaatcagatgcttcccagaagcagctgtcgagtttgagggacagaatggtggccttctgtgaactctgccagagttgcctctcagatgtggatactgagatccaggagcaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgattcccaggaggatcatttacagatagagcggctacaccagcggcgccgcctcctagccgggttctgcaagctgttgctttatggggtgctggagatggatgcagcctcagatgttttcaaacactacaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttactgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggcagtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatccacacgtt

SEQ ID NO: 187102 - DNA, 4203 bp, Homo sapiens
  Payload ID: 16836
  Gene Symbol: STAG3
  Gene Name: stromal antigen 3
  Uniprot ID: Q9UJ98
  ENST ID: ENST00000620100
  CDS Start-End: 328-3831
agcccacgtgagagggcaggacgcctgagagcttgaggccacacgaggctgtggagcggcgtgactcaaacgtggcgcgcatcagctcgcacacttccaaacctcgcgatagctactggccctgggcgagccgttgggattgcgcttgcgcacagcgtgtcttgtacgttcccgcgcttttctggaatctttcgcccccggaagggcagcggcgggcgcctgtgtggaaggtggggtggccagagacacccgagggacctgagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaaggggtgctgacggacgcggattgtgagagcgtctacccagttgtgtatgcctctcatcgaggcctggcctctgccgcaggcgaatttctgtactggaaactcttctaccctgagtgcgagataagaatgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacagtcgtccttcctagatgaggatgaggtatataatctggcagccactctgaaacgcctctctgccttctacaacactcatgacctgactcgctgggagctctatgagccatgttgccaactcctgcagaaggctgtggacacaggagaggttcctcaccaggttatcctgccagccttgactcttgtctatttttccattctctggacactaacccacatttctaaatcagatgcttcccagaagcagctgtcgagtttgagggacagaatggtggccttctgtgaactctgccagagttgcctctcagatgtggatactgagatccaggagcaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgattcccaggaggatcatttacagatagagcggctacaccagcggcgccgcctcctagccgggttctgcaagctgttgctttatggggtgctggagatggatgcagcctcagatgttttcaaacactacaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttactgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatccacacgtt

SEQ ID NO: 187103 - DNA, 2079 bp, Homo sapiens
  Payload ID: 16837
  Gene Symbol: SDF4
  Gene Name: stromal cell derived factor 4
  Uniprot ID: Q9BRK5
  ENST ID: ENST00000263741
  CDS Start-End: 294-1340
ggcgtcccctccgtgaggtcgcgcccgttcgcaccgcccccgcccgcaagaaagatggcagtggcctgatccgggcccgttggcggcgtcactgacgcttcgctccggtcctcggatcccgagcgcggggaggcagaccgactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtcttcctaggcaaggacctgggtggctttgatgaggacgcggagccgcggcggagccggaggaagctgatggtcatcttttccaaggtggatgtgaacactgaccggaagatcagtgccaaggagatgcagcgctggatcatggagaagacggccgagcacttccaggaggccatggaggagagcaagacacacttccgcgccgtggaccctgacggggacggtcacgtgtcttgggacgagtataaggtgaagtttttggcgagtaaaggccatagcgagaaggaggttgccgacgccatcaggctcaacgaggaactcaaagtggatgaggaaacacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctggaccaggacggtgacaagcagctctctgtgcccgagttcatctccctgcccgtgggcaccgtggagaaccagcagggccaggacattgacgacaactgggtgaaagacagaaaaaaggagtttgaggagctcattgactccaaccacgacggcatcgtgaccgccgaggagctggagaacgtgcccacactcccgctgcagccaataggcaccttaaatagccacttcgtgcggctggccgcggagctcggagggggaaaggcgacgctgacctgtgccccgctcgcccgcagagctacatggaccccatgaacgagtacaacgcgctgaacgaggccaagcagatgatcgccgtcgccgacgagaaccagaaccaccacctggagcccgaggaggtgctcaagtacagcgagttcttcacgggcagcaagctggtggactacgcgcgcagcgtgcacgaggagttttgagcgcccggccgcgccccgcgccgccccccacgcaccaccggggcggcctcgcgggtgactccgggctccgtggctgtcccggaccccacctcttccctgccgcccgccaccggccgaccgaccgcggctgccccagttgatgagcggcgtgtcccctctgcagcgcgcaccccggcggggctttggctgtgacgcggtcggggcgcggggctgggctgtggccccgcggcgccgcctcctccctggtccctcgaaatcgtggcatctcacttctgagaacgaaatctcgcttcagtcactctgccgaaggcgctgacggcatcgcggccggaacctctgggcccggcccctcccagggccgccgctccgtgggaaaaaacagctcctccatttccttgaaaactgaacgattattaaaaatagattaaacttcgctggaaatgagtagccaggaagttcaggggagggtgccgggtccttcccgggcctggcgtgtcggagccacccaggtcccgcagctgccgctgagaaaatgcaaatatttgttgtgacaagaatcacatacatttactttaaatata

SEQ ID NO: 187104 - DNA, 1956 bp, Homo sapiens
  Payload ID: 16837
  Gene Symbol: SDF4
  Gene Name: stromal cell derived factor 4
  Uniprot ID: Q9BRK5
  ENST ID: ENST00000360001
  CDS Start-End: 264-1352
gcaccgcccccgcccgcaagaaagatggcagtggcctgatccgggcccgttggcggcgtcactgacgcttcgctccggtcctcggatcccgagcgcggggaggcagaccgactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtcttcctaggcaaggacctgggtggctttgatgaggacgcggagccgcggcggagccggaggaagctgatggtcatcttttccaaggtggatgtgaacactgaccggaagatcagtgccaaggagatgcagcgctggatcatggagaagacggccgagcacttccaggaggccatggaggagagcaagacacacttccgcgccgtggaccctgacggggacggtcacgtgtcttgggacgagtataaggtgaagtttttggcgagtaaaggccatagcgagaaggaggttgccgacgccatcaggctcaacgaggaactcaaagtggatgaggaaacacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctggaccaggacggtgacaagcagctctctgtgcccgagttcatctccctgcccgtgggcaccgtggagaaccagcagggccaggacattgacgacaactgggtgaaagacagaaaaaaggagtttgaggagctcattgactccaaccacgacggcatcgtgaccgccgaggagctggagagctacatggaccccatgaacgagtacaacgcgctgaacgaggccaagcagatgatcgccgtcgccgacgagaaccagaaccaccacctggagcccgaggaggtgctcaagtacagcgagttcttcacgggcagcaagctggtggactacgcgcgcagcgtgcacgaggagttttgagcgcccggccgcgccccgcgccgccccccacgcaccaccggggcggcctcgcgggtgactccgggctccgtggctgtcccggaccccacctcttccctgccgcccgccaccggccgaccgaccgcggctgccccagttgatgagcggcgtgtcccctctgcagcgcgcaccccggcggggctttggctgtgacgcggtcggggcgcggggctgggctgtggccccgcggcgccgcctcctccctggtccctcgaaatcgtggcatctcacttctgagaacgaaatctcgcttcagtcactctgccgaaggcgctgacggcatcgcggccggaacctctgggcccggcccctcccagggccgccgctccgtgggaaaaaacagctcctccatttccttgaaaactgaacgattattaaaaatagattaaacttcgctggaaatgagtagccaggaagttcaggggagggtgccgggtccttcccgggcctggcgtgtcggagccacccaggtcccgcagctgccgctgagaaaatgcaaatatttgttgtgacaagaatcacatacatttactttaaatatagttgccttttttggtcagcttca

SEQ ID NO: 187105 - DNA, 728 bp, Homo sapiens
  Payload ID: 16837
  Gene Symbol: SDF4
  Gene Name: stromal cell derived factor 4
  ENST ID: ENST00000403997
  CDS Start-End: 1-728
gctggagatggacgggcacctcaatcgcggcttccaccaggaggtcttcctaggcaaggacctgggtggctttgatgaggacgcggagccgcggcggagccggaggaagctgatggtcatcttttccaaggtggatgtgaacactgaccggaagatcagtgccaaggagatgcagcgctggatcatggagaagacggccgagcacttccaggaggccatggaggagagcaagacacacttccgcgccgtggaccctgacggggacggtcacgtgtcttgggacgagtataaggtgaagtttttggcgagtaaaggccatagcgagaaggaggttgccgacgccatcaggctcaacgaggaactcaaagtggatgaggaaagcagcacctctcggaactttctggatttgcgtgctggcgtctgtcggcctcgatacccacaggctgcgcccctctcagcacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctggaccaggacggtgacaagcagctctctgtgcccgagttcatctccctgcccgtgggcaccgtggagaaccagcagggccaggacattgacgacaactgggtgaaagacagaa

SEQ ID NO: 187106 - DNA, 2095 bp, Homo sapiens
  Payload ID: 16837
  Gene Symbol: SDF4
  Gene Name: stromal cell derived factor 4
  ENST ID: ENST00000465727
  CDS Start-End: 294-1058
ggcgtcccctccgtgaggtcgcgcccgttcgcaccgcccccgcccgcaagaaagatggcagtggcctgatccgggcccgttggcggcgtcactgacgcttcgctccggtcctcggatcccgagcgcggggaggcagaccgactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtcttcctaggcaaggacctgggtggctttgatgaggacgcggagccgcggcggagccggaggaagctgatggtcatcttttccaaggtggatgtgaacactgaccggaagatcagtgccaaggagatgcagcgctggatcatggagaagacggccgagcacttccaggaggccatggaggagagcaagacacacttccgcgccgtggaccctgacggggacggtcacgtgtcttgggacgagtataaggtgaagtttttggcgagtaaaggccatagcgagaaggaggttgccgacgccatcaggctcaacgaggaactcaaagtggatgaggaaagctgcgcccctctcagcacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctggaccaggacggtgacaagcagctctctgtgcccgagttcatctccctgcccgtgggcaccgtggagaaccagcagggccaggacattgacgacaactgggtgaaagacagaaaaaaggagtttgaggagctcattgactccaaccacgacggcatcgtgaccgccgaggagctggagaacgtgcccacactcccgctgcagccaataggcaccttaaatagccacttcgtgcggctggccgcggagctcggagggggaaaggcgacgctgacctgtgccccgctcgcccgcagagctacatggaccccatgaacgagtacaacgcgctgaacgaggccaagcagatgatcgccgtcgccgacgagaaccagaaccaccacctggagcccgaggaggtgctcaagtacagcgagttcttcacgggcagcaagctggtggactacgcgcgcagcgtgcacgaggagttttgagcgcccggccgcgccccgcgccgccccccacgcaccaccggggcggcctcgcgggtgactccgggctccgtggctgtcccggaccccacctcttccctgccgcccgccaccggccgaccgaccgcggctgccccagttgatgagcggcgtgtcccctctgcagcgcgcaccccggcggggctttggctgtgacgcggtcggggcgcggggctgggctgtggccccgcggcgccgcctcctccctggtccctcgaaatcgtggcatctcacttctgagaacgaaatctcgcttcagtcactctgccgaaggcgctgacggcatcgcggccggaacctctgggcccggcccctcccagggccgccgctccgtgggaaaaaacagctcctccatttccttgaaaactgaacgattattaaaaatagattaaacttcgctggaaatgagtagccaggaagttcaggggagggtgccgggtccttcccgggcctggcgtgtcggagccacccaggtcccgcagctgccgctgagaaaatgcaaatatttgttgtgacaagaatcacatacatttactttaaatata

SEQ ID NO: 187107 - DNA, 1568 bp, Homo sapiens
  Payload ID: 16838
  Gene Symbol: SDF2
  Gene Name: stromal cell-derived factor 2
  Uniprot ID: Q99470
  ENST ID: ENST00000247020
  CDS Start-End: 300-935
cgggagtgggcgggccatttcttgttctctctcccgctctcggaagctttcgtctcgtgggtgcgaaaggtaaccgaagcggctcaggaaggcagctgtcactgagcccctggaacagagcgagagtatcgtaagtaaccaggctcagccggtttctcaggccgctctagtcaaataaaccataaagatcagactcgggcttcttcacttccttctctccgtggtttcgccattagcttccggttccggggaggggccgagttttcttcgaagatttggggctccgcgatacagttaggatggctgtagtacctctgctgttgttggggggtttgtggagcgctgtgggagcgtccagcctgggtgtcgttacttgcggctccgtggtgaagctactcaatacgcgccacaacgtccgactgcactcacacgacgtgcgctatgggtcaggtagtgggcagcagtcagtgacaggtgtaacctctgtggatgacagcaacagttactggaggatacgggggaagagtgccacagtgtgtgagaggggaacccccatcaagtgtggccagcccatccggctgacacatgtcaacactggccgaaacctccatagtcaccacttcacttcacctctttctggaaaccaggaagtgagtgcttttggtgaggaaggtgaaggtgattatctggatgactggacagtgctctgtaatggaccctactgggtgagagatggtgaggtgcggttcaaacactcttccactgaggtactgctgtctgtcacaggagaacaatatggtcgacctatcagtgggcaaaaagaggtgcatggcatggcccagccaagtcagaacaactactggaaagccatggaaggcatcttcatgaagcccagtgagttgttgaaggcagaagcccaccatgcagagctgtgaatctagaggctctgagccactgttaacgcacaatgttcacagacatctgttgctgcctcaccttgggatccctgccacaagttccttgggcagtggccatgtcaccattgagatgaagatatacaacagaaaatagtggctgtgtttggaagcttcagccctgcacatttgaactagtcactctcccagacttgcgtgggtcagttctttctgagtagaggacttgctggtaaaggggcagatgctttttattagtactgataaaacaaactgagggaaacatccctcttagctgggaaacttttactcttcaggagcttggcatcatggactgttaatgtatgtgattttccccctattttctctctccaaaatgataaaaacaataattttattatgagtcactgtgttgttatttattaggtgtgctatttcattagctgcttaatcctttgagtcctaagactctttggagacgctatgaagctccaatgtgggcccttttaagagcttttcttgcatacaaaccttttctccctctactttgacttctctccaggcatctcatctttaatagatctttgactaattatagctaaaaactctcagagaatacagcataataaatagcca

SEQ ID NO: 187108 - DNA, 444 bp, Homo sapiens
  Payload ID: 16838
  Gene Symbol: SDF2
  Gene Name: stromal cell-derived factor 2
  ENST ID: ENST00000587788
  CDS Start-End: 1-151
ccgaaacctccatagtcaccacttcacttcacctctttctggaaaccaggagaacaatatggtcgacctatcagtgggcaaaaagaggtgcatggcatggcccagccaagtcagaacaactactggaaagccatggaaggcatcttcatgaagcccagtgagttgttgaaggcagaagcccaccatgcagagctgtgaatctagaggctctgagccactgttaacgcacaatgttcacagacatctgttgctgcctcaccttgggatccctgccacaagttccttgggcagtggccatgtcaccattgagatgaagatatacaacagaaaatagtggctgtgtttggaagcttcagccctgcacatttgaactagtcactctcccagacttgcgtgggtcagttctttctgagtagaggacttgctggtaaaggggcagatgct

SEQ ID NO: 187109 - DNA, 735 bp, Homo sapiens
  Payload ID: 16838
  Gene Symbol: SDF2
  Gene Name: stromal cell-derived factor 2
  ENST ID: ENST00000591903
  CDS Start-End: 1-315
agcctgggtgtcgttacttgcggctccgtggtgaagctactcaatacgcgccacaacgtccgactgcactcacacgacgtgcgctatgggtcaggtagtgggcagcagtcagtgacaggtgtaacctctgtggatgacagcaacagttactggaggatacgggggaagagtgccacagtgtgtgagaggggaacccccatcaagtgtggccagcccatccggctgacacatgtcaacactggccgaaacctccatagtcaccacttcacttcacctctttctggaaaccagttgctctgtaaggtgatattgtgatcattttatagaggagaaaacaaaggctcaaaggatttacagaagaagggatcaagttgagattcaaggaagtgagtgcttttggtgaggaaggtgaaggtgattatctggatgactggacagtgctctgtaatggaccctactgggtgagagatggtgaggtgcggttcaaacactcttccactgaggtactgctgtctgtcacaggagaacaatatggtcgacctatcagtgggcaaaaagaggtgcatggcatggcccagccaagtcagaacaactactggaaagccatggaaggcatcttcatgaagcccagtgagttgttgaaggcagaagcccaccatgcagagctgtgaatctagaggctctgagccactgttaacgcacaatgttcacagacatctgttgctgcctcacctt

SEQ ID NO: 187110 - DNA, 865 bp, Homo sapiens
  Payload ID: 16839
  Gene Symbol: SDF2L1
  Gene Name: stromal cell-derived factor 2-like 1
  Uniprot ID: Q9HCN8
  ENST ID: ENST00000248958
  CDS Start-End: 77-742
ctgtcagaaccggattgggccgcggcggggacggaagcggcccctgggcccgaggggctggagccgggccggggcgatgtggagcgcgggccgcggcggggctgcctggccggtgctgttggggctgctgctggcgctgttagtgccgggcggtggtgccgccaagaccggtgcggagctcgtgacctgcgggtcggtgctgaagctgctcaatacgcaccaccgcgtgcggctgcactcgcacgacatcaaatacggatccggcagcggccagcaatcggtgaccggcgtagaggcgtcggacgacgccaatagctactggcggatccgcggcggctcggagggcgggtgcccgcgcgggtccccggtgcgctgcgggcaggcggtgaggctcacgcatgtgcttacgggcaagaacctgcacacgcaccacttcccgtcgccgctgtccaacaaccaggaggtgagtgcctttggggaagacggcgagggcgacgacctggacctatggacagtgcgctgctctggacagcactgggagcgtgaggctgctgtgcgcttccagcatgtgggcacctctgtgttcctgtcagtcacgggtgagcagtatggaagccccatccgtgggcagcatgaggtccacggcatgcccagtgccaacacgcacaatacgtggaaggccatggaaggcatcttcatcaagcctagtgtggagccctctgcaggtcacgatgaactctgagtgtgtggatggatgggtggatggagggtggcaggtggggcgtctgcagggccactcttggcagagactttgggtttgtaggggtcctcaagtgcctttgtgattaaagaatgttggtctatg

SEQ ID NO: 187111 - DNA, 4038 bp, Homo sapiens
  Payload ID: 16840
  Gene Symbol: STIM1
  Gene Name: stromal interaction molecule 1
  Uniprot ID: Q13586
  ENST ID: ENST00000300737
  CDS Start-End: 570-2627
gctggacctgggcaccgccagccgcctgggcacgggactgggcgggggcgctgacctcggcctaggaggcccaggatcccggagacgcccgcgccctcaggaccctgcgggtcgcacgccctccccagcttctgctgctcgccgctcttcggcagggcgaggtcaggtgcccccttctcgcctctcttctcttctcttctcttcctcctccacttctgtgcccgcggagactccggccgcccccttccgcaggggtgtagtaatctgcggagctgacagcagccccgcagccaccctgcccgaagtctccggaagcggcacgagctcaggccgccgcagccccggcggacccactgttggacctgaggagccagccctcctcccgcacccaaacttggagcacttgacctttggctgttggagggggcaggctcgcgggtggctggacagctgcggagccgcgagggcatcttgcctggagaccgtcggctgcactcccgggctcctggctttgcctctgggatcccgaggtgtccacatcagacgcatgttgactgagacctagagtcatggatgtatgcgtccgtcttgccctgtggctcctctggggactcctcctgcaccagggccagagcctcagccatagtcacagtgagaaggcgacaggaaccagctcgggggccaactctgaggagtccactgcagcagagttttgccgaattgacaagcccctgtgtcacagtgaggatgagaaactcagcttcgaggcagtccgtaacatccacaaactgatggacgatgatgccaatggtgatgtggatgtggaagaaagtgatgagttcctgagggaagacctcaattaccatgacccaacagtgaaacacagcaccttccatggtgaggataagctcatcagcgtggaggacctgtggaaggcatggaagtcatcagaagtatacaattggaccgtggatgaggtggtacagtggctgatcacatatgtggagctgcctcagtatgaggagaccttccggaagctgcagctcagtggccatgccatgccaaggctggctgtcaccaacaccaccatgacagggactgtgctgaagatgacagaccggagtcatcggcagaagctgcagctgaaggctctggatacagtgctctttgggcctcctctcttgactcgccataatcacctcaaggacttcatgctggtggtgtctatcgttattggtgtgggcggctgctggtttgcctatatccagaaccgttactccaaggagcacatgaagaagatgatgaaggacttggaggggttacaccgagctgagcagagtctgcatgaccttcaggaaaggctgcacaaggcccaggaggagcaccgcacagtggaggtggagaaggtccatctggaaaagaagctgcgcgatgagatcaaccttgctaagcaggaagcccagcggctgaaggagctgcgggagggtactgagaatgagcggagccgccaaaaatatgctgaggaggagttggagcaggttcgggaggccttgaggaaagcagagaaggagctagaatctcacagctcatggtatgctccagaggcccttcagaagtggctgcagctgacacatgaggtggaggtgcaatattacaacatcaagaagcaaaatgctgagaagcagctgctggtggccaaggagggggctgagaagataaaaaagaagagaaacacactctttggcaccttccacgtggcccacagctcttccctggatgatgtagatcataaaattctaacagctaagcaagcactgagcgaggtgacagcagcattgcgggagcgcctgcaccgctggcaacagatcgagatcctctgtggcttccagattgtcaacaaccctggcatccactcactggtggctgccctcaacatagaccccagctggatgggcagtacacgccccaaccctgctcacttcatcatgactgacgacgtggatgacatggatgaggagattgtgtctcccttgtccatgcagtcccctagcctgcagagcagtgttcggcagcgcctgacggagccacagcatggcctgggatctcagagggatttgacccattccgattcggagtcctccctccacatgagtgaccgccagcgtgtggcccccaaacctcctcagatgagccgtgctgcagacgaggctctcaatgccatgacttccaatggcagccaccggctgatcgagggggtccacccagggtctctggtggagaaactgcctgacagccctgccctggccaagaaggcattactggcgctgaaccatgggctggacaaggcccacagcctgatggagctgagcccctcagccccacctggtggctctccacatttggattcttcccgttctcacagccccagctccccagacccagacacaccatctccagttggggacagccgagccctgcaagccagccgaaacacacgcattccccacctggctggcaagaaggctgtggctgaggaggataatggctctattggcgaggaaacagactccagcccaggccggaagaagtttcccctcaaaatctttaagaagcctcttaagaagtaggcaggatggggtggcagtaaagggacagcttgtccttccctgggtgttctgtctctccttccctcccttccttcaagataactggccccaagagtggggcatgggaagggctggtccaggggtctgggcactgtacatacctgccccctcatccttgggtccttcattattatttattaactgaccaccatggcctgcctgccctgcctccgtcccaaccatgggctgctgctgtcactccctctccacttcagtgcatgtcttagttgctgttccctcagctcccagctccacctctggggttcagcttctgtctctgctgtcccagttttgaggtttggtttcttgtttctgtctcttgctttcgggctcctccctcccaccactccccaacttcccctagcagttgcagggaagataggacgagtagcttctgacatgtgtgcctcagatctgttccaccccactcacagtggttctgtttgctccagactggggctagggcctaatctttgaagtttgttctttggtattgatgtgggtcagaaggagcctcatcctaatctcactcaggcctccagggatccatgggggagtgaaaccaattctcagagaacaacccaccagagacttttaaagagaggccaggcttgggaatgggttgggagaggcatctgttcattggagcatgagtggatgccagaactgtaggttataaggcagtcactttttctctctactcccacccacacctgcctccctcttacccctgctcccccacactgcaggaggatttgtctctaagaggtgctgccccaaagctccccaagcatcaatactcctagggctcaggacaagtggctcccctggccaggagagccacagccatgatacagggctcttatggagccctggagttgttgggcaaggatgctgtcattttttgaaccaaaagacaaacaggttaaaaggaaaaaaagtaatctgaatttcccaagtgcctacgctgcatattccccttgttagatcccattttcatgttactttgtagccttggccagaggctcaaaaaggacacaaccagtttggggaaggggtggctaaggaagatggtataggtgaaggcggctgtgtgaccactttcccccacccttcccaccctctagacaactctctcccttacctgtttttgctatggctgtaaaggtatttttcctctgccccactccctgccatacctttatcctgggatcctattttgggcctggggtgggtatacctggggctggtcttaggagggtgctaggctgcagactgccttgtactccctggacaccctcaaatggggttttctgtgttatttcataaaattctttgaagtccaataaagcatgtaggagattttaaccac

SEQ ID NO: 187112 - DNA, 583 bp, Homo sapiens
  Payload ID: 16840
  Gene Symbol: STIM1
  Gene Name: stromal interaction molecule 1
  ENST ID: ENST00000525055
  CDS Start-End: 336-583
acttcctgagatggctctgtcagttggcagtcctacctgtcagctcagcccattttagaaatcattttccaaagaattttaaccttaaggaagctctcctctttctattgaacaggctgtaccaggcataggggccccaggaaccagagacacagcaggctacctttgcatttcctatattggacaaaataagaggaagaaaggaagccaaacagctctcccaggctcagttggcagcagagaggagttgagagttttgccgaattgacaagcccctgtgtcacagtgaggatgagaaactcagcttcgaggcagtccgtaacatccacaaactgatggacgatgatgccaatggtgatgtggatgtggaagaaagtgatgagttcctgagggaagacctcaattaccatgacccaacagtgaaacacagcaccttccatggtgaggataagctcatcagcgtggaggacctgtggaaggcatggaagtcatcagaagtatacaattggaccgtggatgaggtggtacagtggctgatcacatatgtggagctgcctcagtatgaggagaccttccggaagct

SEQ ID NO: 187113 - DNA, 552 bp, Homo sapiens
  Payload ID: 16840
  Gene Symbol: STIM1
  Gene Name: stromal interaction molecule 1
  ENST ID: ENST00000530554
  CDS Start-End: 311-552
ttctgaaatacagcagccaggggagatgggtggccttcaggtgtaacacacacacacaggttagaaagcagtgtgtgtctgtgtgtgtatttgttgctgggtggtcgaatttgtggaggtcttgtttcaagaaacttttgctgacaagagcaaaggtcactggaactcacacttcatatctctgaagagataaatatgtaattaagacaactgaaataacttcgatgagttttgccgaattgacaagcccctgtgtcacagtgaggatgagaaactcagcttcgaggcagtccgtaacatccacaaactgatggacgatgatgccaatggtgatgtggatgtggaagaaagtgatgagttcctgagggaagacctcaattaccatgacccaacagtgaaacacagcaccttccatggtgaggataagctcatcagcgtggaggacctgtggaaggcatggaagtcatcagaagtatacaattggaccgtggatgaggtggtacagtggctgatcacatatgtggagctgcctcagtatgaggagaccttccg

SEQ ID NO: 187114 - DNA, 625 bp, Homo sapiens
  Payload ID: 16840
  Gene Symbol: STIM1
  Gene Name: stromal interaction molecule 1
  ENST ID: ENST00000525403
  CDS Start-End: 294-625
aagatctgctgacagcacgcttgagaagagaacaggaagtgcaggctttgttgaaggaggctcaggcgtggctctgtcttctttggcgcactcattctcaagtcgctgacacctcctccaccagagaggtagctgggagaatgagatgcagggaggaagcatttacaggccccaccgaaaaaccttaaagggctgagagcttgagggcagagttttgccgaattgacaagcccctgtgtcacagtgaggatgagaaactcagcttcgaggcagtccgtaacatccacaaactgatggacgatgatgccaatggtgatgtggatgtggaagaaagtgatgagttcctgagggaagacctcaattaccatgacccaacagtgaaacacagcaccttccatggtgaggataagctcatcagcgtggaggacctgtggaaggcatggaagtcatcagaagtatacaattggaccgtggatgaggtggtacagtggctgatcacatatgtggagctgcctcagtatgaggagaccttccggaagctgcagctcagtggccatgccatgccaaggctggctgtcaccaacaccaccatgacagggactgtgctgaagatgacagaccggag

SEQ ID NO: 187115 - DNA, 581 bp, Homo sapiens
  Payload ID: 16840
  Gene Symbol: STIM1
  Gene Name: stromal interaction molecule 1
  ENST ID: ENST00000528656
  CDS Start-End: 231-581
acttcctgagatggctctgtcagttggcagtcctacctgtcagctcagcccattttagaaatcattttccaaagaattttaaccttaaggaagctctcctctttctattgaacaggctgtaccaggcataggggccccaggaaccagagttttgccgaattgacaagcccctgtgtcacagtgaggatgagaaactcagcttcgaggcagtccgtaacatccacaaactgatggacgatgatgccaatggtgatgtggatgtggaagaaagtgatgagttcctgagggaagacctcaattaccatgacccaacagtgaaacacagcaccttccatggtgaggataagctcatcagcgtggaggacctgtggaaggcatggaagtcatcagaagtatacaattggaccgtggatgaggtggtacagtggctgatcacatatgtggagctgcctcagtatgaggagaccttccggaagctgcagctcagtggccatgccatgccaaggctggctgtcaccaacaccaccatgacagggactgtgctgaagatgacagaccggagtcatcggcagaagctgcag

SEQ ID NO: 187116 - DNA, 668 bp, Homo sapiens
  Payload ID: 16840
  Gene Symbol: STIM1
  Gene Name: stromal interaction molecule 1
  ENST ID: ENST00000532990
  CDS Start-End: 466-668
caatttgagtgtcagaagacagagtttcagtctctgctcagctgtatgaccttatggaagtgacctcccttctcagggttcaatttcctcctctctggagccagaaagttttaacgagggaggctttctggctctgatgttgaatatatgtctcttgtttattactgctgacgggggccctctgtttcacctgttttttccacatactccatcctacaagagacacagcaggctacctttgcatttcctatattggacaaaataagaggaagaaaggaagccaaacagctctcccaggctcagttggcagcagagaggagttgaggtgagaagctggtgtcaccgaattgcccagtaaatcagctgtgtggttggtaaccagagttttgccgaattgacaagcccctgtgtcacagtgaggatgagaaactcagcttcgaggcagtccgtaacatccacaaactgatggacgatgatgccaatggtgatgtggatgtggaagaaagtgatgagttcctgagggaagacctcaattaccatgacccaacagtgaaacacagcaccttccatggtgaggataagctcatcagcgtggaggacctgtggaaggcatggaagtcatcagaagtatacaattggaccgtggatgaggtggtacagtggctgat

SEQ ID NO: 187117 - DNA, 1214 bp, Homo sapiens
  Payload ID: 16840
  Gene Symbol: STIM1
  Gene Name: stromal interaction molecule 1
  ENST ID: ENST00000526596
  CDS Start-End: 1-1214
aggagcaccgcacagtggaggtggagaaggtccatctggaaaagaagctgcgcgatgagatcaaccttgctaagcaggaagcccagcggctgaaggagctgcgggagggtactgagaatgagcggagccgccaaaaatatgctgaggaggagttggagcaggttcgggaggccttgaggaaagcagagaaggagctagaatctcacagctcatggtatgctccagaggcccttcagaagtggctgcagctgacacatgaggtggaggtgcaatattacaacatcaagaagcaaaatgctgagaagcagctgctggtggccaaggagggggctgagaagataaaaaagaagagaaacacactctttggcaccttccacgtggcccacagctcttccctggatgatgtagatcataaaattctaacagctaagcaagcactgagcgaggtgacagcagcattgcgggagcgcctgcaccgctggcaacagatcgagatcctctgtggcttccagattgtcaacaaccctggcatccactcactggtggctgccctcaacatagaccccagctggatgggcagtacacgccccaaccctgctcacttcatcatgactgacgacgtggatgacatggatgaggagattgtgtctcccttgtccatgcagtatgctgcctggctgatggggcgtaggttcagtgaccgctctctctgctctacatccgccggctcggatgatcagtccctctggaaataccccgcccctagcctgcagagcagtgttcggcagcgcctgacggagccacagcatggcctgggatctcagagggatttgacccattccgattcggagtcctccctccacatgagtgaccgccagcgtgtggcccccaaacctcctcagatgagccgtgctgcagacgaggctctcaatgccatgacttccaatggcagccaccggctgatcgagggggtccacccagggtctctggtggagaaactgcctgacagccctgccctggccaagaaggcattactggcgctgaaccatgggctggacaaggcccacagcctgatggagctgagcccctcagccccacctggtggctctccacatttggattcttcccgttctcacagccccagctccccagacccagacacaccatctccagttggggacagccgagccctgcaagccagccgaaacacacgc

SEQ ID NO: 187118 - DNA, 580 bp, Homo sapiens
  Payload ID: 16840
  Gene Symbol: STIM1
  Gene Name: stromal interaction molecule 1
  ENST ID: ENST00000532919
  CDS Start-End: 163-580
agcaatgactaccctgagcaggtggctgcagtaggagtggagaactgtgcttgaagaggacatgaaacctgtaggcaagagttttgccgaattgacaagcccctgtgtcacagtgaggatgagaaactcagcttcgaggcagtccgtaacatccacaaactgatggacgatgatgccaatggtgatgtggatgtggaagaaagtgatgagttcctgagggaagacctcaattaccatgacccaacagtgaaacacagcaccttccatggtgaggataagctcatcagcgtggaggacctgtggaaggcatggaagtcatcagaagtatacaattggaccgtggatgaggtggtacagtggctgatcacatatgtggagctgcctcagtatgaggagaccttccggaagctgcagctcagtggccatgccatgccaaggctggctgtcaccaacaccaccatgacagggactgtgctgaagatgacagaccggagtcatcggcagaagctgcagctgaaggctctggatacagtgctctttgggcctcctctcttgactcgccataatcacctcaaggact

SEQ ID NO: 187119 - DNA, 415 bp, Homo sapiens
  Payload ID: 16840
  Gene Symbol: STIM1
  Gene Name: stromal interaction molecule 1
  ENST ID: ENST00000524822
  CDS Start-End: 253-415
tttctgtttttgaaagatgaagcctgggaggtgccagagctatgccagctgctatggggccagaaacagtcccatcaatatattgtgaggacactcaagaagcatatggaaaaggccatgtggagaactagtgtttcctgacaacaatcagcatggacttgctgggaatagttttgccgaattgacaagcccctgtgtcacagtgaggatgagaaactcagcttcgaggcagtccgtaacatccacaaactgatggacgatgatgccaatggtgatgtggatgtggaagaaagtgatgagttcctgagggaagacctcaattaccatgacccaacagtgaaacacagcaccttccatggtgaggataagctcatcagcgtggaggacctgtggaaggcatggaagtcatcagaag

SEQ ID NO: 187120 - DNA, 2080 bp, Homo sapiens
  Payload ID: 16840
  Gene Symbol: STIM1
  Gene Name: stromal interaction molecule 1
  ENST ID: ENST00000533977
  CDS Start-End: 214-1752
aattccatttttgtcatcagtggttaattaaaattttttttccttttctatatttcatttcaatagcacattagcaggtttatatataatgacagtgagtttagattaggataattcataaatcccagaatcactgggtcatatgacatgacagtttgacctgggctgcacaggaaatgcatttataaatggctggctgtcaccaacaccaccatgacagggactgtgctgaagatgacagaccggagtcatcggcagaagctgcagctgaaggctctggatacagtgctctttgggcctcctctcttgactcgccataatcacctcaaggacttcatgctggtggtgtctatcgttattggtgtgggcggctgctggtttgcctatatccagaaccgttactccaaggagcacatgaagaagatgatgaaggacttggaggggttacaccgagctgagcagagtctgcatgaccttcaggaaaggctgcacaaggcccaggaggagcaccgcacagtggaggtggagaaggtccatctggaaaagaagctgcgcgatgagatcaaccttgctaagcaggaagcccagcggctgaaggagctgcgggagggtactgagaatgagcggagccgccaaaaatatgctgaggaggagttggagcaggttcgggaggccttgaggaaagcagagaaggagctagaatctcacagctcatggtatgctccagaggcccttcagaagtggctgcagctgacacatgaggtggaggtgcaatattacaacatcaagaagcaaaatgctgagaagcagctgctggtggccaaggagggggctgagaagataaaaaagaagagaaacacactctttggcaccttccacgtggcccacagctcttccctggatgatgtagatcataaaattctaacagctaagcaagcactgagcgaggtgacagcagcattgcgggagcgcctgcaccgctggcaacagatcgagatcctctgtggcttccagattgtcaacaaccctggcatccactcactggtggctgccctcaacatagaccccagctggatgggcagtacacgccccaaccctgctcacttcatcatgactgacgacgtggatgacatggatgaggagattgtgtctcccttgtccatgcagtcccctagcctgcagagcagtgttcggcagcgcctgacggagccacagcatggcctgggatctcagagggatttgacccattccgattcggagtcctccctccacatgagtgaccgccagcgtgtggcccccaaacctcctcagatgagccgtgctgcagacgaggctctcaatgccatgacttccaatggcagccaccggctgatcgagggggtccacccagggtctctggtggagaaactgcctgacagccctgccctggccaagaaggcattactggcgctgaaccatgggctggacaaggcccacagcctgatggagctgagcccctcagccccacctggtggctctccacatttggattcttcccgttctcacagccccagctccccagacccagacacaccatctccagttggggacagccgagccctgcaagccagccgaaacacacgcattccccacctggctggcaagaaggctgtggctgaggaggataatggctctattggcgaggaaacagactccagcccaggccggaagaagtttcccctcaaaatctttaagaagcctcttaagaagtaggcaggatggggtggcagtaaagggacagcttgtccttccctgggtgttctgtctctccttccctcccttccttcaagataactggccccaagagtggggcatgggaagggctggtccaggggtctgggcactgtacatacctgccccctcatccttgggtccttcattattatttattaactgaccaccatggcctgcctgccctgcctccgtcccaaccatgggctgctgctgtcactccctctccacttcagtgcatgtcttagttgctgttccctcagctcccagctccacctctggggttcagcttctgtctctgctgtcccag

SEQ ID NO: 187121 - DNA, 524 bp, Homo sapiens
  Payload ID: 16840
  Gene Symbol: STIM1
  Gene Name: stromal interaction molecule 1
  ENST ID: ENST00000532610
  CDS Start-End: 127-524
ctgttagatgagcatgccctgggattgggatagaattcacatgagttttgccgaattgacaagcccctgtgtcacagtgaggatgagaaactcagcttcgaggcagtccgtaacatccacaaactgatggacgatgatgccaatggtgatgtggatgtggaagaaagtgatgagttcctgagggaagacctcaattaccatgacccaacagtgaaacacagcaccttccatggtgaggataagctcatcagcgtggaggacctgtggaaggcatggaagtcatcagaagtatacaattggaccgtggatgaggtggtacagtggctgatcacatatgtggagctgcctcagtatgaggagaccttccggaagctgcagctcagtggccatgccatgccaaggctggctgtcaccaacaccaccatgacagggactgtgctgaagatgacagaccggagtcatcggcagaagctgcagctgaaggctctggatacagtgctctttgggcctcctctctgtgagtc

SEQ ID NO: 187122 - DNA, 2184 bp, Homo sapiens
  Payload ID: 16840
  Gene Symbol: STIM1
  Gene Name: stromal interaction molecule 1
  Uniprot ID: Q13586
  ENST ID: ENST00000527651
  CDS Start-End: 90-1712
gaccgtcggctgcactcccgggctcctggctttgcctctgggatcccgaggtgtccacatcagacgcatgttgactgagacctagagtcatggatgtatgcgtccgtcttgccctgtggctcctctggggactcctcctgcaccagggccagagcctcagccatagtcacagtgagaaggcgacaggaaccagctcgggggccaactctgaggagtccactgcagcagagttttgccgaattgacaagcccctgtgtcacagtgaggatgagaaactcagcttcgaggcagtccgtaacatccacaaactgatggacgatgatgccaatggtgatgtggatgtggaagaaagtgatgagttcctgagggaagacctcaattaccatgacccaacagtgaaacacagcaccttccatggtgaggataagctcatcagcgtggaggacctgtggaaggcatggaagtcatcagaagtatacaattggaccgtggatgaggtggtacagtggctgatcacatatgtggagctgcctcagtatgaggagaccttccggaagctgcagctcagtggccatgccatgccaaggctggctgtcaccaacaccaccatgacagggactgtgctgaagatgacagaccggagtcatcggcagaagctgcagctgaaggctctggatacagtgctctttgggcctcctctcttgactcgccataatcacctcaaggacttcatgctggtggtgtctatcgttattggtgtgggcggctgctggtttgcctatatccagaaccgttactccaaggagcacatgaagaagatgatgaaggacttggaggggttacaccgagctgagcagagtctgcatgaccttcaggaaaggctgcacaaggcccaggaggagcaccgcacagtggaggtggagaaggtccatctggaaaagaagctgcgcgatgagatcaaccttgctaagcaggaagcccagcggctgaaggagctgcgggagggtactgagaatgagcggagccgccaaaaatatgctgaggaggagttggagcaggttcgggaggccttgaggaaagcagagaaggagctagaatctcacagctcatggtatgctccagaggcccttcagaagtggctgcagctgacacatgaggtggaggtgcaatattacaacatcaagaagcaaaatgctgagaagcagctgctggtggccaaggagggggctgagaagataaaaaagaagagaaacacactctttggcaccttccacgtggcccacagctcttccctggatgatgtagatcataaaattctaacagctaagcaagcactgagcgaggtgacagcagcattgcgggagcgcctgcaccgctggcaacagatcgagatcctctgtggcttccagattgtcaacaaccctggcatccactcactggtggctgccctcaacatagaccccagctggatgggcagtacacgccccaaccctgctcacttcatcatgactgacgacgtggatgacatggatgaggagattgtgtctcccttgtccatgcagtcccctagcctgcagagcagtgttcggcagcgcctgacggagccacagcatggcctgggatctcagagaggatcatctctaaaggcaaacaggctctctagtaagggatttgacccattccgattcggagtcctccctccacatgagtgaccgccagcgtgtggcccccaaacctcctcagatgagccgtgctgcagacgaggctctcaatgccatgacttccaatggcagccaccggctgatcgagggggtccacccagggtctctggtggagaaactgcctgacagccctgccctggccaagaaggcattactggcgctgaaccatgggctggacaaggcccacagcctgatggagctgagcccctcagccccacctggtggctctccacatttggattcttcccgttctcacagccccagctccccagacccagacacaccatctccagttggggacagccgagccctgcaagccagccgaaacacacgcattccccacctggctggcaagaaggctgtggctgaggaggataatggctctattggcgaggaaacagactccagcccaggccggaagaagtttcccctcaaaatctttaagaagcctcttaagaagtag

SEQ ID NO: 187123 - DNA, 4356 bp, Homo sapiens
  Payload ID: 16840
  Gene Symbol: STIM1
  Gene Name: stromal interaction molecule 1
  ENST ID: ENST00000616714
  CDS Start-End: 569-2944
ctggacctgggcaccgccagccgcctgggcacgggactgggcgggggcgctgacctcggcctaggaggcccaggatcccggagacgcccgcgccctcaggaccctgcgggtcgcacgccctccccagcttctgctgctcgccgctcttcggcagggcgaggtcaggtgcccccttctcgcctctcttctcttctcttctcttcctcctccacttctgtgcccgcggagactccggccgcccccttccgcaggggtgtagtaatctgcggagctgacagcagccccgcagccaccctgcccgaagtctccggaagcggcacgagctcaggccgccgcagccccggcggacccactgttggacctgaggagccagccctcctcccgcacccaaacttggagcacttgacctttggctgttggagggggcaggctcgcgggtggctggacagctgcggagccgcgagggcatcttgcctggagaccgtcggctgcactcccgggctcctggctttgcctctgggatcccgaggtgtccacatcagacgcatgttgactgagacctagagtcatggatgtatgcgtccgtcttgccctgtggctcctctggggactcctcctgcaccagggccagagcctcagccatagtcacagtgagaaggcgacaggaaccagctcgggggccaactctgaggagtccactgcagcagagttttgccgaattgacaagcccctgtgtcacagtgaggatgagaaactcagcttcgaggcagtccgtaacatccacaaactgatggacgatgatgccaatggtgatgtggatgtggaagaaagtgatgagttcctgagggaagacctcaattaccatgacccaacagtgaaacacagcaccttccatggtgaggataagctcatcagcgtggaggacctgtggaaggcatggaagtcatcagaagtatacaattggaccgtggatgaggtggtacagtggctgatcacatatgtggagctgcctcagtatgaggagaccttccggaagctgcagctcagtggccatgccatgccaaggctggctgtcaccaacaccaccatgacagggactgtgctgaagatgacagaccggagtcatcggcagaagctgcagctgaaggctctggatacagtgctctttgggcctcctctcttgactcgccataatcacctcaaggacttcatgctggtggtgtctatcgttattggtgtgggcggctgctggtttgcctatatccagaaccgttactccaaggagcacatgaagaagatgatgaaggacttggaggggttacaccgagctgagcagagtctgcatgaccttcaggaaaggctgcacaaggcccaggaggagcaccgcacagtggaggtggagaaggtccatctggaaaagaagctgcgcgatgagatcaaccttgctaagcaggaagcccagcggctgaaggagctgcgggagggtactgagaatgagcggagccgccaaaaatatgctgaggaggagttggagcaggttcgggaggccttgaggaaagcagagaaggagctagaatctcacagctcatggtatgctccagaggcccttcagaagtggctgcagctgacacatgaggtggaggtgcaatattacaacatcaagaagcaaaatgctgagaagcagctgctggtggccaaggagggggctgagaagataaaaaagaagagaaacacactctttggcaccttccacgtggcccacagctcttccctggatgatgtagatcataaaattctaacagctaagcaagcactgagcgaggtgacagcagcattgcgggagcgcctgcaccgctggcaacagatcgagatcctctgtggcttccagattgtcaacaaccctggcatccactcactggtggctgccctcaacatagaccccagctggatgggcagtacacgccccaaccctgctcacttcatcatgactgacgacgtggatgacatggatgaggagattgtgtctcccttgtccatgcagtcccctagcctgcagagcagtgttcggcagcgcctgacggagccacagcatggcctgggatctcagaggttggtagagggcgaggctggccacttcttgacaagccgggtatctctgcggcgaatgcgcagcctttcatctggacagtctttcagttctgaaggctacgggaccagctctccatctgcctctgctgctgcttcttgctcctcttccatcaccaccatcaccactaccaccaccaccaccaccaccttcaccaccgtccatgtccaccctgtttattaccaccacagcacttcctatttcctccagatggagccctaccctgacacacccccttctgacagcaccgctgtgatgcctgggcattcagagagcttgggggatttgacccattccgattcggagtcctccctccacatgagtgaccgccagcgtgtggcccccaaacctcctcagatgagccgtgctgcagacgaggctctcaatgccatgacttccaatggcagccaccggctgatcgagggggtccacccagggtctctggtggagaaactgcctgacagccctgccctggccaagaaggcattactggcgctgaaccatgggctggacaaggcccacagcctgatggagctgagcccctcagccccacctggtggctctccacatttggattcttcccgttctcacagccccagctccccagacccagacacaccatctccagttggggacagccgagccctgcaagccagccgaaacacacgcattccccacctggctggcaagaaggctgtggctgaggaggataatggctctattggcgaggaaacagactccagcccaggccggaagaagtttcccctcaaaatctttaagaagcctcttaagaagtaggcaggatggggtggcagtaaagggacagcttgtccttccctgggtgttctgtctctccttccctcccttccttcaagataactggccccaagagtggggcatgggaagggctggtccaggggtctgggcactgtacatacctgccccctcatccttgggtccttcattattatttattaactgaccaccatggcctgcctgccctgcctccgtcccaaccatgggctgctgctgtcactccctctccacttcagtgcatgtcttagttgctgttccctcagctcccagctccacctctggggttcagcttctgtctctgctgtcccagttttgaggtttggtttcttgtttctgtctcttgctttcgggctcctccctcccaccactccccaacttcccctagcagttgcagggaagataggacgagtagcttctgacatgtgtgcctcagatctgttccaccccactcacagtggttctgtttgctccagactggggctagggcctaatctttgaagtttgttctttggtattgatgtgggtcagaaggagcctcatcctaatctcactcaggcctccagggatccatgggggagtgaaaccaattctcagagaacaacccaccagagacttttaaagagaggccaggcttgggaatgggttgggagaggcatctgttcattggagcatgagtggatgccagaactgtaggttataaggcagtcactttttctctctactcccacccacacctgcctccctcttacccctgctcccccacactgcaggaggatttgtctctaagaggtgctgccccaaagctccccaagcatcaatactcctagggctcaggacaagtggctcccctggccaggagagccacagccatgatacagggctcttatggagccctggagttgttgggcaaggatgctgtcattttttgaaccaaaagacaaacaggttaaaaggaaaaaaagtaatctgaatttcccaagtgcctacgctgcatattccccttgttagatcccattttcatgttactttgtagccttggccagaggctcaaaaaggacacaaccagtttggggaaggggtggctaaggaagatggtataggtgaaggcggctgtgtgaccactttcccccacccttcccaccctctagacaactctctcccttacctgtttttgctatggctgtaaaggtatttttcctctgccccactccctgccatacctttatcctgggatcctattttgggcctggggtgggtatacctggggctggtcttaggagggtgctaggctgcagactgccttgtactccctggacaccctcaaatggggttttctgtgttatttcataaaattctttgaagtccaataaagcatgtaggagattttaaccact

SEQ ID NO: 187124 - DNA, 3613 bp, Homo sapiens
  Payload ID: 16841
  Gene Symbol: STIM2
  Gene Name: stromal interaction molecule 2
  ENST ID: ENST00000465503
  CDS Start-End: 379-2643
agagcagcggatcccggtctcgccgcagcagcagcgcgggtgtcgtgcaccgcctgaagacgccgtacctttctaccccccaccttttttttttttttttttaaataaccggaaccaatgaacgcagccgggatcagagctccggaggccgccggtgccgatgggaccaggctggcgcccggcgggagcccgtgtctgaggcggcgggggcggccggaggagtcgccggcggcggtggtggcgcctcgcggagccggcgagctgcaggcggccggggcgccgctgcgctttcacccggcttctcctcggcgccttcatcccgcctcgactcctggcccagcgtggggctggctgctgcggcggcggcgctgggctgcgttgctggtgctcgggctgctggtagccggagcggcggacggatgcgagcttgtgccccggcacctccgcgggcggcgggcgactggctctgccgcaactgccgcctcctctcccgccgcggcggccggcgatagcccggcgctcatgacagatccctgcatgtcactgagtccaccatgctttacagaagaagacagatttagtctggaagctcttcaaacaatacataaacaaatggatgatgacaaagatggtggaattgaagtagaggaaagtgatgaattcatcagagaagatatgaaatataaagatgctactaataaacacagccatctgcacagagaagataaacatataacgattgaggatttatggaaacgatggaaaacatcagaagttcataattggacccttgaagacactcttcagtggttgatagagtttgttgaactaccccaatatgagaagaattttagagacaacaatgtcaaaggaacgacacttcccaggatagcagtgcacgaaccttcatttatgatctcccagttgaaaatcagtgaccggagtcacagacaaaaacttcagctcaaggcattggatgtggttttgtttggacctctaacacgcccacctcataactggatgaaagattttatcctcacagtttctatagtaattggtgttggaggctgctggtttgcttatacgcagaataagacatcaaaagaacatgttgcaaaaatgatgaaagatttagagagcttacaaactgcagagcaaagtctaatggacttacaggagaggcttgaaaaggcacaggaagaaaacagaaatgttgctgtagaaaagcaaaatttagagcgcaaaatgatggatgaaatcaattatgcaaaggaggaggcttgtcggctgagagagctaagggagggagctgaatgtgaattgagtagacgtcagtatgcagaacaggaattggaacaggttcgcatggctctgaaaaaggccgaaaaagaatttgaactgagaagcagttggtctgttccagatgcacttcagaaatggcttcagttaacacatgaagtagaagtgcaatactacaatattaaaagacaaaacgctgaaatgcagctagctattgctaaagatgaggttgctgcttcatatctgattcaggcagaaaaaattaaaaagaagagaagcacagtctttgggactctgcacgttgcacacagctcctccctagatgaggtagaccacaaaattctggaagcaaagaaagctctctctgagttgacaacttgtttacgagaacgactttttcgctggcaacaaattgagaagatctgtggctttcagatagcccataactcaggactccccagcctgacctcttccctttattctgatcacagctgggtggtgatgcccagagtctccattccaccctatccaattgctggaggagttgatgacttagatgaagacacacccccaatagtgtcacaatttcccgggaccatggctaaacctcctggatcattagccagaagcagcagcctgtgccgttcacgccgcagcattgtgccgtcctcgcctcagcctcagcgagctcagcttgctccacacgccccccacccgtcacaccctcggcaccctcaccacccgcaacacacaccacactccttgccttcccctgatccagatatcctctcagtgtcaagttgccctgcgctttatcgaaatgaagaggaggaagaggccatttacttctctgctgaaaagcaatgggaagtgccagacacagcttcagaatgtgactccttaaattcttccattggaaggaaacagtctcctcctttaagcctcgagatataccaaacattatctccgcgaaagatatcaagagatgaggtgtccctagaggattcctcccgaggggattcgcctgtaactgtggatgtgtcttggggttctcccgactgtgtaggtctgacagaaactaagagtatgatcttcagtcctgcaagcaaagtgtacaatggcattttggagaaatcctgtagcatgaaccagctttccagtggcatcccggtgcctaaacctcgccacacatcatgttcctcagctggcaacgacagtaaaccagttcaggaagccccaagtgttgccagaataagcagcatcccacatgacctttgtcataatggagagaaaagcaaaaagccatcaaaaatcaaaagcctttttaagaagaaatctaagtgaactggctgacttgatggaatcatgttcaagtggcatctgtaaactattatcccccaccctccactccccaccttttttttggtttaattttaggaatgtaactccattggggctttccaggccggatgccatagtggaacatccagaagggcaactgtctactgtctgcttatttaagtgactatatataatcaattcatcaagccagttattactgaaaaatcattgaaatgagacagtttacagtcatttctgcctatttatttctgctttgttctcagtgatgtatatgcaacattttgttgaaagccacgatggacttacaagctttaatggactcgtaagccagcatgggcttgcaaaaatttcttgtttaccagagcatcttcttatctttccacagagctatttacatcctggactatataacttaaaagaagtaaaacgtaattgcactactgttttccagactggaaaaaaaaaaaatctctgcaagtgaaactgtatagagtttataaaatgactatggataggggactgttttcacttttagatcaaaatgggtttttaagtagaacctagggtttctaattgacttgatttctggaaatgaaaacccgcgcttttattatgggaagcttcttgaactgcatttactattgtgaagtttcaagtcccgctgtaaagatcatgttgttttgttttccccagggctttcactgtgatttactgcattgcaggctgtatgataaaacacacataatttaaagagagaaggctcttgattccttatgcaagtggaagagttgaaacttgattgaaggacttaaaacattcacaaccttaagccgaggtggggggatatggggattcaggcaattgtttacacactttgaataactgcaaaggatttacggtttgtgaaaaatgtgtactgtggaaaagataataaattgaagacattattgtg

SEQ ID NO: 187125 - DNA, 5154 bp, Homo sapiens
  Payload ID: 16841
  Gene Symbol: STIM2
  Gene Name: stromal interaction molecule 2
  Uniprot ID: Q9P246
  ENST ID: ENST00000467087
  CDS Start-End: 529-2769
gaggcgggggattggtatgcgagcgaatgtgcgaggggagggaggcgtcccggcggagcgtggtactacgaccagcgcgggccggagggggcggggggatgcgccgcggcggcggcggcgcgggagctggggttggtgtttggcggcgccagagcagcggatcccggtctcgccgcagcagcagcgcgggtgtcgtgcaccgcctgaagacgccgtacctttctaccccccaccttttttttttttttttttaaataaccggaaccaatgaacgcagccgggatcagagctccggaggccgccggtgccgatgggaccaggctggcgcccggcgggagcccgtgtctgaggcggcgggggcggccggaggagtcgccggcggcggtggtggcgcctcgcggagccggcgagctgcaggcggccggggcgccgctgcgctttcacccggcttctcctcggcgccttcatcccgcctcgactcctggcccagcgtggggctggctgctgcggcggcggcgctgggctgcgttgctggtgctcgggctgctggtagccggagcggcggacggatgcgagcttgtgccccggcacctccgcgggcggcgggcgactggctctgccgcaactgccgcctcctctcccgccgcggcggccggcgatagcccggcgctcatgacagatccctgcatgtcactgagtccaccatgctttacagaagaagacagatttagtctggaagctcttcaaacaatacataaacaaatggatgatgacaaagatggtggaattgaagtagaggaaagtgatgaattcatcagagaagatatgaaatataaagatgctactaataaacacagccatctgcacagagaagataaacatataacgattgaggatttatggaaacgatggaaaacatcagaagttcataattggacccttgaagacactcttcagtggttgatagagtttgttgaactaccccaatatgagaagaattttagagacaacaatgtcaaaggaacgacacttcccaggatagcagtgcacgaaccttcatttatgatctcccagttgaaaatcagtgaccggagtcacagacaaaaacttcagctcaaggcattggatgtggttttgtttggacctctaacacgcccacctcataactggatgaaagattttatcctcacagtttctatagtaattggtgttggaggctgctggtttgcttatacgcagaataagacatcaaaagaacatgttgcaaaaatgatgaaagatttagagagcttacaaactgcagagcaaagtctaatggacttacaggagaggcttgaaaaggcacaggaagaaaacagaaatgttgctgtagaaaagcaaaatttagagcgcaaaatgatggatgaaatcaattatgcaaaggaggaggcttgtcggctgagagagctaagggagggagctgaatgtgaattgagtagacgtcagtatgcagaacaggaattggaacaggttcgcatggctctgaaaaaggccgaaaaagaatttgaactgagaagcagttggtctgttccagatgcacttcagaaatggcttcagttaacacatgaagtagaagtgcaatactacaatattaaaagacaaaacgctgaaatgcagctagctattgctaaagatgaggcagaaaaaattaaaaagaagagaagcacagtctttgggactctgcacgttgcacacagctcctccctagatgaggtagaccacaaaattctggaagcaaagaaagctctctctgagttgacaacttgtttacgagaacgactttttcgctggcaacaaattgagaagatctgtggctttcagatagcccataactcaggactccccagcctgacctcttccctttattctgatcacagctgggtggtgatgcccagagtctccattccaccctatccaattgctggaggagttgatgacttagatgaagacacacccccaatagtgtcacaatttcccgggaccatggctaaacctcctggatcattagccagaagcagcagcctgtgccgttcacgccgcagcattgtgccgtcctcgcctcagcctcagcgagctcagcttgctccacacgccccccacccgtcacaccctcggcaccctcaccacccgcaacacacaccacactccttgccttcccctgatccagatatcctctcagtgtcaagttgccctgcgctttatcgaaatgaagaggaggaagaggccatttacttctctgctgaaaagcaatgggaagtgccagacacagcttcagaatgtgactccttaaattcttccattggaaggaaacagtctcctcctttaagcctcgagatataccaaacattatctccgcgaaagatatcaagagatgaggtgtccctagaggattcctcccgaggggattcgcctgtaactgtggatgtgtcttggggttctcccgactgtgtaggtctgacagaaactaagagtatgatcttcagtcctgcaagcaaagtgtacaatggcattttggagaaatcctgtagcatgaaccagctttccagtggcatcccggtgcctaaacctcgccacacatcatgttcctcagctggcaacgacagtaaaccagttcaggaagccccaagtgttgccagaataagcagcatcccacatgacctttgtcataatggagagaaaagcaaaaagccatcaaaaatcaaaagcctttttaagaagaaatctaagtgaactggctgacttgatggaatcatgttcaagtggcatctgtaaactattatcccccaccctccactccccaccttttttttggtttaattttaggaatgtaactccattggggctttccaggccggatgccatagtggaacatccagaagggcaactgtctactgtctgcttatttaagtgactatatataatcaattcatcaagccagttattactgaaaaatcattgaaatgagacagtttacagtcatttctgcctatttatttctgctttgttctcagtgatgtatatgcaacattttgttgaaagccacgatggacttacaagctttaatggactcgtaagccagcatgggcttgcaaaaatttcttgtttaccagagcatcttcttatctttccacagagctatttacatcctggactatataacttaaaagaagtaaaacgtaattgcactactgttttccagactggaaaaaaaaaaaatctctgcaagtgaaactgtatagagtttataaaatgactatggataggggactgttttcacttttagatcaaaatgggtttttaagtagaacctagggtttctaattgacttgatttctggaaatgaaaacccgcgcttttattatgggaagcttcttgaactgcatttactattgtgaagtttcaagtcccgctgtaaagatcatgttgttttgttttccccagggctttcactgtgatttactgcattgcaggctgtatgataaaacacacataatttaaagagagaaggctcttgattccttatgcaagtggaagagttgaaacttgattgaaggacttaaaacattcacaaccttaagccgaggtggggggatatggggattcaggcaattgtttacacactttgaataactgcaaaggatttacggtttgtgaaaaatgtgtactgtggaaaagataataaattgaagacattattgtgtgggattgtgctgatttttgttgataacacaaaaaacactatgttttctggagagctgtgtaagctgtcttgttgcttagttgcaatataagaaatagtgatgttttggacgtaagttgtcaacaaatttctattttatattgttatatttttatgtagtttgaaatgtaaaaatgttctaatatcaagattaacaaatataaatttatggtgcatttagattgcgttgtattaatttataaagtatggtgttcattaaattggtgggttgtataagggtagcttttgttgttaaaaaaacagtagagagttaagttccatatagcaacaaagtatgttaacatctagggagtttctgcttataccactttaaaaatatgcaatcataagtgatttggttactgcaatgcagatggatgtttggatgaacaactgatacattttagttagaatgctttttcagcattatggctaaaatatatgtctaacccagtgctatttaggtgaaaatgctaattgataaaccagaagtttcttttgagatttgctttaaagaaatgctttagtaagaatatgaacaatttcctgatgtctcctataaattgtgattgtttattctattactattgttaaaaacttgaatggtatttatattggctgatatttatatacttaatagattgagttctgtaagggcaaaaacggattgaaatgaacatagcgttttgcactaatgataagataacctgagaggtagggttgaggaacacagggttgaaagctgttggagaggggaaaagttgtgcataaagaactgaaaagggttctggagtgttcattcagagtgaagggaaaactttatccttctatttcttataaccagacaggaggagttcttccctttgaaaattgcaaaaggaatgagaactttgcagttggatgaatagagaagggaaaagttgctggagcacggagtgaagatgggaggagctgttagcaaggcccactgctgctcctgggtgagaagggagctctggagcaggaccagctgggggccggcactgctgcttagagtggaggaggctggccaaagagactgtgggctgttttcagtcagggagcatgtgcattgtttgtgctcaatttcagacactcatttataaacaaattcaaccaagggatatttactgctttatgttgcttatgataattattttgcattaatacagtatacacatttgtaaattcaacaggaaattattgagttttggaaagctacagtaatttctgtattacatcatttatatgtgaaaagttggacatttctgtaagtttttaaaattatccatttgttactttaacattttaaaattatggtgttttcctgattttaaaagcaatattttccttactgt

SEQ ID NO: 187126 - DNA, 3925 bp, Homo sapiens
  Payload ID: 16841
  Gene Symbol: STIM2
  Gene Name: stromal interaction molecule 2
  ENST ID: ENST00000467011
  CDS Start-End: 426-2225
ccgcggcggcggcggcgcgggagctggggttggtgtttggcggcgccagagcagcggatcccggtctcgccgcagcagcagcgcgggtgtcgtgcaccgcctgaagacgccgtacctttctaccccccaccttttttttttttttttttaaataaccggaaccaatgaacgcagccgggatcagagctccggaggccgccggtgccgatgggaccaggctggcgcccggcgggagcccgtgtctgaggcggcgggggcggccggaggagtcgccggcggcggtggtggcgcctcgcggagccggcgagctgcaggcggccggggcgccgctgcgctttcacccggcttctcctcggcgccttcatcccgcctcgactcctggcccagcgtggggctggctgctgcggcggcggcgctgggctgcgttgctggtgctcgggctgctggtagccggagcggcggacggatgcgagcttgtgccccggcacctccgcgggcggcgggcgactggctctgccgcaactgccgcctcctctcccgccgcggcggccggcgatagcccggcgctcatgacagatccctgcatgtcactgagtccaccatgctttacagaagaagacagatttagtctggaagctcttcaaacaatacataaacaaatggatgatgacaaagatggtggaattgaagtagaggaaagtgatgaattcatcagagaagatatgaaatataaagatgctactaataaacacagccatctgcacagagaagataaacatataacgattgaggatttatggaaacgatggaaaacatcagaagttcataattggacccttgaagacactcttcagtggttgatagagtttgttgaactaccccaatatgagaagaattttagagacaacaatgtcaaaggaacgacacttcccaggatagcagtgcacgaaccttcatttatgatctcccagttgaaaatcagtgaccggagtcacagacaaaaacttcagctcaaggcattggatgtggttttgtttggacctctaacacgcccacctcataactggatgaaagattttatcctcacagtttctatagtaattggtgttggaggctgctggtttgcttatacgcagaataagacatcaaaagaacatgttgcaaaaatgatgaaagatttagagagcttacaaactgcagagcaaagtctaatggacttacaggagaggcttgaaaaggcacaggaagaaaacagaaatgttgctgtagaaaagcaaaatttagagcgcaaaatgatggatgaaatcaattatgcaaaggaggaggcttgtcggctgagagagctaagggagggagctgaatgtgaattgagtagacgtcagtatgcagaacaggaattggaacaggttcgcatggctctgaaaaaggccgaaaaagaatttgaactgagaagcagttggtctgttccagatgcacttcagaaatggcttcagttaacacatgaagtagaagtgcaatactacaatattaaaagacaaaacgctgaaatgcagctagctattgctaaagatgaggcagaaaaaattaaaaagaagagaagcacagtctttgggactctgcacgttgcacacagctcctccctagatgaggtagaccacaaaattctggaagcaaagaaagctctctctgagttgacaacttgtttacgagaacgactttttcgctggcaacaaattgagaagatctgtggctttcagatagcccataactcaggactccccagcctgacctcttccctttattctgatcacagctgggtggtgatgcccagagtctccattccaccctatccaattgctggaggagttgatgacttagatgaagacacacccccaatagtgtcacaatttcccgggaccatggctaaacctcctggatcattagccagaagcagcagcctgtgccgttcacgccgcagcattgtgccgtcctcgcctcagcctcagcgagctcagcttgctccacacgccccccacccgtcacaccctcggcaccctcaccacccgcaacacacaccacactccttgccttcccctgatccagatatcctctcagtgtcaagttgccctgcgctttatcgaaatgaagaggaggaagaggccatttacttctctgctgaaaagcaatgtattcaccttgggctcggtgcgtgcaaaagtgaatgagactaagtagtaaagctctcaaaaaaaaaaaggaagtgccagacacagcttcagaatgtgactccttaaattcttccattggaaggaaacagtctcctcctttaagcctcgagatataccaaacattatctccgcgaaagatatcaagagatgaggtgtccctagaggattcctcccgaggggattcgcctgtaactgtggatgtgtcttggggttctcccgactgtgtaggtctgacagaaactaagagtatgatcttcagtcctgcaagcaaagtgtacaatggcattttggagaaatcctgtagcatgaaccagctttccagtggcatcccggtgcctaaacctcgccacacatcatgttcctcagctggcaacgacagtaaaccagttcaggaagccccaagtgttgccagaataagcagcatcccacatgacctttgtcataatggagagaaaagcaaaaagccatcaaaaatcaaaagcctttttaagaagaaatctaagtgaactggctgacttgatggaatcatgttcaagtggcatctgtaaactattatcccccaccctccactccccaccttttttttggtttaattttaggaatgtaactccattggggctttccaggccggatgccatagtggaacatccagaagggcaactgtctactgtctgcttatttaagtgactatatataatcaattcatcaagccagttattactgaaaaatcattgaaatgagacagtttacagtcatttctgcctatttatttctgctttgttctcagtgatgtatatgcaacattttgttgaaagccacgatggacttacaagctttaatggactcgtaagccagcatgggcttgcaaaaatttcttgtttaccagagcatcttcttatctttccacagagctatttacatcctggactatataacttaaaagaagtaaaacgtaattgcactactgttttccagactggaaaaaaaaaaaatctctgcaagtgaaactgtatagagtttataaaatgactatggataggggactgttttcacttttagatcaaaatgggtttttaagtagaacctagggtttctaattgacttgatttctggaaatgaaaacccgcgcttttattatgggaagcttcttgaactgcatttactattgtgaagtttcaagtcccgctgtaaagatcatgttgttttgttttccccagggctttcactgtgatttactgcattgcaggctgtatgataaaacacacataatttaaagagagaaggctcttgattccttatgcaagtggaagagttgaaacttgattgaaggacttaaaacattcacaaccttaagccgaggtggggggatatggggattcaggcaattgtttacacactttgaataactgcaaaggatttacggtttgtgaaaaatgtgtactgtggaaaagataataaattgaagacattattgtgtgggattgtgctgatttttgttgataacacaaaaaacactatgttttctggagagctgtgtaagctgtcttgttgcttagttgcaatataagaaatagtgatgttttggacgtaagttgtcaacaaatttctattttatattgttatatttttatgtagtttgaaatgtaaaaatgttctaatatcaagattaacaaatataaatttatggtgcatttaga

SEQ ID NO: 187127 - DNA, 770 bp, Homo sapiens
  Payload ID: 16841
  Gene Symbol: STIM2
  Gene Name: stromal interaction molecule 2
  ENST ID: ENST00000477474
  CDS Start-End: 1-666
cacgttgcacacagctcctccctagatgaggtagaccacaaaattctggaagcaaagaaagctctctctgagttgacaacttgtttacgagaacgactttttcgctggcaacaaattgagaagatctgtggctttcagatagcccataactcaggactccccagcctgacctcttccctttattctgatcacagctgggtggtgatgcccagagtctccattccaccctatccaattgctggaggagttgatgacttagatgaagacacacccccaatagtgtcacaatttcccgggaccatggctaaacctcctggatcattagccagaagcagcagcctgtgccgttcacgccgcagcattgtgccgtcctcgcctcagcctcagcgagctcagcttgctccacacgccccccacccgtcacaccctcggcaccctcaccacccgcaacacacaccacactccttgccttcccctgatccagatatcctctcagtgtcaagttgccctgcgctttatcgaaatgaagaggaggaagaggccatttacttctctgctgaaaagcaatgtatgatcatagtcaccagcaagatgcctttactgacagaactggtcttgtgtggtttctggaaatcagaaggaaaactcgagagctgcactgtctaataaaacttcctgcattgatggaacgttcagttctcatttcaatagcaatgtcaaagtttcatagctagctctcataaataagagaatgatttgaatttggaaaa

SEQ ID NO: 187128 - DNA, 1328 bp, Homo sapiens
  Payload ID: 16841
  Gene Symbol: STIM2
  Gene Name: stromal interaction molecule 2
  ENST ID: ENST00000473519
  CDS Start-End: 1-1044
gaaatcaattatgcaaaggaggaggcttgtcggctgagagagctaagggagggagctgaatgtgaattgagtagacgtcagtatgcagaacaggaattggaacaggttcgcatggctctgaaaaaggccgaaaaagaatttgaactgagaagcagttggtctgttccagatgcacttcagaaatggcttcagttaacacatgaagtagaagtgcaatactacaatattaaaagacaaaacgctgaaatgcagctagctattgctaaagatgaggcagaaaaaattaaaaagaagagaagcacagtctttgggactctgcacgttgcacacagctcctccctagatgaggtagaccacaaaattctggaagcaaagaaagctctctctgagttgacaacttgtttacgagaacgactttttcgctggcaacaaattgagaagatctgtggctttcagatagcccataactcaggactccccagcctgacctcttccctttattctgatcacagctgggtggtgatgcccagagtctccattccaccctatccaattgctggaggagttgatgacttagatgaagacacacccccaatagtgtcacaatttcccgggaccatggctaaacctcctggatcattagccagaagcagcagcctgtgccgttcacgccgcagcattgtgccgtcctcgcctcagcctcagcgagctcagcttgctccacacgccccccacccgtcacaccctcggcaccctcaccacccgcaacacacaccacactccttgccttcccctgatccagatatcctctcagtgtcaagttgccctgcgctttatcgaaatgaagaggaggaagaggccatttacttctctgctgaaaagcaatggaacacaagggagtgtgcagttggagacagccagggaccacatgtacacggcctggtacgctttgacaaggactttggatcttactctgagtatgagagaaagcactgggaagtttcaaggaagtgccagacacagcttcagaatgtgactccttaaattcttccattggaaggaaacagtctcctcctttaagcctcgagatataccaaacattatctccgcgaaagatatcaagagatgaggtgtccctagaggattcctcccgaggggattcgcctgtaactgtggatgtgtcttggggttctcccgactgtgtaggtctgacagaaactaagagtatgatcttcagtcctgcaagcaaagtgtacaatggcattttggagaaatcctgtagcatgaaccagctttccagtggcatcccggtgcctaaacctcgccac

SEQ ID NO: 187129 - DNA, 1072 bp, Homo sapiens
  Payload ID: 16841
  Gene Symbol: STIM2
  Gene Name: stromal interaction molecule 2
  ENST ID: ENST00000463501
  CDS Start-End: 429-1072
caaacaacatgggcaaagtgcgatgcgtttatcctaagccaagaacacgcttagaatgcacgcccagagccagttctccccaagggatggcaacgcacctgtgtgccgggctccgcgcaagggctttccctgtttattctcccgccgccgctaacaaccttgtggggcgggcatggttggatccccaatttaaaagtggggaaactgaggacagattaacctgtctgcacgtaacacagctgaaaagtggtggaattgctatttctttcaggtttgcctgattctagagctcaatgctgcccatcaggtgtttgaagtcatgatttggtgaaaatgggacagtgaagacgttctgaaaaaaaaaaaaggcatatgatgaggtttggacattgagaggtataggctggctgtaggagtcggatccctgcatgtcactgagtccaccatgctttacagaagaagacagatttagtctggaagctcttcaaacaatacataaacaaatggatgatgacaaagatggtggaattgaagtagaggaaagtgatgaattcatcagagaagatatgaaatataaagatgctactaataaacacagccatctgcacagagaagataaacatataacgattgaggatttatggaaacgatggaaaacatcagaagttcataattggacccttgaagacactcttcagtggttgatagagtttgttgaactaccccaatatgagaagaattttagagacaacaatgtcaaaggaacgacacttcccaggatagcagtgcacgaaccttcatttatgatctcccagttgaaaatcagtgaccggagtcacagacaaaaacttcagctcaaggcattggatgtggttttgtttggacctctaacacgcccacctcataactggatgaaagattttatcctcacagtttctatagtaattggtgttggaggctgctggtttgcttatacgcagaataagacatcaaaagaacatgttgcaaaaatgatgaaagatttagagagcttacaaactgcagagcaaagtctaatggacttacaggagag

SEQ ID NO: 187130 - DNA, 726 bp, Homo sapiens
  Payload ID: 16841
  Gene Symbol: STIM2
  Gene Name: stromal interaction molecule 2
  ENST ID: ENST00000494628
  CDS Start-End: 249-726
agcgggcatgcgcggggctgcggtggcgcaggcgccctgccgcgcccgccagtcgggaaccggttctccgagtccgagctggcggcgcgctgtttgcctgattctagagctcaatgctgcccatcaggtgtttgaagtcatgatttggtgaaaatgggacagtgaagacgttctgaaaaaaaaaaaaggcatatgatgaggtttggacattgagaggtataggctggctgtaggagtcggatccctgcatgtcactgagtccaccatgctttacagaagaagacagatttagtctggaagctcttcaaacaatacataaacaaatggatgatgacaaagatggtggaattgaagtagaggaaagtgatgaattcatcagagaagatatgaaatataaagatgctactaataaacacagccatctgcacagagaagataaacatataacgattgaggatttatggaaacgatggaaaacatcagaagttcataattggacccttgaagacactcttcagtggttgatagagtttgttgaactaccccaatatgagaagaattttagagacaacaatgtcaaaggaacgacacttcccaggatagcagtgcacgaaccttcatttatgatctcccagttgaaaatcagtgaccggagtcacagacaaaaacttcagctcaaggcattggatgtggttttgtttggacctctaacacgcccacctcata

SEQ ID NO: 187131 - DNA, 583 bp, Homo sapiens
  Payload ID: 16841
  Gene Symbol: STIM2
  Gene Name: stromal interaction molecule 2
  ENST ID: ENST00000478049
  CDS Start-End: 322-583
gctattccgcggctccggccagggcgcgatgcggagccctgcctgctgcttcgtcgcggtcccctgcactccggacgtctttccttttcaccccgacaccccgccctcgccgagcctctcgacggcactgattcccctcccttcagtcgggctctccgatcttccaagctgagcaatgcggtggtttctctttcgtgctgcagaagtgccagcagggatatagcaacaaggtgccacctgtaaagcaagagagccctcaccagacactgaatctgctggtgcctttatcttggacttcccagcctttagacctatccctgcatgtcactgagtccaccatgctttacagaagaagacagatttagtctggaagctcttcaaacaatacataaacaaatggatgatgacaaagatggtggaattgaagtagaggaaagtgatgaattcatcagagaagatatgaaatataaagatgctactaataaacacagccatctgcacagagaagataaacatataacgattgaggatttatggaaacgatggaaaacatcagaagttcataattggacccttgaagaca

SEQ ID NO: 187132 - DNA, 9784 bp, Homo sapiens
  Payload ID: 16842
  Gene Symbol: SMC1A
  Gene Name: structural maintenance of chromosomes 1A
  Uniprot ID: Q14683
  ENST ID: ENST00000322213
  CDS Start-End: 129-3830
aggcctggacgtattctcgcgacatttgccggtcgcccggcttgcactgcggcgtttcccgcgcgggctacctcagttctcgggcgtacggcgcggcctgtcctactgccgccggcgccgcggccgtcatggggttcctgaaactgattgagattgagaactttaagtcgtacaagggtcgacagattatcggaccatttcagaggttcaccgccatcattggacccaatggctctggtaagtcaaatctcatggatgccatcagctttgtgctaggtgaaaaaaccagcaacctgcgggtaaagaccctgcgggacctgatccatggagctcctgtgggcaagccagctgccaaccgggcctttgtcagcatggtctactctgaggagggtgctgaggaccgtacctttgcccgtgtcattgtaggaggttcttctgagtacaagatcaacaacaaagtggtccaactacatgagtacagtgaggaattagagaagttgggcattctcatcaaagctcgtaacttcctcgttttccagggtgctgtggaatctattgccatgaagaaccccaaagagaggacagctctatttgaagagattagtcgttctggggagctggcgcaggagtatgacaagcgaaagaaggaaatggtgaaggctgaagaggacacacagtttaattaccatcgcaagaaaaatattgcggctgaacgcaaggaagcaaagcaggagaaagaagaggctgaccggtaccagcgcctgaaggatgaggtagtacgggctcaggtacagctgcagctctttaagctttaccataatgaagtggaaattgagaagctcaacaaggaactggcctcaaagaacaaggagatcgagaaggacaagaagcgtatggacaaggtggaggatgaactgaaggagaagaagaaggagctgggcaaaatgatgcgggagcagcagcagattgagaaggagatcaaggagaaggactcagaattgaaccagaagcggcctcagtacatcaaagccaaggagaacacctcccacaaaatcaagaagctggaagcagccaagaagtctctgcagaatgctcagaagcactacaagaagcgtaaaggtgacatggatgagctggagaaggagatgctgtcagtggagaaggctcggcaggagtttgaagaacggatggaagaagagagtcagagtcagggcagagatttgacgttggaggagaatcaggtgaagaaataccaccggttgaaagaagaagccagcaagagagcagctaccctggcccaggagctggagaaattcaatcgagaccagaaagctgaccaggaccgtctggatctggaagaacggaagaaagtagagacagaggccaagatcaagcaaaagctgcgggaaattgaagagaatcagaagcggattgagaaactggaggaatacatcaccactagcaagcagtccctagaagagcagaagaagctagagggggagctgacagaggaggtggagatggccaagcggcgtattgatgaaatcaataaggagctgaaccaggtgatggagcagctaggggatgcccgcatcgaccgccaggagagcagccgccagcagcgaaaggcagagataatggaaagcatcaagcgcctttaccctggctctgtgtacggccgcctcattgacctatgccagcccacacaaaagaagtatcagattgctgtaaccaaggttttgggcaagaacatggatgccattattgtggactcggagaagacaggccgggactgtattcagtatatcaaggagcagcgtggggagcctgagaccttcttgcctcttgactacctggaggtgaagcctacagatgagaaactccgggagctgaagggggccaagctagtgattgatgtgattcgctatgagccacctcatatcaaaaaggccctgcagtatgcttgtggcaatgcccttgtctgtgacaacgtggaagatgcccgccgcattgcctttggaggccaccagcgccacaagacagtggcactggatggaaccctattccagaagtcaggagtgatctctggtggggccagtgacctgaaggccaaggcacggcgctgggatgagaaagcagtagacaagttgaaagagaagaaggagcgcttgacagaggagctgaaagagcagatgaaggcaaaacggaaagaggcagagctgcgtcaggtgcagtctcaggcccatggactgcagatgcggctcaagtactcccagagtgacctagaacagaccaagacacgacatctagccctgaatctgcaggaaaaatccaagctggagagtgagctagccaactttgggcctcgcattaatgatatcaagaggatcattcagagccgagagagggaaatgaaagacttgaaggagaagatgaaccaggtagaggatgaggtgtttgaagagttttgtcgggagattggtgtgcgcaacatccgggagtttgaggaagaaaaggtgaaacggcagaatgaaatcgccaagaagcgtttggagtttgagaatcagaagactcgcttgggcattcagttggattttgaaaagaaccaactgaaggaggaccaagataaagtacacatgtgggagcagacagtgaaaaaagatgaaaatgagatagaaaagctcaaaaaggaggaacaaagacacatgaagatcatagatgagaccatggctcagctacaagacctgaagaatcagcatctggccaagaagtcggaagtgaatgacaagaatcatgagatggaggagattcgtaagaaactcgggggcgccaacaaggaaatgacccatttacagaaggaggtgacagccattgagaccaagcttgaacagaagcgcagtgaccgtcacaacttgctacaggcctgtaagatgcaggacattaagttgccactgtcaaaaggcaccatggatgatattagtcaggaagagggtagctcccagggggaggactcagtgagtggttcacagagaatttccagtatctatgcacgagaggccctcattgagattgactacggtgatctgtgtgaggatctgaaggatgcccaggctgaggaagagatcaagcaagagatgaacacactgcagcagaagctgaatgagcagcagagtgtgcttcagcgtattgccgcccccaacatgaaggccatggaaaagctggaaagtgtccgagacaagttccaggagacctcagatgagtttgaagcagcccgaaagcgagcaaagaaggccaagcaggcattcgaacagatcaagaaggagcgctttgaccgcttcaatgcttgttttgaatctgtggctaccaacattgatgagatctataaggccctgtcccgcaatagcagtgcccaggcattcctgggccctgagaaccctgaagagccctacttggatggcatcaactacaactgtgtggctcctgggaaacgcttccggcctatggacaacttgtcaggcggggagaagacagtggcagctctggccctgctctttgccatccacagctacaagccagcccccttcttcgtcctggatgagattgatgctgccttggataacaccaacattggcaaggtggcaaattacatcaaggagcagtcgacttgcaacttccaggccatcgtcatctctctcaaggaggagttctacaccaaggccgagagcctcattggagtctatcctgagcaaggggactgtgtgatcagcaaagtcctgaccttcgacctcaccaagtacccagatgccaaccccaaccccaatgagcagtagcagtatttttgccctcccgccctgtctggatccctaagctgtccctctcccaatctctggatatttgactcccaaccttccccctacctcctggccctttttggtgtagtcatgggatttaggcactgctaatcaagcatgaagaggaacagaggtgatgttaggtctggagcaaaaattcctgaacgacagggagtattctggcctctgaaaggaggtgctgagctgaacagggccatctgttcatcacacacacccccttcctccccctcatcacccataatcgtgggccccttgggcctcttgcccactgtgtgtgtgggtatgtatgtgtgtatgtatgtatccgcatgtgtgcatgtgagtatgtttgcaaaataataaaggatattggagacctgttttagaaggagcctaggctgaatttgattccaagagagcttaggatgacagcacccctgagctgggcaaaggtactcaggacctcataggagtcttaggcagttacctgaaactgccttcattcactcatttgtgtattcattcatttatgtattcatcagacacataccgaacaccctctatttgtcaggctctgtgcttggaatacagagttgaatcagacatgatctctaccctcctagtaaggagatacagtgggttcatgaatgactatagttagctgaatgtcatatgtactttgaatttgagaagtgggtgatcccctctaggcttcctggaggtcacatttaagctagaccttgacaaattggtaggatttggtcaggcactaggagtggagcatgagctctggggacagacagttatgggttctggtcccactttttatcacttactagttgtttgaccttgggcaagtcatttgaccttctgtgcctcagtttcctcatctgtaaaatggggctaacaatattacctacctcataggatttaatgatgtcaagctcctcactggaggccttatcccttcgtggagcccactaggtgccgacccctcagaatataaccctcatgcctggacccctgagagcttctgatcccagctattagggacagaagaagcctccaaatctggaaggtgctgaatgccctgctgactgggaaagtttcagggcactgatggggtctacctggtaagcggagggcctgaggaaacctgtagcttcaatcatgtctggtaaccgggtgcctgagccccaatctgggttgtgaggaaataggggagaggtatcctgggccacatcccagcctaacacctgtgaggttcattttaggaactaacctcattagctataaggatcatgcagaggcagcaaagccgggtgcgatgagctcagcctttactcattcacatacaccatcacactttaattccaatctgtatattgctttttaaaagttaagtccattctaattacccaaatatgcatgaattcattctccttttgagaagttagattgttaaagatagtctcattcagctaccaaccactccttgatccttcccttcttagtggctgttgtttgttgtacttccgtttagactttgttttaatgcttgtacgtacatatgtgaactcattggaaatattgtgtgtttaatgcaaatgatatattgaattgtttagcaatttgttttctttgcttaacgatgtttttgagatctgtgcatgttacttaatgtagctcaatccatcttctgtaattgctgtatagattgtcatcatatgattaccacattttacttacgcatttcttttgtgatggacattaagactgtttttaggttttgctattacaaaatactacacaggagcatcactatgcctgtgtgaaagtatatgtatgaaagtttacctagggttgattcctagaagtggaattgcaaagtcataggatatttatatattggtttttaataatacttccaaattgccctcctgtactatttactcagtatttttcttgaggttgatctgaggtctaacattgttatcctatatcattttcatcccaagtagtgatatctgtgaaatcacaggtttgatgtgtgctaattatgtattcttctaatacatattaaaagacataactatcaaaacaaaataaatttgtctgttttcaaccaaagaagtcacgtaccactggtggtactgtgtgccataatttggcaaatgctggcctttatggacgagcacaattcgggggtcagacctggttcaaattctagctgtagaaacttgtgcaagttacttcacctctgagcctaagtttccacatctgtaaaaggagataataaacacctaccttgcagtagtgaagcaaagagaaaattaaatatatatgaagcaatttggctggcatctagatcattcacagccctttaaaggtcacctttgctgttctccccactttacagataaggaaactgaggcccaaaaaggtttgaacccaggtcttccaagtcattcaagtgctttctccactgtacaggtggttatcaaccttggctgcgcatcagaatcgtttgtaaagctttttctttttcctttttaaaaagtaaagcaatatatacacaggtaaaaaaataaaatagtacagaagggcttataatgagaagcagcagttccctgcttgcacccccacatccaaaggatgtggagctctttaaaaataaattgctctggtcccacctctggaaatctgattcagccagcatggataataacccagataactaacccctacctcacaggataaaaaggattacatgagatgccttaggctaaggccctggcacacaggaacacatgtgctacaaaggagctttggggacttaagtcctgaggatccaggaggtgaggtgacttgtccaagattccactggtttagtggcagagcctagacttccactcggatctatttagtgcttgccccctgctctctcctgtcgtgccccaccacctcctggcatcacagggcaaccgttgtcaaggctatgctcacgggaggctgggcaccacagtgtttccaagagcaagctggatccgagtagattccctagggcttgttggaggaactagtttgactcccttatactgtggacgcagtagccttgctgtagggagttgaagagtactccacaacagtatcttaagtttaactgggcacttccctctggaaatcacagtgttgtgcaccaggaacacaaagatgagtcaaatctttatcctgcctttgaggagctcactgtttagttggggaaaccatttgtaaaacagccattaaccatacagtgtgatcaacactgacaggagcacaggaaaaacatctagcttatgtgaagattcagagaaggcatcctgtagtctaggtggtgatacctgaactgagtcttgagggacgggtaggaattagccagttgaggaagtagaaggaatttccagatattggaaacagtatgcatgaagacatgaaggcaagaaacagcaaaacaaatactgaagcatgaagattcctggggtggggggaaagcagcaagaaaaggtagagaggaaccagattggaagagggtcgtaaatgcatggctacagaattcagatttgttttgtaggacagtgtggttcccaaactggctgtataccacaaacaggtacggcattctgggccccggcccctaaaacattcattaagtctggggtgaagatttggaatcttgaatgcttataaaggttaccacatgactagggtacagccagatttggaaaccatagcttgaaggcagtgagggagccatgaaatggtttttaatagggggactccagatcagatgtgaacttaacctgtttctggctggctagccaaccagcatggaaaacagattaggttagatgttcatgctgtatgtgcccgtgcctgtagcttccctgttaatcagcttcttacactactatatttgcttattttgtctctgaataagctttaggcaccacaagggtgggcctggggatattttgcttaccagtatagcccctgcaaaaaagcacagtgcctgacacaaaacaggcacccagtaaagtttttgaatgaatgaatgcatgagtgaatccatttgtgagagagcgaatggagatgacaagattagctaggagactggaaaaagaccaggaggcctgcactagggcaaaggccagtaggaatagattggaggtgttaaggtgtgaactgttaaggtaagatgataacttaatgactgattattggatgtggagggtgactgagaggatagaatgagtacccatgaatagccatgattcctaccctgtcccagtcatctctttccttatccatctctgaaacaatctgcttacatcctcctcagcaactggaattcctcaagttagttagacattctgtgtgctgtgtggtctctcactgcccccccactccccacccctccacaagccattgattcattcatccagttcaataaatcttggctaagcacctccagtgtgcagtaaggctcttccaagccaggactctgactccctctttcctacctcaagagatgtttttgagggctttcccaggtaagagtcacatctcttatacaataacttatagtgagatacccagaatgtcagacttgtaagggaagactgcccaaaccccttctgaggtcctcagaggggaattaacttcctaaggtccgactgctaggaagtgttggagccagaaatggaagctaggtttcctttctatgtcatctctggagtcttgatcttgatctatcccattgtagatcaggacaggcagaggtggtcagggagaaggtgggacttaggttgaaccttgaaggtcaatgtattggacaggtcaaacaagatggttgccaattacactgcccccttctggaaacccttagcaaacctgccatgcttgcagtcccttctaaggggtttccttagcataagttgccatgctctgtaccatgtgacctcacaatcctggccacagatagctagatgtggatagtgtctggttcaagggcaaccaatctctaggctggccagtggcctgttagctggactggcataaggacttcaccttacaggggtggcatgtatcaaatggcaaatgtatgaaacaaccagatctttcagggaggcagaatgtgagctattcagaagaagtgaacgttaattagaatttaatgaggcattagtggtggtggatgaggggtggccagaaactaaacagcaaaagcaaagagaaagctgcagaaaccataagtaagcagaggtcatgagacatttgtataatgagatcacggagccacagggtggcagaagccatgaagcagcaaggcaacaatgggctagaagccatgaagcaataggagccacgaggaacagaaaccgtgagacaaaactgactatgagatccacaaagcagcagaaggcttgaatagataagatcatgagacagtagaagcgatgagactgcaagaaccacaaggtagccagaaccatgtggcaacatggcaacaggaatggaagaggcagcaggagctacaatgcagaaaagccatggattaataggaactgaagcgccgggagccatgaagctgcaggacccatgaggcagaaaaagccatgggctagcatcgaggggggcagaaagaagttagtcagtagcagtaggaggagtataaatacagccagaaaggagttgagtcaccaatttgggaagcactagagaagggagcaacagatgcctgcagctgagggggtgacaagataagccaggctctagagctgctttggatcatgaaccattttcaagtttctgttcttccatgaggctgcctgtgtagctgttcttgtcttccttatttccctgtgaatgctttaataaatccccatcactaa

SEQ ID NO: 187133 - DNA, 9930 bp, Homo sapiens
  Payload ID: 16842
  Gene Symbol: SMC1A
  Gene Name: structural maintenance of chromosomes 1A
  ENST ID: ENST00000375340
  CDS Start-End: 341-3976
aggcctggacgtattctcgcgacatttgccggtcgcccggcttgcactgcggcgtttcccgcgcgggctacctcagttctcgggcgtacggcgcggcctgtcctactgccgccggcgccgcggccgtcatggggttcctgaaactgattgagattgagaactttaagtcgtacaagggtcgacagattatcggaccatttcagaggttcaccgccatcattggacccaatggctctgcccagcgtcctctctcgcctcgcattggtacactccaactcctttctactcttctctggaggcggcacttttgaatttcagacccagcgctccagtctttagaatgcttgaggtgtcgatccccaccccccaccgctatgtcagaggtaagtcaaatctcatggatgccatcagctttgtgctaggtgaaaaaaccagcaacctgcgggtaaagaccctgcgggacctgatccatggagctcctgtgggcaagccagctgccaaccgggcctttgtcagcatggtctactctgaggagggtgctgaggaccgtacctttgcccgtgtcattgtaggaggttcttctgagtacaagatcaacaacaaagtggtccaactacatgagtacagtgaggaattagagaagttgggcattctcatcaaagctcgtaacttcctcgttttccagggtgctgtggaatctattgccatgaagaaccccaaagagaggacagctctatttgaagagattagtcgttctggggagctggcgcaggagtatgacaagcgaaagaaggaaatggtgaaggctgaagaggacacacagtttaattaccatcgcaagaaaaatattgcggctgaacgcaaggaagcaaagcaggagaaagaagaggctgaccggtaccagcgcctgaaggatgaggtagtacgggctcaggtacagctgcagctctttaagctttaccataatgaagtggaaattgagaagctcaacaaggaactggcctcaaagaacaaggagatcgagaaggacaagaagcgtatggacaaggtggaggatgaactgaaggagaagaagaaggagctgggcaaaatgatgcgggagcagcagcagattgagaaggagatcaaggagaaggactcagaattgaaccagaagcggcctcagtacatcaaagccaaggagaacacctcccacaaaatcaagaagctggaagcagccaagaagtctctgcagaatgctcagaagcactacaagaagcgtaaaggtgacatggatgagctggagaaggagatgctgtcagtggagaaggctcggcaggagtttgaagaacggatggaagaagagagtcagagtcagggcagagatttgacgttggaggagaatcaggtgaagaaataccaccggttgaaagaagaagccagcaagagagcagctaccctggcccaggagctggagaaattcaatcgagaccagaaagctgaccaggaccgtctggatctggaagaacggaagaaagtagagacagaggccaagatcaagcaaaagctgcgggaaattgaagagaatcagaagcggattgagaaactggaggaatacatcaccactagcaagcagtccctagaagagcagaagaagctagagggggagctgacagaggaggtggagatggccaagcggcgtattgatgaaatcaataaggagctgaaccaggtgatggagcagctaggggatgcccgcatcgaccgccaggagagcagccgccagcagcgaaaggcagagataatggaaagcatcaagcgcctttaccctggctctgtgtacggccgcctcattgacctatgccagcccacacaaaagaagtatcagattgctgtaaccaaggttttgggcaagaacatggatgccattattgtggactcggagaagacaggccgggactgtattcagtatatcaaggagcagcgtggggagcctgagaccttcttgcctcttgactacctggaggtgaagcctacagatgagaaactccgggagctgaagggggccaagctagtgattgatgtgattcgctatgagccacctcatatcaaaaaggccctgcagtatgcttgtggcaatgcccttgtctgtgacaacgtggaagatgcccgccgcattgcctttggaggccaccagcgccacaagacagtggcactggatggaaccctattccagaagtcaggagtgatctctggtggggccagtgacctgaaggccaaggcacggcgctgggatgagaaagcagtagacaagttgaaagagaagaaggagcgcttgacagaggagctgaaagagcagatgaaggcaaaacggaaagaggcagagctgcgtcaggtgcagtctcaggcccatggactgcagatgcggctcaagtactcccagagtgacctagaacagaccaagacacgacatctagccctgaatctgcaggaaaaatccaagctggagagtgagctagccaactttgggcctcgcattaatgatatcaagaggatcattcagagccgagagagggaaatgaaagacttgaaggagaagatgaaccaggtagaggatgaggtgtttgaagagttttgtcgggagattggtgtgcgcaacatccgggagtttgaggaagaaaaggtgaaacggcagaatgaaatcgccaagaagcgtttggagtttgagaatcagaagactcgcttgggcattcagttggattttgaaaagaaccaactgaaggaggaccaagataaagtacacatgtgggagcagacagtgaaaaaagatgaaaatgagatagaaaagctcaaaaaggaggaacaaagacacatgaagatcatagatgagaccatggctcagctacaagacctgaagaatcagcatctggccaagaagtcggaagtgaatgacaagaatcatgagatggaggagattcgtaagaaactcgggggcgccaacaaggaaatgacccatttacagaaggaggtgacagccattgagaccaagcttgaacagaagcgcagtgaccgtcacaacttgctacaggcctgtaagatgcaggacattaagttgccactgtcaaaaggcaccatggatgatattagtcaggaagagggtagctcccagggggaggactcagtgagtggttcacagagaatttccagtatctatgcacgagaggccctcattgagattgactacggtgatctgtgtgaggatctgaaggatgcccaggctgaggaagagatcaagcaagagatgaacacactgcagcagaagctgaatgagcagcagagtgtgcttcagcgtattgccgcccccaacatgaaggccatggaaaagctggaaagtgtccgagacaagttccaggagacctcagatgagtttgaagcagcccgaaagcgagcaaagaaggccaagcaggcattcgaacagatcaagaaggagcgctttgaccgcttcaatgcttgttttgaatctgtggctaccaacattgatgagatctataaggccctgtcccgcaatagcagtgcccaggcattcctgggccctgagaaccctgaagagccctacttggatggcatcaactacaactgtgtggctcctgggaaacgcttccggcctatggacaacttgtcaggcggggagaagacagtggcagctctggccctgctctttgccatccacagctacaagccagcccccttcttcgtcctggatgagattgatgctgccttggataacaccaacattggcaaggtggcaaattacatcaaggagcagtcgacttgcaacttccaggccatcgtcatctctctcaaggaggagttctacaccaaggccgagagcctcattggagtctatcctgagcaaggggactgtgtgatcagcaaagtcctgaccttcgacctcaccaagtacccagatgccaaccccaaccccaatgagcagtagcagtatttttgccctcccgccctgtctggatccctaagctgtccctctcccaatctctggatatttgactcccaaccttccccctacctcctggccctttttggtgtagtcatgggatttaggcactgctaatcaagcatgaagaggaacagaggtgatgttaggtctggagcaaaaattcctgaacgacagggagtattctggcctctgaaaggaggtgctgagctgaacagggccatctgttcatcacacacacccccttcctccccctcatcacccataatcgtgggccccttgggcctcttgcccactgtgtgtgtgggtatgtatgtgtgtatgtatgtatccgcatgtgtgcatgtgagtatgtttgcaaaataataaaggatattggagacctgttttagaaggagcctaggctgaatttgattccaagagagcttaggatgacagcacccctgagctgggcaaaggtactcaggacctcataggagtcttaggcagttacctgaaactgccttcattcactcatttgtgtattcattcatttatgtattcatcagacacataccgaacaccctctatttgtcaggctctgtgcttggaatacagagttgaatcagacatgatctctaccctcctagtaaggagatacagtgggttcatgaatgactatagttagctgaatgtcatatgtactttgaatttgagaagtgggtgatcccctctaggcttcctggaggtcacatttaagctagaccttgacaaattggtaggatttggtcaggcactaggagtggagcatgagctctggggacagacagttatgggttctggtcccactttttatcacttactagttgtttgaccttgggcaagtcatttgaccttctgtgcctcagtttcctcatctgtaaaatggggctaacaatattacctacctcataggatttaatgatgtcaagctcctcactggaggccttatcccttcgtggagcccactaggtgccgacccctcagaatataaccctcatgcctggacccctgagagcttctgatcccagctattagggacagaagaagcctccaaatctggaaggtgctgaatgccctgctgactgggaaagtttcagggcactgatggggtctacctggtaagcggagggcctgaggaaacctgtagcttcaatcatgtctggtaaccgggtgcctgagccccaatctgggttgtgaggaaataggggagaggtatcctgggccacatcccagcctaacacctgtgaggttcattttaggaactaacctcattagctataaggatcatgcagaggcagcaaagccgggtgcgatgagctcagcctttactcattcacatacaccatcacactttaattccaatctgtatattgctttttaaaagttaagtccattctaattacccaaatatgcatgaattcattctccttttgagaagttagattgttaaagatagtctcattcagctaccaaccactccttgatccttcccttcttagtggctgttgtttgttgtacttccgtttagactttgttttaatgcttgtacgtacatatgtgaactcattggaaatattgtgtgtttaatgcaaatgatatattgaattgtttagcaatttgttttctttgcttaacgatgtttttgagatctgtgcatgttacttaatgtagctcaatccatcttctgtaattgctgtatagattgtcatcatatgattaccacattttacttacgcatttcttttgtgatggacattaagactgtttttaggttttgctattacaaaatactacacaggagcatcactatgcctgtgtgaaagtatatgtatgaaagtttacctagggttgattcctagaagtggaattgcaaagtcataggatatttatatattggtttttaataatacttccaaattgccctcctgtactatttactcagtatttttcttgaggttgatctgaggtctaacattgttatcctatatcattttcatcccaagtagtgatatctgtgaaatcacaggtttgatgtgtgctaattatgtattcttctaatacatattaaaagacataactatcaaaacaaaataaatttgtctgttttcaaccaaagaagtcacgtaccactggtggtactgtgtgccataatttggcaaatgctggcctttatggacgagcacaattcgggggtcagacctggttcaaattctagctgtagaaacttgtgcaagttacttcacctctgagcctaagtttccacatctgtaaaaggagataataaacacctaccttgcagtagtgaagcaaagagaaaattaaatatatatgaagcaatttggctggcatctagatcattcacagccctttaaaggtcacctttgctgttctccccactttacagataaggaaactgaggcccaaaaaggtttgaacccaggtcttccaagtcattcaagtgctttctccactgtacaggtggttatcaaccttggctgcgcatcagaatcgtttgtaaagctttttctttttcctttttaaaaagtaaagcaatatatacacaggtaaaaaaataaaatagtacagaagggcttataatgagaagcagcagttccctgcttgcacccccacatccaaaggatgtggagctctttaaaaataaattgctctggtcccacctctggaaatctgattcagccagcatggataataacccagataactaacccctacctcacaggataaaaaggattacatgagatgccttaggctaaggccctggcacacaggaacacatgtgctacaaaggagctttggggacttaagtcctgaggatccaggaggtgaggtgacttgtccaagattccactggtttagtggcagagcctagacttccactcggatctatttagtgcttgccccctgctctctcctgtcgtgccccaccacctcctggcatcacagggcaaccgttgtcaaggctatgctcacgggaggctgggcaccacagtgtttccaagagcaagctggatccgagtagattccctagggcttgttggaggaactagtttgactcccttatactgtggacgcagtagccttgctgtagggagttgaagagtactccacaacagtatcttaagtttaactgggcacttccctctggaaatcacagtgttgtgcaccaggaacacaaagatgagtcaaatctttatcctgcctttgaggagctcactgtttagttggggaaaccatttgtaaaacagccattaaccatacagtgtgatcaacactgacaggagcacaggaaaaacatctagcttatgtgaagattcagagaaggcatcctgtagtctaggtggtgatacctgaactgagtcttgagggacgggtaggaattagccagttgaggaagtagaaggaatttccagatattggaaacagtatgcatgaagacatgaaggcaagaaacagcaaaacaaatactgaagcatgaagattcctggggtggggggaaagcagcaagaaaaggtagagaggaaccagattggaagagggtcgtaaatgcatggctacagaattcagatttgttttgtaggacagtgtggttcccaaactggctgtataccacaaacaggtacggcattctgggccccggcccctaaaacattcattaagtctggggtgaagatttggaatcttgaatgcttataaaggttaccacatgactagggtacagccagatttggaaaccatagcttgaaggcagtgagggagccatgaaatggtttttaatagggggactccagatcagatgtgaacttaacctgtttctggctggctagccaaccagcatggaaaacagattaggttagatgttcatgctgtatgtgcccgtgcctgtagcttccctgttaatcagcttcttacactactatatttgcttattttgtctctgaataagctttaggcaccacaagggtgggcctggggatattttgcttaccagtatagcccctgcaaaaaagcacagtgcctgacacaaaacaggcacccagtaaagtttttgaatgaatgaatgcatgagtgaatccatttgtgagagagcgaatggagatgacaagattagctaggagactggaaaaagaccaggaggcctgcactagggcaaaggccagtaggaatagattggaggtgttaaggtgtgaactgttaaggtaagatgataacttaatgactgattattggatgtggagggtgactgagaggatagaatgagtacccatgaatagccatgattcctaccctgtcccagtcatctctttccttatccatctctgaaacaatctgcttacatcctcctcagcaactggaattcctcaagttagttagacattctgtgtgctgtgtggtctctcactgcccccccactccccacccctccacaagccattgattcattcatccagttcaataaatcttggctaagcacctccagtgtgcagtaaggctcttccaagccaggactctgactccctctttcctacctcaagagatgtttttgagggctttcccaggtaagagtcacatctcttatacaataacttatagtgagatacccagaatgtcagacttgtaagggaagactgcccaaaccccttctgaggtcctcagaggggaattaacttcctaaggtccgactgctaggaagtgttggagccagaaatggaagctaggtttcctttctatgtcatctctggagtcttgatcttgatctatcccattgtagatcaggacaggcagaggtggtcagggagaaggtgggacttaggttgaaccttgaaggtcaatgtattggacaggtcaaacaagatggttgccaattacactgcccccttctggaaacccttagcaaacctgccatgcttgcagtcccttctaaggggtttccttagcataagttgccatgctctgtaccatgtgacctcacaatcctggccacagatagctagatgtggatagtgtctggttcaagggcaaccaatctctaggctggccagtggcctgttagctggactggcataaggacttcaccttacaggggtggcatgtatcaaatggcaaatgtatgaaacaaccagatctttcagggaggcagaatgtgagctattcagaagaagtgaacgttaattagaatttaatgaggcattagtggtggtggatgaggggtggccagaaactaaacagcaaaagcaaagagaaagctgcagaaaccataagtaagcagaggtcatgagacatttgtataatgagatcacggagccacagggtggcagaagccatgaagcagcaaggcaacaatgggctagaagccatgaagcaataggagccacgaggaacagaaaccgtgagacaaaactgactatgagatccacaaagcagcagaaggcttgaatagataagatcatgagacagtagaagcgatgagactgcaagaaccacaaggtagccagaaccatgtggcaacatggcaacaggaatggaagaggcagcaggagctacaatgcagaaaagccatggattaataggaactgaagcgccgggagccatgaagctgcaggacccatgaggcagaaaaagccatgggctagcatcgaggggggcagaaagaagttagtcagtagcagtaggaggagtataaatacagccagaaaggagttgagtcaccaatttgggaagcactagagaagggagcaacagatgcctgcagctgagggggtgacaagataagccaggctctagagctgctttggatcatgaaccattttcaagtttctgttcttccatgaggctgcctgtgtagctgttcttgtcttccttatttccctgtgaatgctttaataaatccccatcactaa

SEQ ID NO: 187134 - DNA, 868 bp, Homo sapiens
  Payload ID: 16842
  Gene Symbol: SMC1A
  Gene Name: structural maintenance of chromosomes 1A
  ENST ID: ENST00000428014
  CDS Start-End: 81-868
attggtacactccaactcctttctactcttctctggaggcggcacttttgaatttcagacccagcgctccagtctttagaatgcttgaggtgtcgatccccaccccccaccgctatgtcagaggtaagtcaaatctcatggatgccatcagctttgtgctaggtgaaaaaaccagcaacctgcgggtaaagaccctgcgggacctgatccatggagctcctgtgggcaagccagctgccaaccgggcctttgtcagcatggtctactctgaggagggtgctgaggaccgtacctttgcccgtgtcattgtaggaggttcttctgagtacaagatcaacaacaaagtggtccaactacatgagtacagtgaggaattagagaagttgggcattctcatcaaagctcgtaacttcctcgttttccagggtgctgtggaatctattgccatgaagaaccccaaagagaggacagctctatttgaagagattagtcgttctggggagctggcgcaggagtatgacaagcgaaagaaggaaatggtgaaggctgaagaggacacacagtttaattaccatcgcaagaaaaatattgcggctgaacgcaaggaagcaaagcaggagaaagaagaggctgaccggtaccagcgcctgaaggatgaggtagtacgggctcaggtacagctgcagctctttaagctttaccataatgaagtggaaattgagaagctcaacaaggaactggcctcaaagaacaaggagatcgagaaggacaagaagcgtatggacaaggtggaggatgaactgaaggagaagaagaaggagctgggcaaaatgatgcgggagcagcagcagattgagaaggagatcaa

SEQ ID NO: 187135 - DNA, 838 bp, Homo sapiens
  Payload ID: 16842
  Gene Symbol: SMC1A
  Gene Name: structural maintenance of chromosomes 1A
  ENST ID: ENST00000470241
  CDS Start-End: 1-838
aaatgacccatttacagaaggaggtgacagccattgagaccaagcttgaacagaagcgcagtgaccgtcacaacttgctacaggcctgtaagatgcaggacattaagttgccactgtcaaaaggcaccatggatgatattagtcaggaagagggtagctcccagggggaggactcagtgagtggttcacagagaatttccagtatctatgcacgagaggccctcattgagattgactacggtgatctgtgtgaggatctgaaggatgcccaggctgaggaagagatcaagcaagagatgaacacactgcagcagaagctgaatgagcagcagagtgtgcttcagcgtattgccgcccccaacatgaaggccatggaaaagctggaaagtgtccgagacaagttccaggagacctcagatgagtttgaagcagcccgaaagcgagcaaagaaggccaagcaggcattcgaacagatcaagaaggagcgctttgaccgcttcaatgcttgttttgaatctgtggctaccaacattgatgagatctataaggccctgtcccgcaatagcagtgcccaggcattcctgggccctgagaaccctgaagagccctacttggatggcatcaactacaactgtgtggctcctgggaaacgcttccggcctatggacaacttgtcaggcggggagaagacagtggcagctctggccctgctctttgccatccacaggtggcaaattacatcaaggagcagtcgacttgcaacttccaggccatcgtcatctctctcaaggaggagttctacaccaaggccgagagcctcattggagtctatcctgag

SEQ ID NO: 187136 - DNA, 880 bp, Homo sapiens
  Payload ID: 16842
  Gene Symbol: SMC1A
  Gene Name: structural maintenance of chromosomes 1A
  ENST ID: ENST00000463684
  CDS Start-End: 70-234
cgcgcgggctacctcagttctcgggcgtacggcgcggcctgtcctactgccgccggcgccgcggccgtcatggggttcctgaaactgattgagattgagaactttaagtcgtacaagggtcgacagattatcggaccatttcagaggttcaccgccatcattggacccaatggctctgggtgctgtggaatctattgccatgaagaaccccaaagagaggacagctctatttgaagagattagtcgttctggggagctggcgcaggagtatgacaagcgaaagaaggaaatggtgaaggctgaagaggacacacagtttaattaccatcgcaagaaaaatattgcggctgaacgcaaggaagcaaagcaggagaaagaagaggctgaccggtaccagcgcctgaaggatgaggtagtacgggctcaggtacagctgcagctctttaagctttaccataatgaagtggaaattgagaagctcaacaaggaactggcctcaaagaacaaggagatcgagaaggacaagaagcgtatggacaaggtggaggatgaactgaaggagaagaagaaggagctgggcaaaatgatgcgggagcagcagcagattgagaaggagatcaaggagaaggactcagaattgaaccagaagcggcctcagtacatcaaagccaaggagaacacctcccacaaaatcaagaagctggaagcagccaagaagtctctgcagaatgctcagaagcactacaagaagcgtaaaggtgacatggatgagctggagaaggagatgctgtcagtggagaaggctcggcaggagtttgaagaacggatggaagaagagagtcagagtcagggcagagatttgacgttggaggagaatcag

SEQ ID NO: 187137 - DNA, 4201 bp, Homo sapiens
  Payload ID: 16843
  Gene Symbol: SMC1B
  Gene Name: structural maintenance of chromosomes 1B
  Uniprot ID: Q8NDV3
  ENST ID: ENST00000357450
  CDS Start-End: 1-3708
atggcccacctggagctgctgcttgtggaaaatttcaagtcgtggcggggccgccaggtcattggccccttccggaggttcacctgcatcatcggccccaacggctctggaaaatctaatgtaatggatgcacttagttttgtaatgggagagaaaatagctaatttaagagtgaaaaatattcaagaactcattcatggagcacatattggaaaacctatttcttcttctgcaagtgtaaaaattatatatgtggaggaaagtggcgaagagaaaacatttgcaaggattatccgagggggatgctcagaatttcgctttaatgataatcttgtgagtcgttctgtttacattgcagagttggaaaagataggcataatagtcaaagcacaaaattgtttggtttttcagggaactgtagagtcaatttcagtgaagaaacccaaagaaaggacccagttttttgaggaaatcagcacttcaggagagcttataggagaatatgaagaaaagaaaagaaagttacaaaaagccgaagaggatgcacagtttaactttaataagaaaaaaaatatagcggcagagcgcagacaagcaaaattagagaaggaagaggcagaacgttaccagagtctccttgaagaactgaaaatgaacaagatacaactgcagctttttcaactataccataatgagaaaaagattcatctcctgaacaccaagttagagcatgtgaatagggatttgagtgtcaaaagagagtctttgtctcatcatgaaaacatagttaaagccaggaaaaaggaacatggaatgctaactagacaactacaacaaacagaaaaagaattaaaatcggttgaaacccttttaaatcagaagaggcctcagtacattaaagccaaagaaaacacttctcaccaccttaagaaattagatgtggctaagaaatcaataaaggacagcgaaaaacaatgttctaaacaggaagatgatataaaagccctggagacagagctggctgatttagatgctgcatggagaagttttgaaaagcagattgaggaagaaattttacataaaaagcgagacattgaactggaagccagtcagctggatcgttataaagaacttaaggaacaagtaagaaagaaagtagctacaatgactcaacaactggaaaaactgcagtgggaacagaagacagatgaagaaagactggcatttgaaaagaggaggcatggagaagttcagggaaatctaaaacaaataaaagaacaaatagaagatcataaaaaacgaatagagaagttagaggagtatacaaagacatgcatggattgcttgaaagagaaaaaacagcaagaggaaaccctagtggatgaaattgaaaaaacaaaatcaagaatgtctgaagttaatgaagaattgaatcttattagaagtgaattgcagaatgctgggattgatacccatgagggaaaacgtcagcaaaagagagcagaggttctggaacaccttaaaagactgtacccagattctgtgtttggaagactatttgacctgtgtcatcctattcataagaaataccagctggctgttactaaggtttttggccggttcatcactgccattgttgtagcctctgaaaaggtagcaaaagattgtattcgatttctgaaggaggaaagagctgaacctgagacattcctcgctctagattaccttgatatcaagccaatcaatgaaagactaagggagcttaaaggctgtaaaatggtgattgatgtcataaagactcagtttcctcagctgaagaaagtgattcagtttgtgtgtggaaatggtcttgtttgtgagactatggaagaagcaaggcatattgcactcagtggacctgaaagacagaaaacagtagctcttgatggaacattatttttaaaatctggagtgatctctggagggtcaagtgacttaaaatacaaggctagatgctgggatgagaaagagttaaagaatctaagagacagacgaagccagaaaatccaagagctaaagggtttaatgaagacactccgcaaagaaacagatttgaaacaaatacagaccctgatacagggaactcaaacacgactcaaatattcacaaaatgaactagagatgattaagaagaagcaccttgttgctttttaccaggaacaatctcagttacaaagtgaactactaaatattgagtctcaatgtattatgttgagtgaaggaatcaaggaacgacaacgaagaattaaagaatttcaagaaaagatagataaggtagaagacgatatcttccaacacttctgtgaagaaattggcgtggaaaatattcgtgaatttgagaacaaacatgttaaacggcaacaagaaattgatcaaaaaagattagaatttgaaaaacaaaaaactcggcttaatgttcaacttgagtatagtcgcagtcaccttaagaagaaactgaataagatcaacacattaaaagaaactatccagaaaggtagtgaagatattgatcacctaaagaaggctgaagaaaactgtctgcagacagtgaatgaactcatggcaaagcagcagcaacttaaggacatacgtgtcactcagaactccagtgccgagaaagttcaaactcaaattgaagaggaacggaagaagtttctggctgttgatagggaagtggggaaattgcaaaaagaagttgtaagtattcaaacttctctggaacagaaacgattagagaagcataacttgctgcttgattgcaaagtgcaagacattgagataatccttttgtcggggtcactggatgacatcattgaagtggagatgggaactgaagcagaaagtacccaggcaacaattgatatctatgaaaaagaagaagcctttgaaatagactacagctctctaaaagaggatttgaaggctctacagtctgatcaagaaatcgaggcccaccttaggctcttattgcagcaagtagcatcccaggaagatatcttactgaaaacagcagccccaaacctacgagcactggagaacttaaagactgtcagagacaagtttcaagagtccacagatgcttttgaggccagcagaaaggaagccagactgtgtaggcaagagttcgagcaagtgaaaaaaaggagatacgatcttttcacccagtgttttgagcatgtctcaatctcaattgatcaaatctacaagaagctctgcagaaacaacagcgcccaagcatttcttagcccagagaaccctgaagaaccttacttggagggaattagctataactgtgtggccccaggcaaacggtttatgccaatggacaatttgtcagggggagaaaagtgtgtggcagccttggctctcctgtttgctgtgcacagttttcgtcctgccccattctttgttttagatgaagtggatgcagccctagacaatactaacataggcaaagtgtcaagttacatcaaagagcaaactcaagaccagtttcagatgatagtcatctccctaaaagaagagttctattccagagccgacgcgctgatcggcatctatcctgagtacgatgactgcatgttcagccgagttttgaccctagatctttctcagtatccagacactgaaggccaagaaagcagcaagagacacggagagtcccgctaggggcagtcctgcagcagtcacctgatcactgttcagttcccactctaatactcacacagctcctccacaggagacttctggagcaagcaggaccagcctggtgcaccctttaagagaaaccttagtcgttctagccaaagaggctgtggctcactttagttgagtgttcagacctcattctagtagggaaagttttcagtgagagctggtgtcaaatgagtttttaaaaaacaaacaaaaggtacaattttgtactataattctaacttctattttgaaataagctagtttggttggaaaaattttgaattcagcttcatcttcactctgatcttgccttgcacccaagtaatcttgaagggaacttctcttggtttttaaacatactagttataagattgttaataaactgttgaacctggcttttgggaaattgtttcagagaaactatgttagtattgaaaatatcaataaaaaatgttctaatttcaaa

SEQ ID NO: 187138 - DNA, 3636 bp, Homo sapiens
  Payload ID: 16843
  Gene Symbol: SMC1B
  Gene Name: structural maintenance of chromosomes 1B
  Uniprot ID: Q8NDV3
  ENST ID: ENST00000404354
  CDS Start-End: 53-3538
cgctttttccgcgggcgcttgataacgcgggtgaggcgtggagggcggcgccatggcccacctggagctgctgcttgtggaaaatttcaagtcgtggcggggccgccaggtcattggccccttccggaggttcacctgcatcatcggccccaacggctctggaaaatctaatgtaatggatgcacttagttttgtaatgggagagaaaatagctaatttaagagtgaaaaatattcaagaactcattcatggagcacatattggaaaacctatttcttcttctgcaagtgtaaaaattatatatgtggaggaaagtggcgaagagaaaacatttgcaaggattatccgagggggatgctcagaatttcgctttaatgataatcttgtgagtcgttctgtttacattgcagagttggaaaagataggcataatagtcaaagcacaaaattgtttggtttttcagggaactgtagagtcaatttcagtgaagaaacccaaagaaaggacccagttttttgaggaaatcagcacttcaggagagcttataggagaatatgaagaaaagaaaagaaagttacaaaaagccgaagaggatgcacagtttaactttaataagaaaaaaaatatagcggcagagcgcagacaagcaaaattagagaaggaagaggcagaacgttaccagagtctccttgaagaactgaaaatgaacaagatacaactgcagctttttcaactataccataatgagaaaaagattcatctcctgaacaccaagttagagcatgtgaatagggatttgagtgtcaaaagagagtctttgtctcatcatgaaaacatagttaaagccaggaaaaaggaacatggaatgctaactagacaactacaacaaacagaaaaagaattaaaatcggttgaaacccttttaaatcagaagaggcctcagtacattaaagccaaagaaaacacttctcaccaccttaagaaattagatgtggctaagaaatcaataaaggacagcgaaaaacaatgttctaaacaggaagatgatataaaagccctggagacagagctggctgatttagatgctgcatggagaagttttgaaaagcagattgaggaagaaattttacataaaaagcgagacattgaactggaagccagtcagctggatcgttataaagaacttaaggaacaagtaagaaagaaagtagctacaatgactcaacaactggaaaaactgcagtgggaacagaagacagatgaagaaagactggcatttgaaaagaggaggcatggagaagttcagggaaatctaaaacaaataaaagaacaaatagaagatcataaaaaacgaatagagaagttagaggagtatacaaagacatgcatggattgcttgaaagagaaaaaacagcaagaggaaaccctagtggatgaaattgaaaaaacaaaatcaagaatgtctgaagttaatgaagaattgaatcttattagaagtgaattgcagaatgctgggattgatacccatgagggaaaacgtcagcaaaagagagcagaggttctggaacaccttaaaagactgtacccagattctgtgtttggaagactatttgacctgtgtcatcctattcataagaaataccagctggctgttactaaggtttttggccggttcatcactgccattgttgtagcctctgaaaaggtagcaaaagattgtattcgatttctgaaggaggaaagagctgaacctgagacattcctcgctctagattaccttgatatcaagccaatcaatgaaagactaagggagcttaaaggctgtaaaatggtgattgatgtcataaagactcagtttcctcagctgaagaaagtgattcagtttgtgtgtggaaatggtcttgtttgtgagactatggaagaagcaaggcatattgcactcagtggacctgaaagacagaaaacagtagctcttgatggaacattatttttaaaatctggagtgatctctggagggtcaagtgacttaaaatacaaggctagatgctgggatgagaaagagttaaagaatctaagagacagacgaagccagaaaatccaagagctaaagggtttaatgaagacactccgcaaagaaacagatttgaaacaaatacagaccctgatacagggaactcaaacacgactcaaatattcacaaaatgaactagagatgattaagaagaagcaccttgttgctttttaccaggaacaatctcagttacaaagtgaactactaaatattgagtctcaatgtattatgttgagtgaaggaatcaaggaacgacaacgaagaattaaagaatttcaagaaaagatagataaggtagaagacgatatcttccaacacttctgtgaagaaattggcgtggaaaatattcgtgaatttgagaacaaacatgttaaacggcaacaagaaattgatcaaaaaagattagaatttgaaaaacaaaaaactcggcttaatgttcaacttgagtatagtcgcagtcaccttaagaagaaactgaataagatcaacacattaaaagaaactatccagaaaggtagtgaagatattgatcacctaaagaaggctgaagaaaactgtctgcagacagtgaatgaactcatggcaaagcagcagcaacttaaggacatacgtgtcactcagaactccagtgccgagaaagttcaaactcaaattgaagaggaacggaagaagtttctggctgttgatagggaagtggggaaattgcaaaaagaagttgtaagtattcaaacttctctggaacagaaacgattagagaagcataacttgctgcttgattgcaaagtgcaagacattgagataatccttttgtcggggtcactggatgacatcattgaagtggagatgggaactgaagcagaaagtacccaggcaacaattgatatctatgaaaaagaagaagcctttgaaatagactacagctctctaaaagaggatttgaaggctctacagtctgatcaagaaatcgaggcccaccttaggctcttattgcagcaagtagcatcccaggaagatatcttactgaaaacagcagccccaaacctacgagcactggagaacttaaagactgtcagagacaagtttcaagagtccacagatgcttttgaggccagcagaaaggaagccagactgtgtaggcaagagttcgagcaagtgaaaaaaaggagatacgatcttttcacccagtgttttgagcatgtctcaatctcaattgatcaaatctacaagaagctctgcagaaacaacagcgcccaagtgtcaagttacatcaaagagcaaactcaagaccagtttcagatgatagtcatctccctaaaagaagagttctattccagagccgacgcgctgatcggcatctatcctgagtacgatgactgcatgttcagccgagttttgaccctagatctttctcagtatccagacactgaaggccaagaaagcagcaagagacacggagagtcccgctaggggcagtcctgcagcagtcacctgatcactgttcagttcccactctaatactcacacagctcctccacaggagacttctggagcaagcaggaccagcc

SEQ ID NO: 187139 - DNA, 5992 bp, Homo sapiens
  Payload ID: 16844
  Gene Symbol: SMC2
  Gene Name: structural maintenance of chromosomes 2
  Uniprot ID: O95347
  ENST ID: ENST00000286398
  CDS Start-End: 305-3898
cacaggaaataagcaatggaggtggggtcctttgctcgcgccgaaattcaaaggaataaatagttccggcgcgggtgttgagagcggtgtggcaggtgttgtagccgctatggtgaagttcgctttgtagcggccccggctagagagttgttctgttccctgcctttgtgacccggaggagcttttggggtgcgtcaagcccctggcctgaggcagcggtggtggtatttctgtttcgtacagaactggtttgtggcctgtttgattcctgtcagaggtttgctgacccaagacagtatcgaaaatgcatattaagtcaattattctagagggattcaagtcctatgctcagaggaccgaagtcaatggttttgaccccctcttcaatgctatcactggcttaaatggtagtgggaaatccaacatattggactccatctgctttttgctgggcatctccaacctgtctcaggttcgggcttctaatttacaagatttagtttacaaaaatgggcaggctggtattaccaaagcctctgtgtcaatcacttttgataattctgacaaaaagcaaagtcctttaggatttgaggttcatgatgaaatcacagtaacaaggcaggtggttattggtggtagaaataaatatttaatcaatggagtcaatgccaacaacaccagagtacaggatctcttctgttctgttggccttaatgttaacaaccctcactttctcatcatgcagggccgaattacaaaagtattgaatatgaaacctccagagattttatccatgatagaagaagcagctggaaccaggatgtatgaatacaaaaaaatagctgcacagaaaactatagaaaaaaaggaggctaagctgaaagaaattaagacgatacttgaagaagagattactccaaccattcaaaaattaaaagaggaaagatcgtcctacttggagtaccaaaaagtaatgagagaaatagaacatttgagtcgtttatatattgcttatcagtttttgctggctgaagataccaaagtacgctcagctgaggaattaaaagaaatgcaagataaagttataaagcttcaggaagaattgtctgagaatgataaaaaaataaaagcacttaatcatgaaatagaagaattggaaaaaagaaaagataaggaaactggaggtatacttcgatctttagaagatgctcttgcagaggctcagcgagttaatactaaatctcaaagcgcatttgatctcaagaagaaaaatctggcatgtgaggaaagcaaacgcaaagagctggaaaaaaatatggttgaggactcaaaaactttagcagcaaaggaaaaagaggttaaaaagataacagatggactgcatgcccttcaagaagcaagtaataaagatgctgaagctctggcagctgcacagcagcacttcaatgctgtttccgctggcctgtccagtaatgaagatggagcagaagcaactcttgctggtcaaatgatggcctgtaaaaatgatataagtaaagctcagacagaagccaaacaggctcagatgaagttgaagcatgctcaacaggaattaaagaataaacaagctgaagttaagaagatggatagtggctacaggaaggatcaagaagctctagaagctgtaaaaagacttaaagaaaaacttgaagctgaaatgaaaaagctaaattatgaagaaaataaagaggaaagccttttggaaaagcgcaggcagctgtctcgtgatattggtagattgaaagaaacatatgaagctctattagccagatttcccaatcttcgatttgcatacaaggatccagagaagaactggaatagaaattgtgtgaaaggacttgtggcttctctgattagtgtgaaagacacttctgcaaccacagctttagaattagtggctggagaacgactctacaatgttgtagtagacacagaagttactggtaaaaagctactagaaaggggggaactgaaacgtcgatacactataattccactcaataaaatttcagccagatgtattgcaccagaaactctgagagttgctcagaatcttgttggccctgacaacgttcatgtggctctttccttggttgaatataaaccagaacttcagaaagcaatggagtttgtctttggaacaacatttgtttgtgacaatatggataatgccaaaaaagtggcctttgataagaggataatgactagaactgtaactctcggaggtgatgtgtttgatcctcatgggacattgagtggaggtgctcgatcccaggcagcttccattttaaccaagtttcaagaactcaaagatgttcaggatgaactgagaatcaaagagaatgagctgcgggctctagaagaggaattagcaggtcttaaaaacactgctgaaaagtatcgccaactaaaacagcagtgggagatgaaaactgaagaggcagatttattacaaaccaagctccagcaaagctcatatcacaagcaacaagaagaattagatgcccttaaaaaaaccattgaggaaagtgaggagactttgaaaaacactaaagaaatccaaagaaaagcagaagaaaaatatgaagtattggaaaataaaatgaaaaatgcagaagctgaaagagagcgagaactgaaagatgctcagaaaaaactggattgtgccaaaacaaaggcagatgcatctagcaagaagatgaaagaaaaacaacaggaagttgaagctatcactctggaactggaagagctcaagagagagcatacatcttacaaacaacagcttgaagctgtaaatgaagctatcaaatcctatgaaagtcagattgaagtaatggcagctgaggtggctaaaaataaggagtcagtaaataaagctcaagaagaggtgaccaagcaaaaagaggtgataacagcccaagacactgtaattaaagctaaatatgcagaagtggcaaaacacaaggagcaaaacaatgattctcagcttaaaattaaggaattagaccacaacatcagcaaacataaacgggaggctgaagatggtgctgcaaaggtatccaaaatgttgaaagattatgactggattaatgcagagagacacctctttggccaacccaatagtgcctatgatttcaaaactaacaaccctaaagaagctggtcagagacttcagaagttgcaagaaatgaaggagaaactaggaagaaatgtcaatatgagagctatgaatgtattgacagaagctgaagagcgatacaatgacttgatgaagaagaagagaattgtagaaaatgacaaatccaaaattcttacaactatagaagaccttgaccagaagaaaaaccaagccctaaatattgcatggcaaaaggtgaacaaggactttgggtctattttttctactcttttgcctggtgctaatgctatgcttgcaccaccagagggtcaaactgttttggatggtctggagttcaaggttgccttgggaaatacctggaaagaaaacctaactgaacttagtggtggtcagaggtctttagtggccttgtcattaatactgtccatgcttctcttcaaacctgctccaatttatatccttgatgaggtagatgcagccttggatctttctcatacccaaaacattggacagatgctgcgtactcatttcacacattctcagttcattgtggtgtcactaaaagaaggtatgttcaacaatgcaaacgttcttttcaaaaccaagtttgtggatggtgtttctacagtagccagatttactcaatgtcaaaatggaaagatttcaaaggaagcaaaatccaaggcaaaaccacccaaaggagcacatgtggaagtttaaactacaaagttatttcttcatcttgacctgtttttttaaatgtaaacttttaaggacttgagataactaatttgtttatatacaaaaattaatgttactgtgttacttaacccatgttttctctttatataatcacttatcgcttacaaatgagcatatattcctcatctcttaactagtctaattatggtccaattattgtggttgtgattttatgcatatcatcaaatgtttttttcttatgcgggtcttttatatattagggatcctgagatacccgattctatatgtaaaagctaatatacaaaaaagcagattaaattacatgataaatgtagctgatcatcagtgtttaattgatttaattcctaaggcaatattaatgtgttttctaaagtcattcaggtaaggaagaattataaatcaggtaactggaccaacaaagggaacacatataaagctattatgcatgcatggagccgtttgaggctagttttttaaggccacaactccagacccctgatttagactgagataggaaacagatcttgaaagaatccttattttaatgatacatgaatatcatgttcctatacgcttaataattggtctctacgttttaatgatacatgaatatcatgttcctatacgcttaataattggtctctacgactttaatgtttttgtttttttaagctgtgtaagtatttttaaatcaaagcttaggaggtgtgttgcgtggtactatctgctgcaaatttatctgaagtttgttaatattttccaagatttttgtcagccttttcataatccagtcattaacaacctattggtaaacaagaatgtaggtgccagtagactaaaccaaatttatttttccctgagtctgatatatatatgtataaatataaataactcaatccatctgttccaccaaaataactcaaaagttggatgattatttgtcttccgctttccagttcaaagggatgaaattcctttagaacttgaaagatgacactagcgaacaccatgagaatactgtctacagtttttggtacgtcatcactagaacagtgaccccaaactgaatcatgaaaggtctgacatgatgtaatctgatcttccatgtgttattttggccccacatctcttcttgattttttagtcttatttccttagtgttattatcatacttcccctgatatatggccgtacttcctggccctgggcttgacatttcccacccttcattctccatacatatgagatgtcagaaaacatgcagtaattgatattatgggacacattggaaaggattgaatctggaattagttctgtccactgtggaggggagaggaaataatgctgtaaatgttgagttacagaaagtccaatgtcaaatatagtttttttgtttcctttcaaatgtattacagactgtgccaaaacagttaccaattcacactgtcaatattaaagtataccatagtatacaaattagtcagtacttgctgttaattttaatatttctgatttaacagttagttattaagtggtacttcattgctgttttagccaacgttttaaaaataatttgggagtttgactattttggcttacgtactcatttccttttctctgctaaaaatgttttgcttgtgtgcgttcctgatttttgtcttgtataatcttgatctttgaaaaccctcaaacatgtattaaattgttgtaactttttttcattagagggaagacattaaggggattggggacatttgtttcacacatctgcagtaatatgagttaactaatatttaacaagctctttctttacattagctgctgttctcatttgtatgtattgtcatatttaatcctcagagtaacctagtgaggtaaatactgttgttgtcagcatggtgtaatcgaggaattgagtgagttgagcagaaaagttaggaaacttgctcagggtgataatacagttaggagtgtcagggcccatggacaaatcttgtcagtctccagaacctaagatatactacgtcactgacagcttgaacatttgtatttattgtacagaataaattt

SEQ ID NO: 187140 - DNA, 4266 bp, Homo sapiens
  Payload ID: 16844
  Gene Symbol: SMC2
  Gene Name: structural maintenance of chromosomes 2
  Uniprot ID: O95347
  ENST ID: ENST00000374787
  CDS Start-End: 337-3930
gggggctgtagggagggggaccagtggcagagggaccttaggtgatccttagaaataaaggctagcttctgttcgaccttggagtagggcgaagaggtgtagacaggcctggagaagcgaggtaaaagcctgagtaaaagcaagaagttggagaatatgagatacatctcatctctagtaaatacttaaatgacttcccctcctcccggagtcaagcacaattcggggatgcaatgacggacgtaggtgaagacactgcgggaacttacagacaaaactggtttgtggcctgtttgattcctgtcagaggtttgctgacccaagacagtatcgaaaatgcatattaagtcaattattctagagggattcaagtcctatgctcagaggaccgaagtcaatggttttgaccccctcttcaatgctatcactggcttaaatggtagtgggaaatccaacatattggactccatctgctttttgctgggcatctccaacctgtctcaggttcgggcttctaatttacaagatttagtttacaaaaatgggcaggctggtattaccaaagcctctgtgtcaatcacttttgataattctgacaaaaagcaaagtcctttaggatttgaggttcatgatgaaatcacagtaacaaggcaggtggttattggtggtagaaataaatatttaatcaatggagtcaatgccaacaacaccagagtacaggatctcttctgttctgttggccttaatgttaacaaccctcactttctcatcatgcagggccgaattacaaaagtattgaatatgaaacctccagagattttatccatgatagaagaagcagctggaaccaggatgtatgaatacaaaaaaatagctgcacagaaaactatagaaaaaaaggaggctaagctgaaagaaattaagacgatacttgaagaagagattactccaaccattcaaaaattaaaagaggaaagatcgtcctacttggagtaccaaaaagtaatgagagaaatagaacatttgagtcgtttatatattgcttatcagtttttgctggctgaagataccaaagtacgctcagctgaggaattaaaagaaatgcaagataaagttataaagcttcaggaagaattgtctgagaatgataaaaaaataaaagcacttaatcatgaaatagaagaattggaaaaaagaaaagataaggaaactggaggtatacttcgatctttagaagatgctcttgcagaggctcagcgagttaatactaaatctcaaagcgcatttgatctcaagaagaaaaatctggcatgtgaggaaagcaaacgcaaagagctggaaaaaaatatggttgaggactcaaaaactttagcagcaaaggaaaaagaggttaaaaagataacagatggactgcatgcccttcaagaagcaagtaataaagatgctgaagctctggcagctgcacagcagcacttcaatgctgtttccgctggcctgtccagtaatgaagatggagcagaagcaactcttgctggtcaaatgatggcctgtaaaaatgatataagtaaagctcagacagaagccaaacaggctcagatgaagttgaagcatgctcaacaggaattaaagaataaacaagctgaagttaagaagatggatagtggctacaggaaggatcaagaagctctagaagctgtaaaaagacttaaagaaaaacttgaagctgaaatgaaaaagctaaattatgaagaaaataaagaggaaagccttttggaaaagcgcaggcagctgtctcgtgatattggtagattgaaagaaacatatgaagctctattagccagatttcccaatcttcgatttgcatacaaggatccagagaagaactggaatagaaattgtgtgaaaggacttgtggcttctctgattagtgtgaaagacacttctgcaaccacagctttagaattagtggctggagaacgactctacaatgttgtagtagacacagaagttactggtaaaaagctactagaaaggggggaactgaaacgtcgatacactataattccactcaataaaatttcagccagatgtattgcaccagaaactctgagagttgctcagaatcttgttggccctgacaacgttcatgtggctctttccttggttgaatataaaccagaacttcagaaagcaatggagtttgtctttggaacaacatttgtttgtgacaatatggataatgccaaaaaagtggcctttgataagaggataatgactagaactgtaactctcggaggtgatgtgtttgatcctcatgggacattgagtggaggtgctcgatcccaggcagcttccattttaaccaagtttcaagaactcaaagatgttcaggatgaactgagaatcaaagagaatgagctgcgggctctagaagaggaattagcaggtcttaaaaacactgctgaaaagtatcgccaactaaaacagcagtgggagatgaaaactgaagaggcagatttattacaaaccaagctccagcaaagctcatatcacaagcaacaagaagaattagatgcccttaaaaaaaccattgaggaaagtgaggagactttgaaaaacactaaagaaatccaaagaaaagcagaagaaaaatatgaagtattggaaaataaaatgaaaaatgcagaagctgaaagagagcgagaactgaaagatgctcagaaaaaactggattgtgccaaaacaaaggcagatgcatctagcaagaagatgaaagaaaaacaacaggaagttgaagctatcactctggaactggaagagctcaagagagagcatacatcttacaaacaacagcttgaagctgtaaatgaagctatcaaatcctatgaaagtcagattgaagtaatggcagctgaggtggctaaaaataaggagtcagtaaataaagctcaagaagaggtgaccaagcaaaaagaggtgataacagcccaagacactgtaattaaagctaaatatgcagaagtggcaaaacacaaggagcaaaacaatgattctcagcttaaaattaaggaattagaccacaacatcagcaaacataaacgggaggctgaagatggtgctgcaaaggtatccaaaatgttgaaagattatgactggattaatgcagagagacacctctttggccaacccaatagtgcctatgatttcaaaactaacaaccctaaagaagctggtcagagacttcagaagttgcaagaaatgaaggagaaactaggaagaaatgtcaatatgagagctatgaatgtattgacagaagctgaagagcgatacaatgacttgatgaagaagaagagaattgtagaaaatgacaaatccaaaattcttacaactatagaagaccttgaccagaagaaaaaccaagccctaaatattgcatggcaaaaggtgaacaaggactttgggtctattttttctactcttttgcctggtgctaatgctatgcttgcaccaccagagggtcaaactgttttggatggtctggagttcaaggttgccttgggaaatacctggaaagaaaacctaactgaacttagtggtggtcagaggtctttagtggccttgtcattaatactgtccatgcttctcttcaaacctgctccaatttatatccttgatgaggtagatgcagccttggatctttctcatacccaaaacattggacagatgctgcgtactcatttcacacattctcagttcattgtggtgtcactaaaagaaggtatgttcaacaatgcaaacgttcttttcaaaaccaagtttgtggatggtgtttctacagtagccagatttactcaatgtcaaaatggaaagatttcaaaggaagcaaaatccaaggcaaaaccacccaaaggagcacatgtggaagtttaaactacaaagttatttcttcatcttgacctgtttttttaaatgtaaacttttaaggacttgagataactaatttgtttatatacaaaaattaatgttactgtgttacttaacccatgttttctctttatataatcacttatcgcttacaaatgagcatatattcctcatctcttaactagtctaattatggtccaattattgtggttgtgattttatgcatatcatcaaatgtttttttcttatgcgggtcttttatatattagggatcctgagatacccgattctatatgtaaaagctaatatacaaaaaagcagattaaattacatgataaatgt

SEQ ID NO: 187141 - DNA, 5909 bp, Homo sapiens
  Payload ID: 16844
  Gene Symbol: SMC2
  Gene Name: structural maintenance of chromosomes 2
  Uniprot ID: O95347
  ENST ID: ENST00000374793
  CDS Start-End: 214-3807
cggcgcgggtgttgagagcggtgtggcaggtgttgtagccgctatggtgaagttcgctttgtagcggccccggctagagagttgttctgttccctgcctttgtgacccggaggagcttttggggtgcgtcaagcccctggcctgaggcagcgaactggtttgtggcctgtttgattcctgtcagaggtttgctgacccaagacagtatcgaaaatgcatattaagtcaattattctagagggattcaagtcctatgctcagaggaccgaagtcaatggttttgaccccctcttcaatgctatcactggcttaaatggtagtgggaaatccaacatattggactccatctgctttttgctgggcatctccaacctgtctcaggttcgggcttctaatttacaagatttagtttacaaaaatgggcaggctggtattaccaaagcctctgtgtcaatcacttttgataattctgacaaaaagcaaagtcctttaggatttgaggttcatgatgaaatcacagtaacaaggcaggtggttattggtggtagaaataaatatttaatcaatggagtcaatgccaacaacaccagagtacaggatctcttctgttctgttggccttaatgttaacaaccctcactttctcatcatgcagggccgaattacaaaagtattgaatatgaaacctccagagattttatccatgatagaagaagcagctggaaccaggatgtatgaatacaaaaaaatagctgcacagaaaactatagaaaaaaaggaggctaagctgaaagaaattaagacgatacttgaagaagagattactccaaccattcaaaaattaaaagaggaaagatcgtcctacttggagtaccaaaaagtaatgagagaaatagaacatttgagtcgtttatatattgcttatcagtttttgctggctgaagataccaaagtacgctcagctgaggaattaaaagaaatgcaagataaagttataaagcttcaggaagaattgtctgagaatgataaaaaaataaaagcacttaatcatgaaatagaagaattggaaaaaagaaaagataaggaaactggaggtatacttcgatctttagaagatgctcttgcagaggctcagcgagttaatactaaatctcaaagcgcatttgatctcaagaagaaaaatctggcatgtgaggaaagcaaacgcaaagagctggaaaaaaatatggttgaggactcaaaaactttagcagcaaaggaaaaagaggttaaaaagataacagatggactgcatgcccttcaagaagcaagtaataaagatgctgaagctctggcagctgcacagcagcacttcaatgctgtttccgctggcctgtccagtaatgaagatggagcagaagcaactcttgctggtcaaatgatggcctgtaaaaatgatataagtaaagctcagacagaagccaaacaggctcagatgaagttgaagcatgctcaacaggaattaaagaataaacaagctgaagttaagaagatggatagtggctacaggaaggatcaagaagctctagaagctgtaaaaagacttaaagaaaaacttgaagctgaaatgaaaaagctaaattatgaagaaaataaagaggaaagccttttggaaaagcgcaggcagctgtctcgtgatattggtagattgaaagaaacatatgaagctctattagccagatttcccaatcttcgatttgcatacaaggatccagagaagaactggaatagaaattgtgtgaaaggacttgtggcttctctgattagtgtgaaagacacttctgcaaccacagctttagaattagtggctggagaacgactctacaatgttgtagtagacacagaagttactggtaaaaagctactagaaaggggggaactgaaacgtcgatacactataattccactcaataaaatttcagccagatgtattgcaccagaaactctgagagttgctcagaatcttgttggccctgacaacgttcatgtggctctttccttggttgaatataaaccagaacttcagaaagcaatggagtttgtctttggaacaacatttgtttgtgacaatatggataatgccaaaaaagtggcctttgataagaggataatgactagaactgtaactctcggaggtgatgtgtttgatcctcatgggacattgagtggaggtgctcgatcccaggcagcttccattttaaccaagtttcaagaactcaaagatgttcaggatgaactgagaatcaaagagaatgagctgcgggctctagaagaggaattagcaggtcttaaaaacactgctgaaaagtatcgccaactaaaacagcagtgggagatgaaaactgaagaggcagatttattacaaaccaagctccagcaaagctcatatcacaagcaacaagaagaattagatgcccttaaaaaaaccattgaggaaagtgaggagactttgaaaaacactaaagaaatccaaagaaaagcagaagaaaaatatgaagtattggaaaataaaatgaaaaatgcagaagctgaaagagagcgagaactgaaagatgctcagaaaaaactggattgtgccaaaacaaaggcagatgcatctagcaagaagatgaaagaaaaacaacaggaagttgaagctatcactctggaactggaagagctcaagagagagcatacatcttacaaacaacagcttgaagctgtaaatgaagctatcaaatcctatgaaagtcagattgaagtaatggcagctgaggtggctaaaaataaggagtcagtaaataaagctcaagaagaggtgaccaagcaaaaagaggtgataacagcccaagacactgtaattaaagctaaatatgcagaagtggcaaaacacaaggagcaaaacaatgattctcagcttaaaattaaggaattagaccacaacatcagcaaacataaacgggaggctgaagatggtgctgcaaaggtatccaaaatgttgaaagattatgactggattaatgcagagagacacctctttggccaacccaatagtgcctatgatttcaaaactaacaaccctaaagaagctggtcagagacttcagaagttgcaagaaatgaaggagaaactaggaagaaatgtcaatatgagagctatgaatgtattgacagaagctgaagagcgatacaatgacttgatgaagaagaagagaattgtagaaaatgacaaatccaaaattcttacaactatagaagaccttgaccagaagaaaaaccaagccctaaatattgcatggcaaaaggtgaacaaggactttgggtctattttttctactcttttgcctggtgctaatgctatgcttgcaccaccagagggtcaaactgttttggatggtctggagttcaaggttgccttgggaaatacctggaaagaaaacctaactgaacttagtggtggtcagaggtctttagtggccttgtcattaatactgtccatgcttctcttcaaacctgctccaatttatatccttgatgaggtagatgcagccttggatctttctcatacccaaaacattggacagatgctgcgtactcatttcacacattctcagttcattgtggtgtcactaaaagaaggtatgttcaacaatgcaaacgttcttttcaaaaccaagtttgtggatggtgtttctacagtagccagatttactcaatgtcaaaatggaaagatttcaaaggaagcaaaatccaaggcaaaaccacccaaaggagcacatgtggaagtttaaactacaaagttatttcttcatcttgacctgtttttttaaatgtaaacttttaaggacttgagataactaatttgtttatatacaaaaattaatgttactgtgttacttaacccatgttttctctttatataatcacttatcgcttacaaatgagcatatattcctcatctcttaactagtctaattatggtccaattattgtggttgtgattttatgcatatcatcaaatgtttttttcttatgcgggtcttttatatattagggatcctgagatacccgattctatatgtaaaagctaatatacaaaaaagcagattaaattacatgataaatgtagctgatcatcagtgtttaattgatttaattcctaaggcaatattaatgtgttttctaaagtcattcaggtaaggaagaattataaatcaggtaactggaccaacaaagggaacacatataaagctattatgcatgcatggagccgtttgaggctagttttttaaggccacaactccagacccctgatttagactgagataggaaacagatcttgaaagaatccttattttaatgatacatgaatatcatgttcctatacgcttaataattggtctctacgttttaatgatacatgaatatcatgttcctatacgcttaataattggtctctacgactttaatgtttttgtttttttaagctgtgtaagtatttttaaatcaaagcttaggaggtgtgttgcgtggtactatctgctgcaaatttatctgaagtttgttaatattttccaagatttttgtcagccttttcataatccagtcattaacaacctattggtaaacaagaatgtaggtgccagtagactaaaccaaatttatttttccctgagtctgatatatatatgtataaatataaataactcaatccatctgttccaccaaaataactcaaaagttggatgattatttgtcttccgctttccagttcaaagggatgaaattcctttagaacttgaaagatgacactagcgaacaccatgagaatactgtctacagtttttggtacgtcatcactagaacagtgaccccaaactgaatcatgaaaggtctgacatgatgtaatctgatcttccatgtgttattttggccccacatctcttcttgattttttagtcttatttccttagtgttattatcatacttcccctgatatatggccgtacttcctggccctgggcttgacatttcccacccttcattctccatacatatgagatgtcagaaaacatgcagtaattgatattatgggacacattggaaaggattgaatctggaattagttctgtccactgtggaggggagaggaaataatgctgtaaatgttgagttacagaaagtccaatgtcaaatatagtttttttgtttcctttcaaatgtattacagactgtgccaaaacagttaccaattcacactgtcaatattaaagtataccatagtatacaaattagtcagtacttgctgttaattttaatatttctgatttaacagttagttattaagtggtacttcattgctgttttagccaacgttttaaaaataatttgggagtttgactattttggcttacgtactcatttccttttctctgctaaaaatgttttgcttgtgtgcgttcctgatttttgtcttgtataatcttgatctttgaaaaccctcaaacatgtattaaattgttgtaactttttttcattagagggaagacattaaggggattggggacatttgtttcacacatctgcagtaatatgagttaactaatatttaacaagctctttctttacattagctgctgttctcatttgtatgtattgtcatatttaatcctcagagtaacctagtgaggtaaatactgttgttgtcagcatggtgtaatcgaggaattgagtgagttgagcagaaaagttaggaaacttgctcagggtgataatacagttaggagtgtcagggcccatggacaaatcttgtcagtctccagaacctaagatatactacgtcactgacagcttgaacatttgtatttattgtacagaataaatttaagaaaaa

SEQ ID NO: 187142 - DNA, 705 bp, Homo sapiens
  Payload ID: 16844
  Gene Symbol: SMC2
  Gene Name: structural maintenance of chromosomes 2
  ENST ID: ENST00000440179
  CDS Start-End: 271-705
cgcgccgaaattcaaaggaataaatagttccggcgcgggtgttgagagcggtgtggcaggtgttgtagccgctatggtgaagttcgctttgtagcggccccggctagagagttgttctgttccctgcctttgtgacccggaggagcttttggggtggttattggtggtagaaataaatatttaatcaatggagtcaatgccaacaacaccagagtacaggatctcttctgttctgttggccttaatgttaacaaccctcactttctcatcatgcagggccgaattacaaaagtattgaatatgaaacctccagagattttatccatgatagaagaagcagctggaaccaggatgtatgaatacaaaaaaatagctgcacagaaaactatagaaaaaaaggaggctaagctgaaagaaattaagacgatacttgaagaagagattactccaaccattcaaaaattaaaagaggaaagatcgtcctacttggagtaccaaaaagtaatgagagaaatagaacatttgagtcgtttatatattgcttatcagtttttgctggctgaagataccaaagtacgctcagctgaggaattaaaagaaatgcaagataaagttataaagcttcaggaagaattgtctgagaatgataaaaaaataaaagcacttaatcatgaaatagaagaattggaaaaaagaaaagataag

SEQ ID NO: 187143 - DNA, 1408 bp, Homo sapiens
  Payload ID: 16844
  Gene Symbol: SMC2
  Gene Name: structural maintenance of chromosomes 2
  ENST ID: ENST00000493955
  CDS Start-End: 84-584
ctcagcttaaaattaaggaattagaccacaacatcagcaaacataaacgggaggctgaagatggtgctgcaaaggtatccaaaatgttgaaagattatgactggattaatgcagagagacacctctttggccaacccaatagtgcctatgatttcaaaactaacaaccctaaagaagctggtcagagacttcagaagttgcaagaaatgaaggagaaactaggaagaaatgtcaatatgagagctatgaatgtattgacagaagctgaagagcgatacaatgacttgatgaagaagaagagaattgtagaaaatgacaaatccaaaattcttacaactatagaagaccttgaccagaagaaaaaccaagccctaaatattgcatggcaaaaggtgaacaaggactttgggtctattttttctactcttttgcctggtgctaatgctatgcttgcaccaccagagggtcaaactgttttggatggtctggagttcaaggttgccttgggaaatacctggaaagaaaacctaactgaacttagtggtggtcagagacaaaaacagcagaaccatactacaggttaaaggaagttctcaggcaaaaggaaaatgataccagatggaaccttggatctacataaaggaaagaagagtgttggaaactaacatggatttggagttcagggaagtttctcctgaccttacacagtgattcagaaaatcagcatagtgatagaaacctaaaaggtctttagtggccttgtcattaatactgtccatgcttctcttcaaacctgctccaatttatatccttgatgaggtagatgcagccttggatctttctcatacccaaaacattggacagatgctgcgtactcatttcacacattctcagttcattgtggtgtcactaaaagaaggtatgttcaacaatgcaaacgttcttttcaaaaccaagtttgtggatggtgtttctacagtagccagatttactcaatgtcaaaatggaaagatttcaaaggaagcaaaatccaaggcaaaaccacccaaaggagcacatgtggaagtttaaactacaaagttatttcttcatcttgacctgtttttttaaatgtaaacttttaaggacttgagataactaatttgtttatatacaaaaattaatgttactgtgttacttaacccatgttttctctttatataatcacttatcgcttacaaatgagcatatattcctcatctcttaactagtctaattatggtccaattattgtggttgtgattttatgcatatcatcaaatgtttttttcttatgcgggtcttttatatattagggatcctgagatacccgattctatatgtaaaagctaatatacaaaaaagcagattaaattacatgataaatgta

SEQ ID NO: 187144 - DNA, 4114 bp, Homo sapiens
  Payload ID: 16845
  Gene Symbol: SMC3
  Gene Name: structural maintenance of chromosomes 3
  Uniprot ID: Q9UQE7
  ENST ID: ENST00000361804
  CDS Start-End: 127-3780
ttttgtttggctgaggggagcgagcggcgctttgggggaggggtcgcgtaggcgcctcacctgaccctgcggccgtgcggttgctgctccggggcaggtctccttccaggccaggggcccggaatcatgtacataaagcaggtgattatccagggttttcgaagttacagagatcaaacaattgtagatcccttcagttcaaaacataatgtgattgtgggcagaaatggatctggaaaaagtaactttttttatgcaattcagtttgttctcagtgatgagtttagtcatcttcgtccagaacagcggttggctttattgcatgaaggtactggtcctcgtgttatttctgcttttgtggagattatttttgataattcagacaaccggttaccaatcgataaagaggaagtttcacttcgaagagttattggtgccaaaaaggatcagtatttcttagacaagaagatggtcacgaaaaatgatgtgatgaacctccttgaaagcgctggtttttctcgaagcaatccttattatattgttaaacaaggaaagatcaaccagatggcaacagcaccagattctcagagattaaagctattaagagaagtagctggtactagagtgtatgacgaacgaaaggaagaaagcatctccttaatgaaagaaacagagggcaaacgggaaaaaatcaatgagttgttaaaatacattgaagagagattacatactctagaggaagaaaaggaagaactagctcagtatcagaagtgggataaaatgagacgagccctggaatataccatttacaatcaggaacttaacgagactcgtgccaaacttgatgagctttctgctaagcgagagactagtggagaaaaatccagacaattaagagatgctcagcaggatgcaagagataaaatggaggatatcgaacgccaagttagagaattgaaaacaaaaatttcagctatgaaagaagaaaaagaacagcttagtgctgaaagacaagagcagattaagcagaggactaagttggagcttaaagccaaggatttacaagatgaactagcaggcaatagtgaacaaaggaaacgtttattaaaagagaggcagaagctgcttgaaaaaatagaagaaaagcagaaagaactggcagaaacagaacccaaattcaacagtgtgaaagagaaagaagaacgaggaattgctagattggctcaagctacccaggaaagaacggatctttatgcaaagcagggtcgaggaagccagtttacatcaaaagaagaaagggataagtggattaaaaaggaactcaagtctttagatcaggctattaatgacaagaaaagacagattgctgctatacataaggatttggaagacactgaagcaaataaagagaaaaatctggagcagtataataaactggaccaggatcttaatgaagtcaaagctcgagtagaagaactggacagaaaatattacgaagtaaaaaataagaaagatgaactacaaagtgaaagaaactacttgtggagagaagagaatgcagaacagcaagcacttgctgctaaaagagaagatcttgaaaagaagcaacaacttcttagagcagcaacaggaaaggccattttaaatggaatagacagcataaacaaagtgctagaccacttccgtcgaaaaggaataaaccagcatgttcaaaatggctatcatggtattgtaatgaataactttgaatgtgaaccagctttctacacatgcgtggaagtcactgctggaaacaggttattttatcacattgttgattcagatgaagtcagcacgaagattttaatggagtttaataaaatgaatcttcctggagaggttacttttctgcctcttaacaagttagatgtcagggatacagcctatcctgaaaccaatgatgctattcctatgatcagcaaactgaggtacaatcccagatttgacaaagctttcaaacatgtgtttggaaagactcttatttgtcgtagcatggaagtttcaacccagctggcccgtgctttcactatggactgtattactttggaaggtgaccaagtcagccatcggggtgctctaactgggggttattatgacacaaggaagtctcgacttgaattgcaaaaagatgttagaaaagcagaagaagaactaggtgaacttgaagcaaagctcaatgaaaacctgcgcagaaatattgaaaggattaataatgaaattgatcagttgatgaaccaaatgcaacagatcgagacccagcaaaggaaatttaaagcatctagagatagcatattatcagaaatgaagatgctaaaagagaagaggcagcagtcagagaaaaccttcatgcctaagcaacgtagcttacagagtttggaggcaagcttgcatgctatggagtctaccagagagtcattgaaagcagaactgggaactgatttgctttctcaactgagtttggaagatcagaagagagtagatgcactgaatgatgagattcgtcaacttcagcaggaaaacagacagttgctaaatgaaagaattaaattagaaggtattattactcgagtagagacttatctcaatgagaatctgagaaaacgcttggaccaagtagaacaggaacttaatgagctgagagagacagaagggggtactgttctcacagccacaacatcagaacttgaagccatcaataaaagagtaaaagacactatggcacgatcagaagatttggacaattccattgataaaacagaagctggaattaaggagcttcagaagagtatggagcgctggaaaaatatggaaaaagaacatatggatgctataaatcatgatactaaagaactggaaaagatgacaaatcggcaaggcatgctattgaagaagaaagaagagtgtatgaagaaaattcgagaacttggatcacttccccaggaagcatttgaaaagtaccagacactgagcctcaaacagttgtttcgaaaacttgagcagtgcaacacagaattaaagaagtacagccatgttaacaaaaaggctttggatcagtttgtaaatttctccgagcagaaagaaaagttaataaagcgtcaagaagagttagataggggttacaaatcaatcatggaactgatgaatgtacttgaacttcggaaatatgaagctattcagttaactttcaaacaggtatctaagaacttcagtgaagtattccagaagttagtacctggtggcaaagctactttggtgatgaagaaaggagatgtggagggcagtcagtctcaagatgaaggagaagggagtggtgagagtgagaggggttctggctcacaaagcagtgtcccatcagttgaccagtttactggagttggaattagggtgtcatttacaggaaaacaaggtgaaatgagagaaatgcaacagctttcaggtggacagaaatccttggtagcccttgctctgatttttgccattcagaaatgtgacccggctccattttacttgtttgatgaaattgaccaggctctggatgctcagcacagaaaggctgtgtcagatatgattatggaacttgctgtacatgctcagtttattacaactacttttaggcctgaactgcttgagtcagctgacaaattctatggtgtaaagttcagaaataaggttagtcatattgatgtgatcacagcagagatggccaaagactttgtagaagatgataccacacatggttaattggaaaatactacctactggtttgggagatgtatatagtaatatgattctcatacccaggaactgtaaatttaaacctaaatatttggccaatagttttcagacttaaagcatcatagtccttttatatttgtctttgtattttataagatactctgtaatgtcatgtttgtactgatagtttaagaatttaatttcctgtacaactttttgtaaaatgttctgctcctattttaaatgttttgaaacatgctaaatattctttcctaattattttatcacttatactaccttttttatagcttcaattaaataatcggttttatgactaata

SEQ ID NO: 187145 - DNA, 5356 bp, Homo sapiens
  Payload ID: 16846
  Gene Symbol: SMC4
  Gene Name: structural maintenance of chromosomes 4
  Uniprot ID: Q9NTJ3
  ENST ID: ENST00000344722
  CDS Start-End: 346-4212
ccttaattagaaatgcgttagcgaatattatacgcttatactatgggcggacgggtggagagccttaaaaacaacaacaacaaactaagcagttgctcaatcgttgattgatcctcaggcacgtctagattttcccacttacataggtcttgttaagaaaccagtcctgccttcttgccactcgtgtctttcgatggctcccttcccgaagtcccgctgcctctaagcggagtgttaagcggggctctcggaagccggtggaccgagatttccccgggtggggcgggcgcggtgtagcggcccgcgggctgacttgctcccggctgtcccccggccccagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatccgggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaa

SEQ ID NO: 187146 - DNA, 5471 bp, Homo sapiens
  Payload ID: 16846
  Gene Symbol: SMC4
  Gene Name: structural maintenance of chromosomes 4
  Uniprot ID: Q9NTJ3
  ENST ID: ENST00000357388
  CDS Start-End: 452-4318
gccctcttctgaagaggcgtttctggaccactgagccccgcctcccactgtgagcggaaccctaccgtttttaaaaaaatctttttcaaaacttgccaggttgtctttccaaatatttttaataatagtgctgctgctgtagaccacagagaaaagaatccctcgctcttccttttcacttagtagaaacttctaccgcgtaggtcccgccaggagttcgcgcatgcgcaggagcgacaataagatggcggtgataatcgccgcactttttttcaaattagtggatcccagaaatcattgcgcgcatttgtaacgaatttccgttcgagtttgtattttaggcgccattttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatccgggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaagatcggaaa

SEQ ID NO: 187147 - DNA, 629 bp, Homo sapiens
  Payload ID: 16846
  Gene Symbol: SMC4
  Gene Name: structural maintenance of chromosomes 4
  ENST ID: ENST00000485867
  CDS Start-End: 159-629
ggagccgaaacaccggtaggagcggggaggtgggtactacacaaccgtctccagccttggtctgagtggactgtcctgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacag

SEQ ID NO: 187148 - DNA, 3998 bp, Homo sapiens
  Payload ID: 16846
  Gene Symbol: SMC4
  Gene Name: structural maintenance of chromosomes 4
  ENST ID: ENST00000469762
  CDS Start-End: 106-3897
attttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactag

SEQ ID NO: 187149 - DNA, 582 bp, Homo sapiens
  Payload ID: 16846
  Gene Symbol: SMC4
  Gene Name: structural maintenance of chromosomes 4
  ENST ID: ENST00000472991
  CDS Start-End: 165-582
aggcgccattttcgagtgaaggacccggagccgaaacaccggtaggagcggggaggtgggtactacacaaccgtctccagccttggtctgagtggactgtcctgcagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatg

SEQ ID NO: 187150 - DNA, 1971 bp, Homo sapiens
  Payload ID: 16846
  Gene Symbol: SMC4
  Gene Name: structural maintenance of chromosomes 4
  ENST ID: ENST00000469858
  CDS Start-End: 105-257
ttttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaaggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaa

SEQ ID NO: 187151 - DNA, 708 bp, Homo sapiens
  Payload ID: 16846
  Gene Symbol: SMC4
  Gene Name: structural maintenance of chromosomes 4
  ENST ID: ENST00000497311
  CDS Start-End: 190-708
gggcccgagaccccgcctctcggcgagcccgccctcttctgaagaggcgtttctggaccactgagccccgcctcccactgcgccattttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggat

SEQ ID NO: 187152 - DNA, 849 bp, Homo sapiens
  Payload ID: 16846
  Gene Symbol: SMC4
  Gene Name: structural maintenance of chromosomes 4
  ENST ID: ENST00000465903
  CDS Start-End: 340-849
attttaggcgccattttcgagtgaaggacccggagccgaaacaccggtaggagcggggaggtgggtactacacaaccgtctccagccttggtctgagtggactgtcctgcaggcacgtctagattttcccacttacataggtcttgttaagaaaccagtcctgccttcttgccactcgtgtctttcgatggctcccttcccgaagtcccgctgcctctaagcggagtgttaagcggggctctcggaagccggtggaccgagatttccccgggtggggcgggcgcggtgtagcggcccgcgggctgacttgctcccggctgtcccccggccccagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataag

SEQ ID NO: 187153 - DNA, 566 bp, Homo sapiens
  Payload ID: 16846
  Gene Symbol: SMC4
  Gene Name: structural maintenance of chromosomes 4
  ENST ID: ENST00000467468
  CDS Start-End: 210-566
attttcgagtgaaggacccggagccgaaacaccggtaggagcggggagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagact

SEQ ID NO: 187154 - DNA, 1553 bp, Homo sapiens
  Payload ID: 16846
  Gene Symbol: SMC4
  Gene Name: structural maintenance of chromosomes 4
  ENST ID: ENST00000489573
  CDS Start-End: 284-1553
cccggagccgaaacaccggtaggagcggggaggtgggtactacacaaccgtctccagccttggtctgagtggactgtcctgcaggtcttgttaagaaaccagtcctgccttcttgccactcgtgtctttcgatggctcccttcccgaagtcccgctgcctctaagcggagtgttaagcggggctctcggaagccggtggaccgagatttccccgggtggggcgggcgcggtgtagcggcccgcgggctgacttgctcccggctgtcccccggccccagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaa

SEQ ID NO: 187155 - DNA, 583 bp, Homo sapiens
  Payload ID: 16846
  Gene Symbol: SMC4
  Gene Name: structural maintenance of chromosomes 4
  ENST ID: ENST00000485645
  CDS Start-End: 65-583
ttttaggcgccattttcgagtgaaggacccggagccgaaacaccggtaggagcggggagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggat

SEQ ID NO: 187156 - DNA, 5033 bp, Homo sapiens
  Payload ID: 16846
  Gene Symbol: SMC4
  Gene Name: structural maintenance of chromosomes 4
  Uniprot ID: Q9NTJ3
  ENST ID: ENST00000462787
  CDS Start-End: 1160-4852
cggagccgaaacaccggtaggagcggggaggtgggtactacacaaccgtctccagccttggtctgagtggactgtcctgcaggtaaagtacttctcttcctggtcaggttgtcacgctcttacttcctgccttgtccgcgagcgcctggaaaatagaggccttgagcccgagcggcgaagtccgggcttgaagctgccgctgggagatttctcttgctgtcacccctcccccctcggccgctccccggcggcccgggctcccgcgcgcagctcccgggcgccacttttccaagctactcaaatgtctcggggaggccctgagcctcgcagatcttttctttaaaaaatcctagtctctatctggaaaagggcgtctccccctacccctcttccttctgccaacggactagtcaccgggtctcagccttcgctggtgacctttcatggtttactgtccaacgggactccgcctggggagctggagagacaaactcttgccactccaaaattagcaagcgctgccagcgtccgacttgaagttgctagtggttagtcccagccttcgcccttcgcggtccgaccgctgagaggagggagacttcgttatgccccgggccgtcaacggcgccaggagctaaagggcgggcagacgaaagcgggcggcgagtcgccagttagtcttcaccgctctggagagagttgctagccacgggatcctgacccggacacgaactcgtttctccacgtcggtgcgcgcttgcatccctggccccgaaagcgtgggaatgtccggaaatgctggcgtatgggagttccttaattagaaatgcgttagcgaatattatacgcttatactatgggcggacgggtggagagccttaaaaacaacaacaacaaactaagcagttgctcaatcgttgattgatcctcaggcacgtctagattttcccacttacataggtcttgttaagaaaccagtcctgccttcttgccactcgtgtctttcgatggctcccttcccgaagtcccgctgcctctaagcggagtgttaagcggggctctcggaagccggtggaccgagatttccccgggtggggcgggcgcggtgtagcggcccgcgggctgacttgctcccggctgtcccccggccccagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagatta

SEQ ID NO: 187157 - DNA, 821 bp, Homo sapiens
  Payload ID: 16846
  Gene Symbol: SMC4
  Gene Name: structural maintenance of chromosomes 4
  ENST ID: ENST00000490207
  CDS Start-End: 281-821
ggagccgaaacaccggtaggagcggggaggtgggtactacacaaccgtctccagccttggtctgagtggactgtcctgcaggtcttgttaagaaaccagtcctgccttcttgccactcgtgtctttcgatggctcccttcccgaagtcccgctgcctctaagcggagtgttaagcggggctctcggaagccggtggaccgagatttccccgggtggggcgggcgcggtgtagcggcccgcgggctgacttgctcccggctgtcccccggccccagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaaca

SEQ ID NO: 187158 - DNA, 5980 bp, Homo sapiens
  Payload ID: 16847
  Gene Symbol: SMC5
  Gene Name: structural maintenance of chromosomes 5
  Uniprot ID: Q8IY18
  ENST ID: ENST00000361138
  CDS Start-End: 118-3423
ggtaacagttcgcggcagttcgcgcgggagcggggcgcctgggtggatgggcgcttgggcgcctgggctgccggacggtgggaacggaagtcgctgtgggacgctgaggaagccaggatggcgactccgagcaagaagacgtcaactccaagcccccagccttccaagagagctctcccgagagacccttcgtcggaggtcccgagcaagaggaagaattcggccccgcagctgccgctgttgcagtcgtccgggcctttcgtggaaggctctatcgtccgcatctcgatggagaacttcctaacatatgatatttgtgaagtatctcctggaccccacttgaatatgatcgttggagccaatggaacagggaagtcgagcattgtgtgtgccatttgccttggtttagctggaaaacctgctttcatgggacgagcagataaggttgggttttttgtgaagagaggatgttctagaggcatggttgaaattgaattgttcagggcttctggaaatcttgtaatcacccgtgagattgatgtggcaaaaaatcagtccttttggttcatcaacaaaaaatctacaacccagaaaatagtggaagagaaagttgcagccttaaatattcaagtggggaatctttgccagtttctccctcaggacaaagttggagaatttgctaaactcagcaaaattgaactcctcgaagccactgaaaagtcaattggtcccccagaaatgcacaaatatcactgtgaactcaaaaacttaagggagaaagaaaaacagctcgagacctcatgcaaagagaaaactgagtatctacagaaaatggttcagaggaatgaaagatataaacaagatgtggagaggttctatgaacggaagcgacatttagatttaattgagatgcttgaagcaaaaaggccatgggtggaatatgaaaatgttcgtcaggaatatgaagaagtaaaactagttcgtgaccgagtgaaggaagaggtcagaaaacttaaagaagggcagattcctgtaacatgtcgaattgaagaaatggaaaacgagcgtcacaatttggaggctcgaatcaaagaaaaggcaacagatattaaggaggcatctcaaaaatgcaaacagaagcaagatgttatagaaaggaaagataaacatattgaggaacttcagcaggctttaatagtaaagcaaaatgaagagcttgaccgacagaggagaataggtaatacccgcaaaatgatagaggatttgcaaaatgaactaaagaccacggaaaactgcgagaatcttcagccccagattgatgccattacaaatgatctgagacggattcaggatgaaaaggcattatgtgaaggcgaaataattgataagcgaagagagagggaaactctagagaaggagaaaaagagtgtggacgatcatattgtacgttttgacaatcttatgaatcagaaggaagataagctaagacagagattccgtgacacgtatgatgctgttttatggctaagaaataacagagacaaatttaaacaaagagtctgtgagcccataatgctcacgatcaatatgaaagataataaaaatgccaaatatattgaaaatcatattccatcaaatgacttaagagcctttgtatttgaaagtcaagaagatatggaggttttcctcaaagaggttcgtgacaataaaaaattaagagtaaatgctgttattgctcccaagagttcatatgcagacaaagcaccttcaagatctttgaatgaacttaaacaatacggatttttctcttatttgagagaattatttgatgcacctgatcctgtaatgagttacctttgctgtcagtatcatattcatgaagttcctgtaggaactgaaaagaccagagaaagaattgaacgggtaatacaagaaacccgattaaaacagatttatacagcagaagaaaagtatgtggtgaaaacttctttttattcaaacaaagttatttctagtaacacatctctaaaagtagcgcagtttctcactgtcactgtggacctagagcagagaagacacttagaagaacagctaaaggaaattcatagaaaattgcaagcagtggattcagggttgattgccttacgtgaaacaagcaaacatctggagcacaaagacaatgaacttagacaaaagaagaaggagcttcttgagagaaaaaccaagaaaagacaactggaacaaaaaatcagttccaaactaggaagtttaaagctgatggaacaggatacttgcaatcttgaagaggaagagcgaaaagcaagtaccaaaatcaaagaaataaatgttcaaaaagcgaaacttgttaccgaattaacaaacctaataaagatttgtacttctttgcatatacaaaaagtagatttaattctccaaaatactacagtgatctctgagaagaacaaattagaatcagattatatggccgcatcttcacaactccgtcttacagagcaacatttcattgaattggatgaaaatagacagagattattgcagaaatgcaaggaacttatgaaaagagctaggcaagtatgtaacctgggtgcagagcagactcttcctcaagaataccagacacaagtacccaccattccaaatggacacaactcctcactccccatggttttccaagaccttccaaacacattggatgaaattgatgctttattaactgaagaaagatcaagagcttcctgcttcacgggactgaatcctacaattgttcaggaatatacaaaaagagaagaagaaatagaacagttaactgaggaactaaagggaaagaaagttgaactagatcaatacagggaaaacatttcacaggtaaaagaaaggtggcttaatcctttaaaagagctggtagaaaaaattaatgaaaaattcagcaatttttttagttccatgcagtgtgctggtgaagttgatctccatacagaaaatgaggaagattatgataaatatggaattcgaattagagtcaaatttcgaagtagtactcaactgcatgaattaactcctcatcatcaaagtggaggtgaaagaagtgtttctaccatgttatacttgatggcacttcaggagctaaatagatgtccattcagagtagttgatgaaatcaatcagggaatggacccaatcaatgaacggagagtgtttgaaatggttgtaaatactgcctgtaaagaaaatacatctcaatactttttcataacaccaaagctcctgcaaaatcttccttattctgaaaagatgacagttttgtttgtctacaatggccctcatatgctggaaccaaacacatggaatttaaaggctttccaaaggcggcggcgccgtattacattcactcaaccttcttaataaaagtaaagagagggaacttgggaattttttttgttaaattctgtttataagtatggctcaactgaataaaaggagattcactaaaacgaaaagcagttatttttggaaacctgcttttaaatacaaataggttgataatggaaactataatgacctttccaaaatagcagctggtagtaaaagttaagtcttcttcagtcttggttgaacttgagttcttggcactctgaccatgagtcattcagttctcatgttaaaatgtacttaatattacaaatcaaaggtacagtggaagaagggttaatcacaagaagttacttatatggtagccctgagctttaattgcagagtaactttaattacttttagagcctaaagatgactctagagcctaagtcctagtttctcccaatgttatatttaattttaaaaaattgatatgaaaatgtctaatgtatagtaataatttatgacagatctagtcatttcttcctattaaaaaagattaccttatctccagtaggaaatggaattttatgggcctttaaaagaaagttttatgaaacttgatgctataattttattggtatttcaaggggaaaaaagcactggggttcaaaaatggtagcagaactgctttgaaatgctgcaaggtggccactagatgatgcaaaatacaaccaaaagattgactgagaataaaattaggtgacaagggtttttaaagaataaccttttaaagtgtgggggcaggggttgcttttttttattttatttaaagtcaattatattttacatcttacatttctaaaagcattttataattatttttagtaagatttttcttaaaatttcatatactggtttctacaatttatatttgaaatttctcagtgttatgtaaagagtgatggaaaagcattgatttctttaaaaccgtaatgtttttagaacttaagcctatagggcctttcttacaatgttgatgtacccattatcttagaaaatctagtttaaactgttttctttcaccgcaaaagaattaaatgggaaaatcatttgtttatctctaagttatactaattagtagaaccaaacaaattatcttcttttaaaaaataaatcttataggaaaatagacagtccaaagtcatgtctttgaacagtggattggatctgtgccagtaatgacaaaattatttttttgacttgcttgcctgaataaattgaagaattgctttcagtttgggttttgtatattcttaagtagccattgaaatttatattcttaactaggtcaaaaaataatgagccataagtttatgtcctctcacttagacattttctctttaaaaaggtattttcttctttataaacattttaaaagagccttcccttcttaaactaactccagtgcatgaagtgtgaaaatattttaaaatgacatttttactaatatgagcaagtcatgtaaacattgaagaacttggtaacatattagtaaatggatattaccaaatgttttcatcgttaattactttgcgttccaccaaaatatctttactaaaatgtgcttggtgtagtttgtttattgtctaaattagtaccagtcatcttatttctgcaaaatgagtatcaatgtgaaaaagacacgtgaagattaagcatgtttgaaaataaaatggtcaattacatttcaatttacataggccaacaactgttccatactttgtttgtaaacatttaatttctctactggacaaaattaatatttggctttacattgaattttgagctgtgaagaataaattatgtatcattttagcatattaaacagtagtaagtctagcacatagtctcagccacttaaaacaaaagtttttttgtttgtttgtttgtttgtttttttgagatggagtctcactctgttgcccaggctggagtgcagtggcgtgatctcggcttactgcaacctccgcctcccgggttcaagcgattctcctgcctcagcctcccaagtaactgggacaacaggcgcgtcccaccacacccagctaattttttatacttttagtagagatggggtttcagcatattggccaggctggtctcgaactcctgaccttgtgatccacccgcctcggcctcccaaagtgctgggattataggcgtgagcccctgcacccggccaaaagttgatttttaattacataaaaatcgtaaaaacttctagtaaaaacttgatttggtgaatacagttatatttaaaaaccttaaggtgacaagcattttctatgcctaaatcttcattggtttgcctggaaagagtctctgttaaaagattttccatattcaaagtaaaaggaaagatttcttgctttctaattgtcttttggacacatgcctattttctttgaggtataaacctttagatgtgaaaaatgtaatttcattctgctattgtgtgtgcttgtgtgtgtgtaattgaaaaaactgggaaatcctgctttgttggtaataaatcaatatttttatattcttttggtgtatgtta

SEQ ID NO: 187159 - DNA, 5173 bp, Homo sapiens
  Payload ID: 16848
  Gene Symbol: SMC6
  Gene Name: structural maintenance of chromosomes 6
  Uniprot ID: Q96SB8
  ENST ID: ENST00000351948
  CDS Start-End: 211-3486
ggagggcggggcgcaggcgcggttagtaccgcggtgggcgccggggctcccgggaatctaccttctcctgcggccggcacgcggttcccagggggccagcggcggtcagccgaggtcgagacgcccgcagggtggccttagcggccggtcgtaccacggcagccccgccgatcaggttcctttgggagacttcgacttgttggcgacctgatggccaaaagaaaggaagaaaatttttcctctcctaaaaatgccaaaaggccaagacaagaagaattggaggattttgataaagatggtgacgaagacgaatgtaaaggtactactttgactgcagcagaagttggaataattgagagtattcacctaaaaaacttcatgtgtcattcaatgcttggaccttttaagtttggttctaatgtcaactttgttgttggcaacaatggaagtgggaagagtgcagtactcacagctctcatagtcggtcttggtggaagagcagttgctactaatagaggatcctctttaaaaggttttgtgaaagatggacagaactctgcagatatctcaataacattgaggaacagaggagatgatgcctttaaagccagtgtgtatggtaactctatacttatacagcaacacatcagcatagatggaagtcgatcttataaacttaaaagtgcaacaggctccgtggtttccacgaggaaagaagagctgattgcaattcttgatcattttaacatccaggtggataatccagtttctgttttaacacaagaaatgagcaagcagttcttacagtctaaaaatgaaggagacaaatacaaattcttcatgaaagcaacgcaacttgaacagatgaaggaagattattcatacattatggaaacgaaagaaagaacaaaggagcagatacatcaaggagaagagcggcttactgaactaaagcgccagtgtgtagagaaagaggaacgttttcaaagtattgctggtttaagtacaatgaagactaatttagagtccttgaaacatgaaatggcttgggcagtggtcaatgaaattgaaaaacaattgaatgccatcagagataatatcaaaattggagaagatcgtgctgctagacttgacaggaaaatggaagaacagcaggtcagacttaatgaggcagaacaaaagtacaaggatattcaagacaaactagaaaagattagtgaagagacaaatgcacgagcaccagaatgtatggcattgaaagcagatgttgttgctaagaaaagggcctataatgaagctgaggttttatataaccgatccttaaacgaatataaagcattaaagaaagatgatgagcagctttgtaaacgaattgaagagctgaaaaaaagtactgaccaatctttggaacctgaacggttggaaagacaaaaaaaaatatcttggttaaaagagagagtaaaggcctttcaaaatcaagaaaattcagtcaatcaagagatcgaacagtttcagcaagccatagaaaaggacaaagaagaacatggcaaaattaagagagaagaattagatgtgaagcatgcactgagctacaatcagaggcaactgaaagaattgaaagatagtaaaactgatcgactcaaaagatttggccctaatgttccagctcttcttgaagccatagatgatgcttatagacaaggacattttacctataaacctgtaggccctttaggagcttgcattcatcttcgggacccagaacttgctttggctattgaatcttgcttaaaagggcttctgcaggcctattgttgccataatcatgctgatgaaagggtccttcaggcactcatgaaaaggttttatttaccagggacctcacggccaccgataatagtttctgagtttcggaatgagatatatgatgtaagacacagagctgcttatcatccagactttccaacagttctgacagctttagaaatagataatgcggttgtggcaaatagcctaattgacatgagaggcatagagacagtgctactaatcaaaaataattctgtagctcgtgcagtaatgcagtcccaaaagccacccaaaaattgtagagaagcttttactgctgatggtgatcaagtttttgcaggacgttattattcatctgaaaatacaagacctaagttcctaagcagagatgtggattctgaaataagtgacttggagaatgaggttgaaaataagacggcccagatattaaatcttcagcaacatttatctgcccttgaaaaagatattaaacacaatgaggaacttcttaaaaggtgccaactacattataaagaactaaagatgaaaataagaaaaaatatttctgaaattcgggaacttgagaacatagaagaacaccagtctgtagatattgcaactttggaagatgaagctcaggaaaataaaagcaaaatgaaaatggttgaggaacatatggagcaacaaaaagaaaatatggagcatcttaaaagtctgaaaatagaagcagaaaataagtatgatgcaattaaattcaaaattaatcaactatcggagctagcagacccacttaaggatgaattaaaccttgctgattctgaagtggataaccaaaaacgagggaaacgacattatgaagaaaaacaaaaagaacacttggataccttaaataaaaagaaacgagaactggatatgaaagagaaagaactagaggagaaaatgtcacaagcaagacaaatctgcccagagcgtatagaagtagaaaaatctgcatcaattctggacaaagaaattaatcgattaaggcagaagatacaggcagaacatgctagtcatggagatcgagaggaaataatgaggcagtaccaagaagcaagagagacctatcttgatctggatagtaaagtgaggactttaaaaaagtttattaaattactgggagaaatcatggagcacagattcaagacatatcaacaatttagaaggtgtttgactttacgatgcaaattatactttgacaacttactatctcagcgggcctattgtggaaaaatgaattttgaccacaagaatgaaactctaagtatatcagttcagcctggagaaggaaataaagctgctttcaatgacatgagagccttgtctggaggtgaacgttctttctccacagtgtgttttattctttccctgtggtccatcgcagaatctcctttcagatgcctggatgaatttgatgtctacatggatatggttaataggagaattgccatggacttgatactgaagatggcagattcccagcgttttagacagtttatcttgctcacacctcaaagcatgagttcacttccatccagtaaactgataagaattctccgaatgtctgatcctgaaagaggacaaactacattgcctttcagacctgtgactcaagaagaagatgatgaccaaaggtgatttgtaacttaacatgccttgtcctgatgttgaaggatttgtgaagggaaaaaaaattctggactctttgatataataaaatgagactggaggcattctgaaatgaaagaaactcctttatatatccaaccacaatcaaacatataaataagcctggaaaaccaactacaacctgcaatttaagattactattactttaagaaaatcaatttcatagtattggttttaaatctttttaagtttttttaatacgatctatttttataggttctttttcagaagtaaaattttgtacatatatacatgtacatatctgtttagtttgggttcatttctataacattttgtaagaaaataaaagtttgagcacctgattatatttagttttgcttttccagatattacattctatagttaccaaaaatggttgaagggagggatttctcattgcagagggtggggtgcaagggaataagacacttgtacggaacactgaagctttgccaacttctacacatgccttttttgcagtcctttaactgtccaccctaccaagagcttataaccagtatcagaactggataatgacgcagtttttcactctgacctccatcatgcttgcctgatttaaaagccctcagtttgcagtccagggactgttcaggcttgtcctcagctgagaggacacaggctagagggactgtgcagaaccaggctgggagaagggctgggaaaactgggagtggagggtggatcctcatggagcaggagagtagctcatggctccaggagcctgaggccatgcagttgatggtgagctgacatcaattctaagactcatcctaattgaggggtgttaaaaagtgtgctgcttagaatgaccaaatatagttattgtaaaaaatgatatttatgaactttttattttagaaaacatgaattttattgctccctgtattatttgtttgatactaggattcatgctaaactttttaagaatgtattggatatcaagaagcattccttacattagtagcaataaatattagaataaatatgaaattgaactattttcagaaaaagggcagtatattaagagcagggactgttctctagttattgaggaaaactggactttgtttgtgtttttggtggaggaagaagtttaagatactttagtcttaaattgaggtttgccaaatgagaagttcaaaaacttgggctttctaatcagaatttccaggaggaggaaagtgtgtgctgaatattttaaacatttcccactgatcatacaaagtctgatttttaaatttacacttataatgcctttgtattaaaattatttttaacatgtgcttttccaaattaaaaatgaagtagagtataccaaatgcataaactttcattagctaaggaactcatgtctgaattttgttgtagttttgaatgttgtgctctttcatacagaatgggaaacataatcctcaggtatcccagcatctcttgttgaattgaagattattcattgctttggcctcacaaagttttgatttcaactatcataagtgaaaatatcttcctttaatgttctaagtagtgataatattactagaatgaaagaataaaaagaaattgttcttttaaaatatgtgtaacttctaaaaataaaacttaaaatttatatgta

SEQ ID NO: 187160 - DNA, 1803 bp, Homo sapiens
  Payload ID: 16848
  Gene Symbol: SMC6
  Gene Name: structural maintenance of chromosomes 6
  ENST ID: ENST00000381272
  CDS Start-End: 467-1803
tagaaaccacaatttcacaaaatcttttaccttttgtgagtttagtagtcacaacatttaggtaggcttatactgataaaatcttggctatgaatacctctgaagtaaaatcaactagtatagaatatgcagatgttaaagcaatacaaacttactatcttacgcttctgtggattagaagtccaacacagatctcactgggctaaaatccagatgtcagtagggctatgttctgttttagggcctctaggggaaaatctatttccttgccttttccagcattttttgactcatgtccctcttccttagtgcaagatgcaagactaatttactttaatttttaaggtaaaaatggatggacatagtacctaaagtttaattagccttgttagatttattttgttgagtttaatatatatggaacttgatttacctcattgttactataaatatttgttcagacctgatggccaaaagaaaggaagaaaatttttcctctcctaaaaatgccaaaaggccaagacaagaagaattggaggattttgataaagatggtgacgaagacgaatgtaaaggtactactttgactgcagcagaagttggaataattgagagtattcacctaaaaaacttcatgtgtcattcaatgcttggaccttttaagtttggttctaatgtcaactttgttgttggcaacaatggaagtgggaagagtgcagtactcacagctctcatagtcggtcttggtggaagagcagttgctactaatagaggatcctctttaaaaggttttgtgaaagatggacagaactctgcagatatctcaataacattgaggaacagaggagatgatgcctttaaagccagtgtgtatggtaactctatacttatacagcaacacatcagcatagatggaagtcgatcttataaacttaaaagtgcaacaggctccgtggtttccacgaggaaagaagagctgattgcaattcttgatcattttaacatccaggtggataatccagtttctgttttaacacaagaaatgagcaagcagttcttacagtctaaaaatgaaggagacaaatacaaattcttcatgaaagcaacgcaacttgaacagatgaaggaagattattcatacattatggaaacgaaagaaagaacaaaggagcagatacatcaaggagaagagcggcttactgaactaaagcgccagtgtgtagagaaagaggaacgttttcaaagtattgctggtttaagtacaatgaagactaatttagagtccttgaaacatgaaatggcttgggcagtggtcaatgaaattgaaaaacaattgaatgccatcagagataatatcaaaattggagaagatcgtgctgctagacttgacaggaaaatggaagaacagcaggtcagacttaatgaggcagaacaaaagtacaaggatattcaagacaaactagaaaagattagtgaagagacaaatgcacgagcaccagaatgtatggcattgaaagcagatgttgttgctaagaaaagggcctataatgaagctgaggttttatataaccgatccttaaacgaatataaagcattaaagaaagatgatgagcagctttgtaaacgaattgaagagctgaaaaaaagtactgaccaatctttggaacctgaacggttggaaagacaaaaaaaaatatcttggttaaaagagagagtaaaggcctttcaaaatcaagaaaattcagtcaatcaagagatcgaacagtttcagcaagccatagaaaaggacaaagaagaacatgg

SEQ ID NO: 187161 - DNA, 3729 bp, Homo sapiens
  Payload ID: 16848
  Gene Symbol: SMC6
  Gene Name: structural maintenance of chromosomes 6
  Uniprot ID: Q96SB8
  ENST ID: ENST00000402989
  CDS Start-End: 402-3677
tagctcaaaatgttctaaagataaaatctaatgatttcttataggaaggctaggcttggtgggtacaagtaagaaagccaagcagagagaagcttcctggtccttctccacctttccctttcctccagtctggactttgccttctccacctccttggaagacaggctgctcatcccattgtggtgtctcggctggtgtatgttttctgcctaggcttaatggacagcacgaggaggtagggactgacgttacccatgttttacagtggaagaacctgaggcttaaagagatggagtttcgctcttcttgcccaggctagagtgcaatggcacggtctcagctcactgcaacctccgcctcccgggttcaagtgattctcttgtctcagcctcccaaacctgatggccaaaagaaaggaagaaaatttttcctctcctaaaaatgccaaaaggccaagacaagaagaattggaggattttgataaagatggtgacgaagacgaatgtaaaggtactactttgactgcagcagaagttggaataattgagagtattcacctaaaaaacttcatgtgtcattcaatgcttggaccttttaagtttggttctaatgtcaactttgttgttggcaacaatggaagtgggaagagtgcagtactcacagctctcatagtcggtcttggtggaagagcagttgctactaatagaggatcctctttaaaaggttttgtgaaagatggacagaactctgcagatatctcaataacattgaggaacagaggagatgatgcctttaaagccagtgtgtatggtaactctatacttatacagcaacacatcagcatagatggaagtcgatcttataaacttaaaagtgcaacaggctccgtggtttccacgaggaaagaagagctgattgcaattcttgatcattttaacatccaggtggataatccagtttctgttttaacacaagaaatgagcaagcagttcttacagtctaaaaatgaaggagacaaatacaaattcttcatgaaagcaacgcaacttgaacagatgaaggaagattattcatacattatggaaacgaaagaaagaacaaaggagcagatacatcaaggagaagagcggcttactgaactaaagcgccagtgtgtagagaaagaggaacgttttcaaagtattgctggtttaagtacaatgaagactaatttagagtccttgaaacatgaaatggcttgggcagtggtcaatgaaattgaaaaacaattgaatgccatcagagataatatcaaaattggagaagatcgtgctgctagacttgacaggaaaatggaagaacagcaggtcagacttaatgaggcagaacaaaagtacaaggatattcaagacaaactagaaaagattagtgaagagacaaatgcacgagcaccagaatgtatggcattgaaagcagatgttgttgctaagaaaagggcctataatgaagctgaggttttatataaccgatccttaaacgaatataaagcattaaagaaagatgatgagcagctttgtaaacgaattgaagagctgaaaaaaagtactgaccaatctttggaacctgaacggttggaaagacaaaaaaaaatatcttggttaaaagagagagtaaaggcctttcaaaatcaagaaaattcagtcaatcaagagatcgaacagtttcagcaagccatagaaaaggacaaagaagaacatggcaaaattaagagagaagaattagatgtgaagcatgcactgagctacaatcagaggcaactgaaagaattgaaagatagtaaaactgatcgactcaaaagatttggccctaatgttccagctcttcttgaagccatagatgatgcttatagacaaggacattttacctataaacctgtaggccctttaggagcttgcattcatcttcgggacccagaacttgctttggctattgaatcttgcttaaaagggcttctgcaggcctattgttgccataatcatgctgatgaaagggtccttcaggcactcatgaaaaggttttatttaccagggacctcacggccaccgataatagtttctgagtttcggaatgagatatatgatgtaagacacagagctgcttatcatccagactttccaacagttctgacagctttagaaatagataatgcggttgtggcaaatagcctaattgacatgagaggcatagagacagtgctactaatcaaaaataattctgtagctcgtgcagtaatgcagtcccaaaagccacccaaaaattgtagagaagcttttactgctgatggtgatcaagtttttgcaggacgttattattcatctgaaaatacaagacctaagttcctaagcagagatgtggattctgaaataagtgacttggagaatgaggttgaaaataagacggcccagatattaaatcttcagcaacatttatctgcccttgaaaaagatattaaacacaatgaggaacttcttaaaaggtgccaactacattataaagaactaaagatgaaaataagaaaaaatatttctgaaattcgggaacttgagaacatagaagaacaccagtctgtagatattgcaactttggaagatgaagctcaggaaaataaaagcaaaatgaaaatggttgaggaacatatggagcaacaaaaagaaaatatggagcatcttaaaagtctgaaaatagaagcagaaaataagtatgatgcaattaaattcaaaattaatcaactatcggagctagcagacccacttaaggatgaattaaaccttgctgattctgaagtggataaccaaaaacgagggaaacgacattatgaagaaaaacaaaaagaacacttggataccttaaataaaaagaaacgagaactggatatgaaagagaaagaactagaggagaaaatgtcacaagcaagacaaatctgcccagagcgtatagaagtagaaaaatctgcatcaattctggacaaagaaattaatcgattaaggcagaagatacaggcagaacatgctagtcatggagatcgagaggaaataatgaggcagtaccaagaagcaagagagacctatcttgatctggatagtaaagtgaggactttaaaaaagtttattaaattactgggagaaatcatggagcacagattcaagacatatcaacaatttagaaggtgtttgactttacgatgcaaattatactttgacaacttactatctcagcgggcctattgtggaaaaatgaattttgaccacaagaatgaaactctaagtatatcagttcagcctggagaaggaaataaagctgctttcaatgacatgagagccttgtctggaggtgaacgttctttctccacagtgtgttttattctttccctgtggtccatcgcagaatctcctttcagatgcctggatgaatttgatgtctacatggatatggttaataggagaattgccatggacttgatactgaagatggcagattcccagcgttttagacagtttatcttgctcacacctcaaagcatgagttcacttccatccagtaaactgataagaattctccgaatgtctgatcctgaaagaggacaaactacattgcctttcagacctgtgactcaagaagaagatgatgaccaaaggtgatttgtaacttaacatgccttgtcctgatgttgaaggatttgtgaagggaaaa

SEQ ID NO: 187162 - DNA, 5233 bp, Homo sapiens
  Payload ID: 16848
  Gene Symbol: SMC6
  Gene Name: structural maintenance of chromosomes 6
  Uniprot ID: Q96SB8
  ENST ID: ENST00000448223
  CDS Start-End: 271-3546
accgcggtgggcgccggggctcccgggaatctaccttctcctgcggccggcacgcggttcccagggggccagcggcggtcagccgaggtcgagacgcccgcagggtggccttagcggccggtcgtaccacggcagccccgccgatcaggttcctttgggagacttcgacttgttggcgaaatgaaccggagaagaatcccaattgggaattgcggaaaacaggactctagggtagagaaaggttgtagaaccaatagggtttgagacctgatggccaaaagaaaggaagaaaatttttcctctcctaaaaatgccaaaaggccaagacaagaagaattggaggattttgataaagatggtgacgaagacgaatgtaaaggtactactttgactgcagcagaagttggaataattgagagtattcacctaaaaaacttcatgtgtcattcaatgcttggaccttttaagtttggttctaatgtcaactttgttgttggcaacaatggaagtgggaagagtgcagtactcacagctctcatagtcggtcttggtggaagagcagttgctactaatagaggatcctctttaaaaggttttgtgaaagatggacagaactctgcagatatctcaataacattgaggaacagaggagatgatgcctttaaagccagtgtgtatggtaactctatacttatacagcaacacatcagcatagatggaagtcgatcttataaacttaaaagtgcaacaggctccgtggtttccacgaggaaagaagagctgattgcaattcttgatcattttaacatccaggtggataatccagtttctgttttaacacaagaaatgagcaagcagttcttacagtctaaaaatgaaggagacaaatacaaattcttcatgaaagcaacgcaacttgaacagatgaaggaagattattcatacattatggaaacgaaagaaagaacaaaggagcagatacatcaaggagaagagcggcttactgaactaaagcgccagtgtgtagagaaagaggaacgttttcaaagtattgctggtttaagtacaatgaagactaatttagagtccttgaaacatgaaatggcttgggcagtggtcaatgaaattgaaaaacaattgaatgccatcagagataatatcaaaattggagaagatcgtgctgctagacttgacaggaaaatggaagaacagcaggtcagacttaatgaggcagaacaaaagtacaaggatattcaagacaaactagaaaagattagtgaagagacaaatgcacgagcaccagaatgtatggcattgaaagcagatgttgttgctaagaaaagggcctataatgaagctgaggttttatataaccgatccttaaacgaatataaagcattaaagaaagatgatgagcagctttgtaaacgaattgaagagctgaaaaaaagtactgaccaatctttggaacctgaacggttggaaagacaaaaaaaaatatcttggttaaaagagagagtaaaggcctttcaaaatcaagaaaattcagtcaatcaagagatcgaacagtttcagcaagccatagaaaaggacaaagaagaacatggcaaaattaagagagaagaattagatgtgaagcatgcactgagctacaatcagaggcaactgaaagaattgaaagatagtaaaactgatcgactcaaaagatttggccctaatgttccagctcttcttgaagccatagatgatgcttatagacaaggacattttacctataaacctgtaggccctttaggagcttgcattcatcttcgggacccagaacttgctttggctattgaatcttgcttaaaagggcttctgcaggcctattgttgccataatcatgctgatgaaagggtccttcaggcactcatgaaaaggttttatttaccagggacctcacggccaccgataatagtttctgagtttcggaatgagatatatgatgtaagacacagagctgcttatcatccagactttccaacagttctgacagctttagaaatagataatgcggttgtggcaaatagcctaattgacatgagaggcatagagacagtgctactaatcaaaaataattctgtagctcgtgcagtaatgcagtcccaaaagccacccaaaaattgtagagaagcttttactgctgatggtgatcaagtttttgcaggacgttattattcatctgaaaatacaagacctaagttcctaagcagagatgtggattctgaaataagtgacttggagaatgaggttgaaaataagacggcccagatattaaatcttcagcaacatttatctgcccttgaaaaagatattaaacacaatgaggaacttcttaaaaggtgccaactacattataaagaactaaagatgaaaataagaaaaaatatttctgaaattcgggaacttgagaacatagaagaacaccagtctgtagatattgcaactttggaagatgaagctcaggaaaataaaagcaaaatgaaaatggttgaggaacatatggagcaacaaaaagaaaatatggagcatcttaaaagtctgaaaatagaagcagaaaataagtatgatgcaattaaattcaaaattaatcaactatcggagctagcagacccacttaaggatgaattaaaccttgctgattctgaagtggataaccaaaaacgagggaaacgacattatgaagaaaaacaaaaagaacacttggataccttaaataaaaagaaacgagaactggatatgaaagagaaagaactagaggagaaaatgtcacaagcaagacaaatctgcccagagcgtatagaagtagaaaaatctgcatcaattctggacaaagaaattaatcgattaaggcagaagatacaggcagaacatgctagtcatggagatcgagaggaaataatgaggcagtaccaagaagcaagagagacctatcttgatctggatagtaaagtgaggactttaaaaaagtttattaaattactgggagaaatcatggagcacagattcaagacatatcaacaatttagaaggtgtttgactttacgatgcaaattatactttgacaacttactatctcagcgggcctattgtggaaaaatgaattttgaccacaagaatgaaactctaagtatatcagttcagcctggagaaggaaataaagctgctttcaatgacatgagagccttgtctggaggtgaacgttctttctccacagtgtgttttattctttccctgtggtccatcgcagaatctcctttcagatgcctggatgaatttgatgtctacatggatatggttaataggagaattgccatggacttgatactgaagatggcagattcccagcgttttagacagtttatcttgctcacacctcaaagcatgagttcacttccatccagtaaactgataagaattctccgaatgtctgatcctgaaagaggacaaactacattgcctttcagacctgtgactcaagaagaagatgatgaccaaaggtgatttgtaacttaacatgccttgtcctgatgttgaaggatttgtgaagggaaaaaaaattctggactctttgatataataaaatgagactggaggcattctgaaatgaaagaaactcctttatatatccaaccacaatcaaacatataaataagcctggaaaaccaactacaacctgcaatttaagattactattactttaagaaaatcaatttcatagtattggttttaaatctttttaagtttttttaatacgatctatttttataggttctttttcagaagtaaaattttgtacatatatacatgtacatatctgtttagtttgggttcatttctataacattttgtaagaaaataaaagtttgagcacctgattatatttagttttgcttttccagatattacattctatagttaccaaaaatggttgaagggagggatttctcattgcagagggtggggtgcaagggaataagacacttgtacggaacactgaagctttgccaacttctacacatgccttttttgcagtcctttaactgtccaccctaccaagagcttataaccagtatcagaactggataatgacgcagtttttcactctgacctccatcatgcttgcctgatttaaaagccctcagtttgcagtccagggactgttcaggcttgtcctcagctgagaggacacaggctagagggactgtgcagaaccaggctgggagaagggctgggaaaactgggagtggagggtggatcctcatggagcaggagagtagctcatggctccaggagcctgaggccatgcagttgatggtgagctgacatcaattctaagactcatcctaattgaggggtgttaaaaagtgtgctgcttagaatgaccaaatatagttattgtaaaaaatgatatttatgaactttttattttagaaaacatgaattttattgctccctgtattatttgtttgatactaggattcatgctaaactttttaagaatgtattggatatcaagaagcattccttacattagtagcaataaatattagaataaatatgaaattgaactattttcagaaaaagggcagtatattaagagcagggactgttctctagttattgaggaaaactggactttgtttgtgtttttggtggaggaagaagtttaagatactttagtcttaaattgaggtttgccaaatgagaagttcaaaaacttgggctttctaatcagaatttccaggaggaggaaagtgtgtgctgaatattttaaacatttcccactgatcatacaaagtctgatttttaaatttacacttataatgcctttgtattaaaattatttttaacatgtgcttttccaaattaaaaatgaagtagagtataccaaatgcataaactttcattagctaaggaactcatgtctgaattttgttgtagttttgaatgttgtgctctttcatacagaatgggaaacataatcctcaggtatcccagcatctcttgttgaattgaagattattcattgctttggcctcacaaagttttgatttcaactatcataagtgaaaatatcttcctttaatgttctaagtagtgataatattactagaatgaaagaataaaaagaaattgttcttttaaaatatgtgtaacttctaaaaataaaacttaaaatttatatgta

SEQ ID NO: 187163 - DNA, 2460 bp, Homo sapiens
  Payload ID: 16848
  Gene Symbol: SMC6
  Gene Name: structural maintenance of chromosomes 6
  ENST ID: ENST00000446852
  CDS Start-End: 241-2460
ctaccttctcctgcggccggcacgcggttcccagggggccagcggcggtcagccgaggtcgagacgcccgcagggtggccttagcggccggtcgtaccacggcagccccgccgatcaggttcctttgggagacttcgacttgttggcgaaatgaaccggagaagaatcccaattgggaattgcggaaaacaggactctagggtagagaaaggttgtagaaccaatagggtttgagacctgatggccaaaagaaaggaagaaaatttttcctctcctaaaaatgccaaaaggccaagacaagaagaattggaggattttgataaagatggtgacgaagacgaatgtaaaggtactactttgactgcagcagaagttggaataattgagagtattcacctaaaaaacttcatgtgtcattcaatgcttggaccttttaagtttggttctaatgtcaactttgttgttggcaacaatggaagttggagtgcagtggtgcgatctcggctcaatgcaacctctgcctcccaggttcaagcgattctcctgtttcagccttgtgggaagagtgcagtactcacagctctcatagtcggtcttggtggaagagcagttgctactaatagaggatcctctttaaaaggttttgtgaaagatggacagaactctgcagatatctcaataacattgaggaacagaggagatgatgcctttaaagccagtgtgtatggtaactctatacttatacagcaacacatcagcatagatggaagtcgatcttataaacttaaaagtgcaacaggctccgtggtttccacgaggaaagaagagctgattgcaattcttgatcattttaacatccaggtggataatccagtttctgttttaacacaagaaatgagcaagcagttcttacagtctaaaaatgaaggagacaaatacaaattcttcatgaaagcaacgcaacttgaacagatgaaggaagattattcatacattatggaaacgaaagaaagaacaaaggagcagatacatcaaggagaagagcggcttactgaactaaagcgccagtgtgtagagaaagaggaacgttttcaaagtattgctggtttaagtacaatgaagactaatttagagtccttgaaacatgaaatggcttgggcagtggtcaatgaaattgaaaaacaattgaatgccatcagagataatatcaaaattggagaagatcgtgctgctagacttgacaggaaaatggaagaacagcaggtcagacttaatgaggcagaacaaaagtacaaggatattcaagacaaactagaaaagattagtgaagagacaaatgcacgagcaccagaatgtatggcattgaaagcagatgttgttgctaagaaaagggcctataatgaagctgaggttttatataaccgatccttaaacgaatataaagcattaaagaaagatgatgagcagctttgtaaacgaattgaagagctgaaaaaaagtactgaccaatctttggaacctgaacggttggaaagacaaaaaaaaatatcttggttaaaagagagagtaaaggcctttcaaaatcaagaaaattcagtcaatcaagagatcgaacagtttcagcaagccatagaaaaggacaaagaagaacatggcaaaattaagagagaagaattagatgtgaagcatgcactgagctacaatcagaggcaactgaaagaattgaaagatagtaaaactgatcgactcaaaagatttggccctaatgttccagctcttcttgaagccatagatgatgcttatagacaaggacattttacctataaacctgtaggccctttaggagcttgcattcatcttcgggacccagaacttgctttggctattgaatcttgcttaaaagggcttctgcaggcctattgttgccataatcatgctgatgaaagggtccttcaggcactcatgaaaaggttttatttaccagggacctcacggccaccgataatagtttctgagtttcggaatgagatatatgatgtaagacacagagctgcttatcatccagactttccaacagttctgacagctttagaaatagataatgcggttgtggcaaatagcctaattgacatgagaggcatagagacagtgctactaatcaaaaataattctgtagctcgtgcagtaatgcagtcccaaaagccacccaaaaattgtagagaagcttttactgctgatggtgatcaagtttttgcaggacgttattattcatctgaaaatacaagacctaagttcctaagcagagatgtggattctgaaataagtgacttggagaatgaggttgaaaataagacggcccagatattaaatcttcagcaacatttatctgcccttgaaaaagatattaaacacaatgaggaacttcttaaaaggtgccaactacattataaagaactaaag

SEQ ID NO: 187164 - DNA, 480 bp, Homo sapiens
  Payload ID: 16848
  Gene Symbol: SMC6
  Gene Name: structural maintenance of chromosomes 6
  ENST ID: ENST00000430591
  CDS Start-End: 1-69
tatgatgtaagacacaggaccaaagagaatagtcctggccattctggtggggcctgctctgtgaactgacacaaagactctgaagaagagtgcctggcactgccttgctggcacattgtgtgtcccagcctgtgcttctaatcacttagccacgaaacacatgtgacaaaggatccagtgtatgtgtcataatgccagttttcttggaagtagagctgcttatcatccagactttccaacagttctgacagctttagaaatagataatgcggttgtggcaaatagcctaattgacatgagaggcatagagacagtgctactaatcaaaaataattctgtagctcgtgcagtaatgcagtcccaaaagccacccaaaaattgtagagaagcttttactgctgatggtgatcaagtttttgcaggacgttattattcatctgaaaatacaagacctaagttcctaagcagagatgtggattc

SEQ ID NO: 187165 - DNA, 544 bp, Homo sapiens
  Payload ID: 16848
  Gene Symbol: SMC6
  Gene Name: structural maintenance of chromosomes 6
  ENST ID: ENST00000428868
  CDS Start-End: 374-544
gataatgactgtgcctgtatgtatggacacgatgttctttcttctcatagctcaaaatgttctaaagataaaatctaatgatttcttataggaaggctaggcttggtgggtacaagtaagaaagccaagcagagagaagcttcctggtccttctccacctttccctttcctccagtctggactttgccttctccacctccttggaagacaggctgctcatcccattgtggtgtctcggctggtgtatgttttctgcctaggatggagtttcgctcttcttgcccaggctagagtgcaatggcacggtctcagctcactgcaacctccgcctcccgggttcaagtgattctcttgtctcagcctcccaaacctgatggccaaaagaaaggaagaaaatttttcctctcctaaaaatgccaaaaggccaagacaagaagaattggaggattttgataaagatggtgacgaagacgaatgtaaaggtactactttgactgcagcagaagttggaataattgagagtattcacctaaaaaacttcatg

SEQ ID NO: 187166 - DNA, 500 bp, Homo sapiens
  Payload ID: 16848
  Gene Symbol: SMC6
  Gene Name: structural maintenance of chromosomes 6
  ENST ID: ENST00000621152
  CDS Start-End: 273-500
gagggcggggcgcaggcgcggttagtaccgcggtgggcgccggggctcccgggaatctaccttctcctgcggccggcacgcggttcccagggggccagcggcggtcagccgaggtcgagacgcccgcagggtggccttagcggccggtcgtaccacggcagccccgccgatcaggttcctttgggagacttcgacttgttggcgaaatgaaccggagaagaatcccaattgggaattgcggaaaacaggactctagggtagagaaagacctgatggccaaaagaaaggaagaaaatttttcctctcctaaaaatgccaaaaggccaagacaagaagaattggaggattttgataaagatggtgacgaagacgaatgtaaaggtactactttgactgcagcagaagttggaataattgagagtattcacctaaaaaacttcatgtgtcattcaatgcttggaccttttaagtttggttctaatgtcaactttgttgttggc

SEQ ID NO: 187167 - DNA, 8821 bp, Homo sapiens
  Payload ID: 16849
  Gene Symbol: SMCHD1
  Gene Name: structural maintenance of chromosomes flexible hinge domain containing 1
  Uniprot ID: A6NHR9
  ENST ID: ENST00000320876
  CDS Start-End: 339-6356
gcggcgctggtcgcgggtcgcaccgtgaggctcgcgtgggcggcgataggcgctgggcccgggcccggtgaggagcgcgccgcgcgtccccttctcctcaggagtggcgggccgcggaagtgacgtggtgcacgggcaggagcgcgtttgaatcggttcccgggtgatcctcgcgcctgccgctgctcggccgccgccgctgacgaggagctgcagcgcgccgggccgaggcctcgagccgccccgggagctggagctgaaggcgccgcgcggagcgcgcacctcagccctgagcccggcggcggcaggcgtcgctgtcttttctccttttccccaatatggcagcggcggacggcggcgggcctggtggggcctctgtggggactgaggaggatggcggaggcgtcggccacaggacggtgtacttgtttgatcggcgcgaaaaggagtccgagctcggggaccggcctctgcaggtcggggagcgctcggactacgcgggatttcgcgcgtgtgtgtgtcagacacttggcatttcacctgaagaaaaatttgttattacaacaacaagtaggaaagaaattacctgtgataattttgatgaaactgttaaagatggagtcaccttatacctgctacagtcggtcaatcagttactactgacagctacgaaagaacgaattgacttcttacctcactatgacacactggttaaaagtggcatgtatgaatattatgccagtgaaggacaaaatcctttgccatttgctcttgcggaattaattgacaattcattgtctgctacttctcgtaacattggggttagaagaatacagatcaaattgctttttgatgaaacacaaggaaaacctgctgttgcagtgatagataatggaagaggaatgacctctaaacagcttaacaactgggccgtgtataggttgtcaaaattcacaaggcaaggtgactttgaaagtgatcattcaggatatgttcgtccagtaccagtgccacgcagtttaaatagtgatatttcctattttggtgttgggggcaagcaagctgtcttctttgttggacaatcagccagaatgataagcaaacctgcagattcccaagatgttcacgagcttgtgctttctaaagaagattttgagaagaaggagaaaaataaagaggcaatatatagtggatatattagaaacagaaagccctctgattctgttcacattacaaatgatgatgaaagatttctacatcatcttatcatagaggagaaggaaaaagatagctttactgctgtggttatcacaggggtacaaccagaacacatacagtacttgaaaaattatttccacctttggacacgacagttagcgcatatttatcactactatattcatggcccaaaaggaaatgaaatacgaacatcaaaagaagttgaacctttcaacaatattgatattgaaatttctatgtttgaaaaagggaaggtacctaagattgtcaacctaagggaaatacaagacgacatgcagacgttgtatgtaaacacagcagctgatagttttgaattcaaagctcatgttgaaggagatggtgtagtggaagggattatccgttatcatccattcttatatgatagagaaacttaccctgatgatccatgctttccatcaaaattaaaagatgaagatgatgaagatgattgtttcatacttgagaaagcagctagagggaaaaggcctatttttgaatgtttttggaatggacgattaataccatatacatcagttgaagactttgactggtgtactcctcctaagaagagagggcttgcaccaattgaatgctacaataggatatctggtgcattattcactaatgacaaattccaggtcagcacaaataaattgacgtttatggatcttgagctaaaattgaaagataagaacaccctttttacaaggattttaaatggacaggaacagcgaatgaaaattgacagagaatttgctttgtggctgaaggactgtcatgagaagtatgataaacaaataaaatttacactttttaagggagtaattacacgtcctgatcttccttctaaaaagcaaggtccctgggcaacatatgcagcaatagaatgggatggaaagatatacaaagcaggacagctggtcaagacaatcaagacacttcccctcttttatggaagcatagtaagattttttctttatggcgatcatgatggagaagtatatgctacaggaggagaggttcaaattgcaatggaacctcaggcactatatgatgaagtaagaactgtgccaattgcaaagctggataggacagttgctgagaaagctgttaaaaaatatgtagaagatgaaatggcaaggctccctgatagattgtcagtaacttggcctgaaggagatgaattattgcctaatgaggttaggcctgctggaacccctattggtgcgttaagaattgaaatactgaataaaaaaggggaagcaatgcaaaagcttccaggaacaagccatggagggtcaaagaaactcctggttgagctcaaagttattttacattcttcaagtggaaataaagagattatttcgcatattagtcaacatggaggaaaatggccttactggtttaaaaaaatggaaaatattcagaagttggggaattataccttgaaattacaagttgtgttgaatgaaagtaatgcagacacttatgcaggaagaccactaccatctaaagcaattaagttttctgttaaagagggtaagccagagaaattttcatttggtcttctggatcttccttttcgtgttggagttccatttaatatccctctggagtttcaggatgaatttggtcataccagtcaactagtaactgatattcagccagttcttgaagcaagtggtttatctttacattatgaagaaataaccaaaggaccaaattgtgtaattcgaggtgttacagccaagggccctgtaaactcttgtcaaggcaagaattataatctgaaggttactctgcctggcttaaaagaagactcacagattttgaaaattagattactacctggtcaccctcgtcgactgaaagtgaaacctgattctgaaattttagttatagaaaatggaacagctttcccatttcaggtggaagttttagatgaatcagacaacataacagcacaaccaaaattgattgttcattgtaagttttcaggtgctccaaaccttccagtctatgttgtagattgcagtagttctggaaccagtattttaacaggatctgcaattcaagttcagaatattaaaaaagaccagacgcttaaagcaagaattgaaatacctagttgtaaagatgtggcacctgtggagaagactattaagttgcttcccagtagccatgttgcaagactacaaatattcagtgtagaaggacaaaaggcaattcagatcaaacatcaggatgaggttaattggatagcgggtgatattatgcataatcttatttttcaaatgtatgatgaaggagaaagagaaatcaatataacatcagctttagcagaaaaaattaaagttaattggactcctgagattaacaaagaacacttgctacagggtctgcttcctgatgtgcaagtaccaacatctgtaaaagatatgcgctattgccaggtttcattccaagatgatcatgtgtctttggaaagtgcgtttacagtaagaccacttcctgatgaacctaaacatttaaaatgtgaaatgaaaggaggaaaaacagtacagatgggccaagagcttcaaggagaagtagttataataattacagatcagtacggaaatcagattcaagcattttcaccaagttctttatcttctttgtcaattgctggggttggacttgatagctcaaatttgaaaacaacctttcaggaaaacacacagagtataagtgtaagaggcatcaaatttattccaggtcctcctggaaataaggatctttgttttacttggcgtgagttttctgactttattcgagtgcaactaatttctggacctcctgctaaacttctccttatagactggccagaactaaaggagtccattccagtgattaatggaagagatttacagaaccctattattgttcaactttgtgatcagtgggataatccagcaccggtacaacatgttaaaataagtcttacaaaagctagcaatttaaagctcatgccttcaaaccaacagcataaaacagatgagaaaggcagggctaatttgggagtattcagtgtttttgcccctaggggagagcatactcttcaggttaaagccatctataacaaaagtatcatagaaggacctataattaagttaatgattcttccagacccagaaaaacccgttcgtctcaatgttaaatatgacaaagatgcatccttcttagcagggggtcttttcactgattttatgattagtgttatttctgaagatgacagtatcattaaaaacattaatccagcacgtatttccatgaaaatgtggaagctgtctaccagtgggaaccgacccccagcaaatgcagaaacatttagttgtaataaaataaaagataatgacaaagaagatggctgcttctatttcagggataaagtaattcctaataaagtggggacatattgtatccagtttggttttatgatggataaaacaaatattctcaacagtgaacaggttatagttgaagtcctgcctaatcaacctgtgaagttagtacctaaaattaaaccacctacaccagctgtttcaaatgttcgctcagttgccagtaggaccttggtcagagatctacatcttagtatcacggatgactacgacaaccatactggaattgatttggttggcactataatagccaccattaaaggctctaatgaggaagatactgataccccactttttattgggaaagttagaacacttgaattccccttcgtgaatggttcggctgaaatcatgagtctggtgctggcagaaagtagtcctggaagggatagtactgaatattttattgtatttgagccccggctaccacttttatcaagaaccttagaaccatatatcctaccgttcatgttttacaatgatgttaagaagcagcaacaaatggcagcacttacaaaagaaaaggaccaattatctcagtctattgttatgtataaaagtttatttgaagccagccaacagcttcttaatgaaatgaaatgtcaagttgaagaagcaagattaaaagaggcccaattgcgaaatgaactaaaaatacataatattgacattcctacaacacaacaggtgccacacattgaagcacttctgaaaagaaagctatcagaacaagaagaactgaagaaaaaacctagaagatcgtgtactcttccaaactatactaaaggcagtggagatgttttgggaaagattgcacatctagcacaaattgaagatgatagagctgcgatggttatttcttggcatctggcaagtgacatggactgtgtagtcaccctaaccactgacgctgcacgtcgtatctatgatgaaacccaaggtcgtcagcaggtgttgccccttgattctatttacaagaagactcttccagattggaaaagatctctacctcatttccgaaatggaaaattgtattttaaacccattggagatccagtctttgctcgagacttgttaacatttccagataatgtagaacattgtgaaacagtatttggtatgctgttaggagacaccattattttggataatctggatgcggccaatcattatagaaaagaggttgttaaaattacacactgtcctacactgctgaccagagatggagatcgaattcgaagtaatggaaagtttgggggccttcagaataaagctcctccaatggataaacttcggggaatggtatttggagctccagttccaaaacagtgtctgatcttaggggaacaaatagatcttcttcagcagtatcgttctgctgtgtgcaaactagacagtgtgaataaggatcttaacagtcaattagagtaccttcgcactccggatatgaggaagaaaaagcaagaacttgatgaacatgagaaaaatctcaaactaatagaggaaaaactaggtatgactcccatacgtaagtgtaatgactcattgcgtcattcaccaaaggttgagacgacagattgtccagttcctcctaaaagaatgagacgagaagctacaagacaaaataggattataaccaaaacagatgtatgagaggtgacagagagaagaggccattggtctcagtaagaatgccctgctttctgcatctctgtttcagaagaccaagagggtgacttaccagactgagtatttctggggacaatacaagtacctgggcatgaatttccatttcgattcagatgggactggaaacaaccattcaattttatgaatcttactggacattatggatttactggaattattccagacattatgccctttggttgtcactaccttgcaaatgtgtaagaggaaaatgtgctaatgtggcagtgactgtaaaactggcacatggcatttattaatcctgaagaaaagtacatgtactatttttcagtataaatataatgaacatgtcagaactatttcttgaaaacctttttattacttttgcgtgaatttatttaacaaagatgttttgtcttttgtgtaagggaggttctagaggctagatgtttaattgtaaatatgtgaggaaactcaatgcagaattcaggataaaaattttaaaagcacaggtatttgggaattgaaatgttaagatacccagaacaacattaaatcaatgagtgaacttgtgacagtggtagcatttcaaatttcaaaagacttatcctgtgtgtgtgtgtgtgtgtatatatatatatatatataaatatatatatataaaatattcagcagcaccaagttttataactattgtttgtttgactttattaatactagaatatgtagtctcagccttaattttacatttacattattttgtaattttttattactatttttaaggggttaaagagaacatacattctcacattagtgtactttctggtagaaagttgctgcaaaaacatttgaaatgtatattaacctaatgtatgtcatatatatgtctttgtgtaagttcaagactattgatctgtgaagttattttgtaaggacatacatttggtaagtaagtttgtgtcccaggaaatgtatgtgtttttaaaccctttctaaatatgcaggccattaataaataagattgtttcttccctactgaatagataagtgtttttcttttttaaaattggaagcttcataaaagttatcttgttaaaaaacgatgatgatgttaacctatctatctttataattggaaattatttaaactgtttgttgttacagaagaaacaaaatggtaattacagaattagctgtggggaagattggctcccatggtactacaggttgagtatcccttattcaaaatggttgggacctgaagtgttttggattttggttttttgtggggtttttaaattattattttggaatatttgcattatatttaccaatttagcatccctaatccaaaaatctttcattagaaattggaaatgcttcaatgagcatttcccttatgtgtcatatctgcgctcaaatgttttgaattttggaacatttcttgtttctgacttttagattagggatactcaccccgtaccaatatttggagtccttagacattagattatatgaaaatgattgattgataggtaagaaaggttaaagagaaatgactttttaggaactagacttgaacgtataattaatatgtggaactagtttgcttttataattcattgtatcaagaaggagtcatgttttaaatccaaggcattgagactatctagaagcaaaaaagttggttttaaaaattctttttattagaagtgtgtttaaaaacatgtctttttttcccttgagcgacagtggcctcactacattgcccaggctagtcttgaactcctgggttcaagcagtcttcctgccttggcctcctaagtagcagggattacaggcatgcacccacatgccaatttttattgcttaaaatggcgagttctatggatattatctagccccaagcccatatctgtacacttttgttcattttataataccagaaagaatgttctatcagtaaaagaaggtttttaagtatgaatctccatttttgtggagtttttctaccctgtaaaaattaactttgtggttcccagtaattacagtaaggagtttttctatattttcacagttggatttatctaaggatatttctcagcatattaaggaatccttttctacatttgagcaaatactgaggttcatgttgtaccaaataataataaattgcttttgtgtttaatatgtaacacgtaagaacaattgaaattttcttctaagatttaatactagtcttttagtataaaggaatgtaactggagaaaaaaattaatgctacagccatttatcctgtgttatgtgttatataatctgaaatttgtcacaatgttacaatcaggaagttttttttctggtttcttcttccaaaggaaaataatagcctacttgtattttgaagtaactgaaataaaactctctccaagcctttttgcacatta

SEQ ID NO: 187168 - DNA, 555 bp, Homo sapiens
  Payload ID: 16849
  Gene Symbol: SMCHD1
  Gene Name: structural maintenance of chromosomes flexible hinge domain containing 1
  ENST ID: ENST00000585229
  CDS Start-End: 1-148
aattgaatgctacaataggatatctggtgcattattcactaatgacaaattccaggtcagcacaaataaattgacgtttatggatcttgagctaaaattgaaagataagaacaccctttttacaaggattttaaatggacaggtatgatttttaaatataaagttgtgaatatttgcaaatgttttatttttaagtaaaagaagacactagcagtgtaggtttttattgatattttgcatcaaaagactatgatgtataaatttttttatgagcagtcaagtgttcacattactaaaaaatttaaagctaattttttagtaatgactaaacctacctagtaaagactaggtttggatagaatttacatatcttcattagttttttttgtttttttttttttaagacaggagtttcactctgtttcccaggctggattgcagtggctcaatctcagctcactgcaacctctgcctcccaggctgaggcaggaggatggcttgaggccaggagttcaagaccagcgtgtgcaatacagtgagacaccttctgtattt

SEQ ID NO: 187169 - DNA, 865 bp, Homo sapiens
  Payload ID: 16849
  Gene Symbol: SMCHD1
  Gene Name: structural maintenance of chromosomes flexible hinge domain containing 1
  ENST ID: ENST00000583800
  CDS Start-End: 1-146
aaaaactaggtatgactcccatacgtaagtgtaatgactcattgcgtcattcaccaaaggttgagacgacagattgtccagttcctcctaaaagaatgagacgagaagctacaagacaaaatagagatggggtcttgctgtgttgaccaggctggtctcaagctcctgggcttaagctactctcctgccgcggcctcccaaagtactgagattacaggcctgagtcaccatgctcggcccaacatccacatgtttaaagcaaaacctgtggacccatgacgttgatttgccctatcccagttatagttaccatcaagtcccactcggagaagagacttgttggtaaaacagttctatttttataatagtagaagaaattccagctagcaatgtaatcctctttcttaaatgtaattgtacaactaacagtcatcacacatatgagggtagccagcaacgtgagagacaaaattcaagattaagttccaaaatcaacatggaggacaatttagtaaagagactagacctcttttataaaattataattactatgtagcagaaaggagccaggacaagaatgaataaacagattacaaatattgttgctgaaataaaaatgttcaataggaggattaaagtccaaaaagaaaacttccccaatacaaaaagagatagaagacatagagaaccaattcagactattaggaatctagaaagaagaaaatggagaaggaaatgctatcatgtggaagaggatttcctagggatgaataaaattcattgaatgcccagcaacagtgactgacaaaatactcactaagatacttcatagtaatactgtatcatatcaaggagagggagaaag

SEQ ID NO: 187170 - DNA, 4951 bp, Homo sapiens
  Payload ID: 16849
  Gene Symbol: SMCHD1
  Gene Name: structural maintenance of chromosomes flexible hinge domain containing 1
  ENST ID: ENST00000577880
  CDS Start-End: 1-4167
gatcttgagctaaaattgaaagataagaacaccctttttacaaggattttaaatggacaggaacagcgaatgaaaattgacagagaatttgctttgtggctgaaggactgtcatgagaagtatgataaacaaataaaatttacactttttaagggagtaattacacgtcctgatcttccttctaaaaagcaaggtccctgggcaacatatgcagcaatagaatgggatggaaagatatacaaagcaggacagctggtcaagacaatcaagacacttcccctcttttatggaagcatagtaagattttttctttatggcgatcatgatggagaagtatatgctacaggaggagaggttcaaattgcaatggaacctcaggcactatatgatgaagtaagaactgtgccaattgcaaagctggataggacagttgctgagaaagctgttaaaaaatatgtagaagatgaaatggcaaggctccctgatagattgtcagtaacttggcctgaaggagatgaattattgcctaatgaggttaggcctgctggaacccctattggtgcgttaagaattgaaatactgaataaaaaaggggaagcaatgcaaaagcttccaggaacaagccatggagggtcaaagaaactcctggttgagctcaaagttattttacattcttcaagtggaaataaagagattatttcgcatattagtcaacatggaggaaaatggccttactggtttaaaaaaatggaaaatattcagaagttggggaattataccttgaaattacaagttgtgttgaatgaaagtaatgcagacacttatgcaggaagaccactaccatctaaagcaattaagttttctgttaaagagggtaagccagagaaattttcatttggtcttctggatcttccttttcgtgttggagttccatttaatatccctctggagtttcaggatgaatttggtcataccagtcaactagtaactgatattcagccagttcttgaagcaagtggtttatctttacattatgaagaaataaccaaaggaccaaattgtgtaattcgaggtgttacagccaagggccctgtaaactcttgtcaaggcaagaattataatctgaaggttactctgcctggcttaaaagaagactcacagattttgaaaattagattactacctggtcaccctcgtcgactgaaagtgaaacctgattctgaaattttagttatagaaaatggaacagctttcccatttcaggtggaagttttagatgaatcagacaacataacagcacaaccaaaattgattgttcattgtaagttttcaggtgctccaaaccttccagtctatgttgtagattgcagtagttctggaaccagtattttaacaggatctgcaattcaagttcagaatattaaaaaagaccagacgcttaaagcaagaattgaaatacctagttgtaaagatgtggcacctgtggagaagactattaagttgcttcccagtagccatgttgcaagactacaaatattcagtgtagaaggacaaaaggcaattcagatcaaacatcaggatgaggttaattggatagcgggtgatattatgcataatcttatttttcaaatgtatgatgaaggagaaagagaaatcaatataacatcagctttagcagaaaaaattaaagttaattggactcctgagattaacaaagaacacttgctacagggtctgcttcctgatgtgcaagtaccaacatctgtaaaagatatgcgctattgccaggtttcattccaagatgatcatgtgtctttggaaagtgcgtttacagtaagaccacttcctgatgaacctaaacatttaaaatgtgaaatgaaaggaggaaaaacagtacagatgggccaagagcttcaaggagaagtagttataataattacagatcagtacggaaatcagattcaagcattttcaccaagttctttatcttctttgtcaattgctggggttggacttgatagctcaaatttgaaaacaacctttcaggaaaacacacagagtataagtgtaagaggcatcaaatttattccaggtcctcctggaaataaggatctttgttttacttggcgtgagttttctgactttattcgagtgcaactaatttctggacctcctgctaaacttctccttatagactggccagaactaaaggagtccattccagtgattaatggaagagatttacagaaccctattattgttcaactttgtgatcagtgggataatccagcaccggtacaacatgttaaaataagtcttacaaaagctagcaatttaaagctcatgccttcaaaccaacagcataaaacagatgagaaaggcagggctaatttgggagtattcagtgtttttgcccctaggggagagcatactcttcaggttaaagccatctataacaaaagtatcatagaaggacctataattaagttaatgattcttccagacccagaaaaacccgttcgtctcaatgttaaatatgacaaagatgcatccttcttagcagggggtcttttcactgattttatgattagtgttatttctgaagatgacagtatcattaaaaacattaatccagcacgtatttccatgaaaatgtggaagctgtctaccagtgggaaccgacccccagcaaatgcagaaacatttagttgtaataaaataaaagataatgacaaagaagatggctgcttctatttcagggataaagtaattcctaataaagtggggacatattgtatccagtttggttttatgatggataaaacaaatattctcaacagtgaacaggttatagttgaagtcctgcctaatcaacctgtgaagttagtacctaaaattaaaccacctacaccagctgtttcaaatgttcgctcagttgccagtaggaccttggtcagagatctacatcttagtatcacggatgactacgacaaccatactggaattgatttggttggcactataatagccaccattaaaggctctaatgaggaagatactgataccccactttttattgggaaagttagaacacttgaattccccttcgtgaatggttcggctgaaatcatgagtctggtgctggcagaaagtagtcctggaagggatagtactgaatattttattgtatttgagccccggctaccacttttatcaagaaccttagaaccatatatcctaccgttcatgttttacaatgatgttaagaagcagcaacaaatggcagcacttacaaaagaaaaggaccaattatctcagtctattgttatgtataaaagtttatttgaagccagccaacagcttcttaatgaaatgaaatgtcaagttgaagaagcaagattaaaagaggcccaattgcgaaatgaactaaaaatacataatattgacattcctacaacacaacaggtgccacacattgaagcacttctgaaaagaaagctatcagaacaagaagaactgaagaaaaaacctagaagatcgtgtactcttccaaactatactaaaggcagtggagatgttttgggaaagattgcacatctagcacaaattgaagatgatagagctgcgatggttatttcttggcatctggcaagtgacatggactgtgtagtcaccctaaccactgacgctgcacgtcgtatctatgatgaaacccaaggtcgtcagcaggtgttgccccttgattctatttacaagaagactcttccagattggaaaagatctctacctcatttccgaaatggaaaattgtattttaaacccattggagatccagtctttgctcgagacttgttaacatttccagataatgtagaacattgtgaaacagtatttggtatgctgttaggagacaccattattttggataatctggatgcggccaatcattatagaaaagaggttgttaaaattacacactgtcctacactgctgaccagagatggagatcgaattcgaagtaatggaaagtttgggggccttcagaataaagctcctccaatggataaacttcggggaatggtatttggagctccagttccaaaacagtgtctgatcttaggggaacaaatagtgcatgcctgtgttcccagctactcaggaggctaagacaagagtgtcgcttgagcccaggagtttgaggtcagcctgggcaacgtagcaagactccatctcttaaaaaaaaaaaaagaagaaatttctgtcattattgaataaatcttcttcagcagtatcgttctgctgtgtgcaaactagacagtgtgaataaggatcttaacagtcaattagagtaccttcgcactccggatatgaggaagaaaaagcaagaacttgatgaacatgagaaaaatctcaaactaatagaggaaaaactaggtatgactcccatacgtaagtgtaatgactcattgcgtcattcaccaaaggttgagacgacagattgtccagttcctcctaaaagaatgagacgagaagctacaagacaaaataggattataaccaaaacagatgtatgagaggtgacagagagaagaggccattggtctcagtaagaatgccctgctttctgcatctctgtttcagaagaccaagagggtgacttaccagactgagtatttctggggacaatacaagtacctgggcatgaatttccatttcgattcagatgggactggaaacaaccattcaattttatgaatcttactggacattatggatttactggaattattccagacattatgccctttggttgtcactaccttgcaaatgtgtaagaggaaaatgtgctaatgtggcagtgactgtaaaactggcacatggcatttattaatcctgaagaaaagtacatgtactatttttcagtataaatataatgaacatgtcagaacta

SEQ ID NO: 187171 - DNA, 4143 bp, Homo sapiens
  Payload ID: 16849
  Gene Symbol: SMCHD1
  Gene Name: structural maintenance of chromosomes flexible hinge domain containing 1
  ENST ID: ENST00000584897
  CDS Start-End: 1-452
aaaaatatgtagaagatgaaatggcaaggctccctgatagattgtcagtaacttggcctgaaggagatgaattattgcctaatgaggttaggcctgctggaacccctattggtgcgttaagaattgaaatactgaataaaaaaggggaagcaatgcaaaagcttccaggaacaagccatggagggtcaaagaaactcctggttgagctcaaagttattttacattcttcaagtggaaataaagagattatttcgcatattagtcaacatggaggaaaatggccttactggtttaaaaaaatggaaaatattcagaagttggggaattataccttgaaattacaagttgtgttgaatgaaagtaatgcagacacttatgcaggaagaccactaccatctaaagcaattaagttttctgttaaagtggtttatctttacattatgaagaaataaccaaaggaccaaattgtgtaattcgaggtgttacagccaagggccctgtaaactcttgtcaaggcaagaattataatctgaaggttactctgcctggcttaaaagaagactcacagattttgaaaattagattactacctggtcaccctcgtcgactgaaagtgaaacctgattctgaaattttagttatagaaaatggaacagctttcccatttcaggtggaagttttagatgaatcagacaacataacagcacaaccaaaattgattgttcattgtaagttttcaggtgctccaaaccttccagtctatgttgtagattgcagtagttctggaaccagtattttaacaggatctgcaattcaagttcagaatattaaaaaagaccagacgcttaaagcaagaattgaaatacctagttgtaaagatgtggcacctgtggagaagactattaagttgcttcccagtagccatgttgcaagactacaaatattcagtgtagaaggacaaaaggcaattcagatcaaacatcaggatgaggttaattggatagcgggtgatattatgcataatcttatttttcaaatgtatgatgaaggagaaagagaaatcaatataacatcagctttagcagaaaaaattaaagttaattggactcctgagattaacaaagaacacttgctacagggtctgcttcctgatgtgcaagtaccaacatctgtaaaagatatgcgctattgccaggtttcattccaagatgatcatgtgtctttggaaagtgcgtttacagtaagaccacttcctgatgaacctaaacatttaaaatgtgaaatgaaaggaggaaaaacagtacagatgggccaagagcttcaaggagaagtagttataataattacagatcagtacggaaatcagattcaagcattttcaccaagttctttatcttctttgtcaattgctggggttggacttgatagctcaaatttgaaaacaacctttcaggaaaacacacagagtataagtgtaagaggcatcaaatttattccaggtcctcctggaaataaggatctttgttttacttggcgtgagttttctgactttattcgagtgcaactaatttctggacctcctgctaaacttctccttatagactggccagaactaaaggagtccattccagtgattaatggaagagatttacagaaccctattattgttcaactttgtgatcagtgggataatccagcaccggtacaacatgttaaaataagtcttacaaaagctagcaatttaaagctcatgccttcaaaccaacagcataaaacagatgagaaaggcagggctaatttgggagtattcagtgtttttgcccctaggggagagcatactcttcaggttaaagccatctataacaaaagtatcatagaaggacctataattaagttaatgattcttccagacccagaaaaacccgttcgtctcaatgttaaatatgacaaagatgcatccttcttagcagggggtcttttcactgattttatgattagtgttatttctgaagatgacagtatcattaaaaacattaatccagcacgtatttccatgaaaatgtggaagctgtctaccagtgggaaccgacccccagcaaatgcagaaacatttagttgtaataaaataaaagataatgacaaagaagatggctgcttctatttcagggataaagtaattcctaataaagtggggacatattgtatccagtttggttttatgatggataaaacaaatattctcaacagtgaacaggttatagttgaagtcctgcctaatcaacctgtgaagttagtacctaaaattaaaccacctacaccagctgtttcaaatgttcgctcagttgccagtaggaccttggtcagagatctacatcttagtatcacggatgactacgacaaccatactggaattgatttggttggcactataatagccaccattaaaggctctaatgaggaagatactgataccccactttttattgggaaagttagaacacttgaattccccttcgtgaatggttcggctgaaatcatgagtctggtgctggcagaaagtagtcctggaagggatagtactgaatattttattgtatttgagccccggctaccacttttatcaagaaccttagaaccatatatcctaccgttcatgttttacaatgatgttaagaagcagcaacaaatggcagcacttacaaaagaaaaggaccaattatctcagtctattgttatgtataaaagtttatttgaagccagccaacagcttcttaatgaaatgaaatgtcaagttgaagaagcaagattaaaagaggcccaattgcgaaatgaactaaaaatacataatattgacattcctacaacacaacaggtgccacacattgaagcacttctgaaaagaaagctatcagaacaagaagaactgaagaaaaaacctagaagatcgtgtactcttccaaactatactaaaggcagtggagatgttttgggaaagattgcacatctagcacaaattgaagatgatagagctgcgatggttatttcttggcatctggcaagtgacatggactgtgtagtcaccctaaccactgacgctgcacgtcgtatctatgatgaaacccaaggtcgtcagcaggtgttgccccttgattctatttacaagaagactcttccagattggaaaagatctctacctcatttccgaaatggaaaattgtattttaaacccattggagatccagtctttgctcgagacttgttaacatttccagataatgtagaacattgtgaaacaggttgttaaaattacacactgtcctacactgctgaccagagatggagatcgaattcgaagtaatggaaagtttgggggccttcagaataaagctcctccaatggataaacttcggggaatggtatttggagctccagttccaaaacagtgtctgatcttaggggaacaaatagatcttcttcagcagtatcgttctgctgtgtgcaaactagacagtgtgaataaggatcttaacagtcaattagagtaccttcgcactccggatatgaggaagaaaaagcaagaacttgatgaacatgagaaaaatctcaaactaatagaggaaaaactaggtatgactcccatacgtaagtgtaatgactcattgcgtcattcaccaaaggttgagacgacagattgtccagttcctcctaaaagaatgagacgagaagctacaagacaaaataggattataaccaaaacagatgtatgagaggtgacagagagaagaggccattggtctcagtaagaatgccctgctttctgcatctctgtttcagaagaccaagagggtgacttaccagactgagtatttctggggacaatacaagtacctgggcatgaatttccatttcgattcagatgggactggaaacaaccattcaattttatgaatcttactggacattatggatttactggaattattccagacattatgccctttggttgtcactaccttgcaaatgtgtaagaggaaaatgtgctaatgtggcagtgactgtaaaactggcacatggcatttattaatcctgaagaaaagtacatgtactatttttcagtataaatataatgaacatgtcagaact

SEQ ID NO: 187172 - DNA, 2819 bp, Homo sapiens
  Payload ID: 16850
  Gene Symbol: SSRP1
  Gene Name: structure specific recognition protein 1
  Uniprot ID: Q08945
  ENST ID: ENST00000278412
  CDS Start-End: 268-2397
gtacggcttccggtggcgggacgcggggccgcgcacgcgggaaaagcttccccggtgtccccccatccccctccccgcgccccccccgcgtccccccagcgcgcccacctctcgcgccggggccctcgcgaggccgcagcctgaggagattcccaacctgctgagcatccgcacacccactcaggagttggggcccagctcccagtttacttggtttcccttgtgcagcctggggctctgcccaggccaccacaggcaggggtcgacatggcagagacactggagttcaacgacgtctatcaggaggtgaaaggttccatgaatgatggtcgactgaggttgagccgtcagggcatcatcttcaagaatagcaagacaggcaaagtggacaacatccaggctggggagttaacagaaggtatctggcgccgtgttgctctgggccatggacttaaactgcttacaaagaatggccatgtctacaagtatgatggcttccgagaatcggagtttgagaaactctctgatttcttcaaaactcactatcgccttgagctaatggagaaggacctttgtgtgaagggctggaactgggggacagtgaaatttggtgggcagctgctttcctttgacattggtgaccagccagtctttgagatacccctcagcaatgtgtcccagtgcaccacaggcaagaatgaggtgacactggaattccaccaaaacgatgacgcagaggtgtctctcatggaggtgcgcttctacgtcccacccacccaggaggatggtgtggaccctgttgaggcctttgcccagaatgtgttgtcaaaggcggatgtaatccaggccacgggagatgccatctgcatcttccgggagctgcagtgtctgactcctcgtggtcgttatgacattcggatctaccccacctttctgcacctgcatggcaagacctttgactacaagatcccctacaccacagtactgcgtctgtttttgttaccccacaaggaccagcgccagatgttctttgtgatcagcctggatcccccaatcaagcaaggccaaactcgctaccacttcctgatcctcctcttctccaaggacgaggacatttcgttgactctgaacatgaacgaggaagaagtggagaagcgctttgagggtcggctcaccaagaacatgtcaggatccctctatgagatggtcagccgggtcatgaaagcactggtaaaccgcaagatcacagtgccaggcaacttccaagggcactcaggggcccagtgcattacctgttcctacaaggcaagctcaggactgctctacccgctggagcggggcttcatctacgtccacaagccacctgtgcacatccgcttcgatgagatctcctttgtcaactttgctcgtggtaccactactactcgttcctttgactttgaaattgagaccaagcagggcactcagtataccttcagcagcattgagagggaggagtacgggaaactgtttgattttgtcaacgcgaaaaagctcaacatcaaaaaccgaggattgaaagagggcatgaacccaagctacgatgaatatgctgactctgatgaggaccagcatgatgcctacttggagaggatgaaggaggaaggcaagatccgggaggagaatgccaatgacagcagcgatgactcaggagaagaaaccgatgagtcattcaacccaggtgaagaggaggaagatgtggcagaggagtttgacagcaacgcctctgccagctcctccagtaatgagggtgacagtgaccgggatgagaagaagcggaaacagctcaaaaaggccaagatggccaaggaccgcaagagccgcaagaagcctgtggaggtgaagaagggcaaagaccccaatgcccccaagaggcccatgtctgcatacatgctgtggctcaatgccagccgagagaagatcaagtcagaccatcctggcatcagcatcacggatctttccaagaaggcaggcgagatctggaagggaatgtccaaagagaagaaagaggagtgggatcgcaaggctgaggatgccaggagggactatgaaaaagccatgaaagaatatgaagggggccgaggcgagtcttctaagagggacaagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagaggaggaggagcgaggactctgaagaagaagaactagccagtactccccccagctcagaggactcagcgtcaggatccgatgagtagaaacggaggaaggttctctttgcgcttgccttctcacaccccccgactccccacccatattttggtaccagtttctcctcatgaaatgcagtccctggattctgtgccatctgaacatgctctcctgttggtgtgtatgtcactagggcagtggggagacgtcttaactctgctgcttcccaaggatggctgtttataatttggggagagatagggtgggaggcagggcaatgcaggatccaaatcctcatcttactttcccgaccttaaggatgtagctgctgcttgtcctgttcaagttgctggagcaggggtcatgtgaggccaggcctgtagctcctacctggggcctatttctactttcattttgtatttctggtctgtgaaaatgatttaataaagggaactgactttggaaacca

SEQ ID NO: 187173 - DNA, 948 bp, Homo sapiens
  Payload ID: 16850
  Gene Symbol: SSRP1
  Gene Name: structure specific recognition protein 1
  ENST ID: ENST00000526696
  CDS Start-End: 430-948
tcccgccggagcggccagagcgggcgtcgggttgggtgtcagcggtattccgggcccggttctccacccaggcctggacctggaccctcgggcactgcagcgtccgtctgtaggtttccaggcagaggaaatcctgagacatccaggcgcagctgggagttgctacctggctccatccgtgagcacagcgagaatgatggtcgactgaggttgagccgtcagggcatcatcttcaagaatagcaagacaggcaaagtggacaacatccaggctggggagttaacagaaggtatctggcgccgtgttgctctgggccatggacttaaactgcttacaaagaatggccatgtctacaagtatgatggcttccgagaatcggagtttgagaaactctctgatttcttcaaaactcactatcgccttgagctaatggagaaggacctttgtgtgaagggctggaactgggggacagtgaaatttggtgggcagctgctttcctttgacattggtgaccagccagtctttgagatacccctcagcaatgtgtcccagtgcaccacaggcaagaatgaggtgacactggaattccaccaaaacgatgacgcagaggtgtctctcatggaggtgcgcttctacgtcccacccacccaggaggatggtgtggaccctgttgaggcctttgcccagaatgtgttgtcaaaggcggatgtaatccaggccacgggagatgccatctgcatcttccgggagctgcagtgtctgactcctcgtggtcgttatgacattcggatctaccccacctttctgcacctgcatggcaagacctttgactacaagatcccctacaccacagtactgcgtctgtttttgttaccccacaaggaccagcgccagatgttctttgtgatcagcctggatcccccaatcaagcaaggccaaactcgctac

SEQ ID NO: 187174 - DNA, 648 bp, Homo sapiens
  Payload ID: 16850
  Gene Symbol: SSRP1
  Gene Name: structure specific recognition protein 1
  ENST ID: ENST00000529002
  CDS Start-End: 382-648
ggcttccggtggcgggacgcggggccgcgcacgcgggaaaagcttccccggtgtccccccatccccctccccgcgccccccccgcgtccccccagcgcgcccacctctcgcgccggggccctcgcgaggccgcagcctgaggagaatgatggtcgactgaggttgagccgtcagggcatcatcttcaagaatagcaagacaggcaaagtggacaacatccaggctggggagttaacagaaggtatctggcgccgtgttgctctgggccatggacttaaactgcttacaaagaatggccatgtctacaagtatgatggcttccgagaatcggagtttgagaaactctctgatttcttcaaaactcactatcgccttgagctaatggagaaggacctttgtgtgaagggctggaactgggggacagtgaaatttggtgggcagctgctttcctttgacattggtgaccagccagtctttgagatacccctcagcaatgtgtcccagtgcaccacaggcaagaatgaggtgacactggaattccaccaaaacgatgacgcagaggtgtctctcatggaggtgcgcttctacgtcccacccacccaggaggatggtgtggaccctgttgaggcctttgcccagaatgtgttg

SEQ ID NO: 187175 - DNA, 675 bp, Homo sapiens
  Payload ID: 16850
  Gene Symbol: SSRP1
  Gene Name: structure specific recognition protein 1
  ENST ID: ENST00000635721
  CDS Start-End: 1-675
ggaggagtacgggaaactgtttgattttgtcaacgcgaaaaagctcaacatcaaaaaccgaggattgaaagagaaaaaagagggcatgaacccaagctacgatgaatatgctgactctgatgaggaccagcatgatgcctacttggagaggatgaaggaggaaggcaagatccgggaggagaatgccaatgacagcagcgatgactcaggagaagaaaccgatgagtcattcaacccaggtgaagaggaggaagatgtggcagaggagtttgacagcaacgcctctgccagctcctccagtaatgagggtgacagtgaccgggatgagaagaagcggaaacagctcaaaaaggccaagatggccaaggaccgcaagagccgcaagaagcctgtggaggtgaagaagggcaaagaccccaatgcccccaagaggcccatgtctgcatacatgctgtggctcaatgccagccgagagaagatcaagtcagaccatcctggcatcagcatcacggatctttccaagaaggcaggcgagatctggaagggaatgtccaaagagaagaaagaggagtgggatcgcaaggctgaggatgccaggagggactatgaaaaagccatgaaagaatatgaagggggccgaggcgagtcttctaagagggacaagtcaaagaagaa

SEQ ID NO: 187176 - DNA, 4558 bp, Homo sapiens
  Payload ID: 16851
  Gene Symbol: STT3A
  Gene Name: STT3A, subunit of the oligosaccharyltransferase complex (catalytic)
  Uniprot ID: P46977
  ENST ID: ENST00000392708
  CDS Start-End: 160-2277
attggcctggagccagccaacgggggagcggtccgggaggcggacccggctcctgccagggttgggtgcgccgctgaacggatggctgagggagccccgcggatcgtttaggaaagccggccagctgatcgtcgtgtgttgccacccattcatgtcaagatgactaagtttggatttttgcgattgtcctatgagaagcaggacacacttttgaagcttctcattctgtcaatggctgctgtattatccttctccactcgtctgtttgctgtcctgagatttgaaagtgttatccatgagtttgatccgtactttaattatcggactaccaggttcctggctgaggaggggttttataaattccataactggtttgatgaccgagcctggtaccctttgggacgaatcattggaggaacaatttacccaggtttaatgatcacctctgctgcaatctaccatgtactccattttttccacatcaccatcgacattcggaatgtctgtgtgttcctggcccctctcttctcctccttcaccaccatcgtcacgtaccaccttaccaaagagctcaaggatgcaggggctgggcttcttgctgctgccatgattgctgtagttcctggatatatctcccgatctgtggctggctcctatgataatgaagggattgccatcttttgcatgctactcacctactacatgtggatcaaggcagtaaagactggttccatctgttgggcagctaagtgtgcccttgcttatttctacatggtctcgtcatggggaggttatgtgttcctgatcaacttaattcctctccacgtcctcgtgctgatgctcacaggccgtttctctcaccggatctatgtggcctactgtactgtttactgcctgggcactatactttctatgcagatctcctttgtgggtttccagcctgtcctttcatcagagcacatggcagcctttggggtctttggtctctgccagatccatgcctttgtggattacctgcgcagcaagttgaatccacaacaatttgaagttcttttccggagcgtcatctctctggtaggctttgtccttctcaccgtgggagctctcctcatgctgacaggaaaaatatctccctggacggggcgtttctactcgctgctggatccctcttatgctaagaacaacatccccatcattgcttctgtgtctgagcatcagcccacaacctggtcctcatactattttgacctgcagctcctcgtcttcatgtttccagttggcctctattactgctttagcaacctgtctgatgcccggatttttatcatcatgtatggtgtgaccagcatgtacttttcagctgtaatggtgcgtctaatgctagtgttggcacctgttatgtgcattctctctggcattggagtctcccaggtgctgtccacatacatgaagaatctggacataagtcgtccagacaagaagagcaagaagcaacaggattccacctaccctattaagaatgaagtggcaagtgggatgatactggtcatggctttctttctcatcacctacacctttcattcaacctgggtgaccagtgaggcctactcttctccgtccattgtactatctgcccgtggtggggatggcagtaggatcatatttgatgacttccgagaagcatattattggcttcgtcataatactccagaggatgcgaaggtcatgtcctggtgggattatggctatcagattacagctatggcaaaccgaacaattttagtggacaataacacatggaataatacccatatttctcgagtagggcaggcaatggcgtccacagaggaaaaagcctatgagatcatgagggagctcgatgtcagctatgtgctggtcatttttggaggcctcactgggtattcctctgatgatatcaacaagtttctttggatggtccggattggagggagcacagatacaggcaaacatatcaaggagaatgactattatactccaactggggagttccgtgtggaccgtgaaggttctccagtgctgctcaactgcctcatgtacaagatgtgttactatcgctttggacaggtttacacagaagccaagcgtcctccaggctttgaccgtgtccgaaatgctgagattgggaataaagactttgagcttgatgtcctggaggaagcatataccacagaacattggctggtcaggatatacaaggtaaaggacctggataatcgaggcttgtcaaggacataaatgtcacgtccagctctgatatgcttcgcactgagcacatcacatttaggacgttgaagatttttttttttttttttttttaatatgcagtttgtaagaacaaaactggatggcatcagaattgtctggaagttttgtcttgggcagtatgggctgggccaaatgaaatgatttttataattctaaacaggttaccaaatgaaatgtcatggctttactttggtcaattaaaggggggaatttttttaaaaaatgtgccttatttgttttgacttataactgatttgagggaggcaaaagctatgctaggctgccagaaggacataagcagaccttgtccattctcttagctccctaaattagccaaatagagacttctttctcaaatcaggaaaactatcaaagaccaattcagatcctacatttacagacagttttgtcataaccctttgcattgcagcacctagtacaattccttggaaacagcgtggctcaataaatttttattgaatgaataaatgtgggaccagaagagtgctagaagagtgcctttctgggctactatgtctctgttctcaatgtcttttatccttagacgctctttgactttataaatcagcagttttgaagactcaagacaaacagtgaaattattggtttatcaatggagaggaagaaactcttccagcattacatatagagcttgatggtcagtaggtgtttttgaatcagcttaaatataatcatacatatcaatttgaaatggagcttttcagtactctcacttattcatgacacaggaatgaccctttactcaaaactcttgtggttgttcaaaggtgagcttctttttcccttagtcttagcctatgtgttgctgttgtatattgttaccaagttcaactacctaattttgaagctctttccaaataagatacaaattaaaaggggaagcattgccagtaacaggtccctagagagcagtgccagcctgcctgcaagaaaagaggagaaacttcttaaaaagttttaagcctgggcaacataaggagattgtttctatgaaaaataaaaattagccaggtatggtggtgtacacctgtagtcccagctactcgggaagatgagattggaggatcacttgggcctgggaggttgaggctacagtgaactgtgattgtgccactgtactccagtctgggcgacagtgaaatcttgtctaaacaaaaacaatttaactgggaagcacagtggtccttgaggacatttaatatcaggacaaagagcctatgaatatatcactgatgtatataaaccctaaggcgttaataaaagctaactgtttagtgttatccatttaagggaacaggaggaattgcataacttttagattagtcatagtggtgctcctaagggatatgctgttgtatatttgtatagccagggcacttagccttccaaaccaatttatataccatgttcttcaactgtgggtgagatttagcctcaagatttgatttactatatgtaagtacattacttgatttctataaagaatctttagtggaagaggttattctgaattatttatcaatatgattaataccagttagaaattattaatgatcttcctttatactatacataggataacttttaacttgtcgctacagttgttgctctgaggatcttaattttgttactttctaggctacatgaagctatctttttaaaaagtgtactcttcattttcactgttattgtgtacttagcataaaaaactcaaatctaggccaggtgcagtggctcatgcctgtaatcccagcactttgggaggctgaagcatgcggatcacttgagcccaggagttcaagaccagcctgggcaacatggctaatgaacactaagcatagttttgatgtctttcatattaaagactttctcaaattcttgctagtctgctcctctttaagagtgggaccctaggcagggcgcagtggatcatgcctgtaatcccagcactttgggaggccgaggcaggcagatcacttgaggccaggagtttgagaccggcctggcaacgtgggaaaactctgtctctactaaaaatacaaaaattagctgggtgtggggtacacaccctgtaatctcagctactggggaggctgaggcatgagaattgcccaggaggtggaggttgcagtgagcagacatcatgccactgcactccaacctgggagacagagcaagactgtctcaaaaaaaaaaaaaaaaaaaaaaa

SEQ ID NO: 187177 - DNA, 2160 bp, Homo sapiens
  Payload ID: 16851
  Gene Symbol: STT3A
  Gene Name: STT3A, subunit of the oligosaccharyltransferase complex (catalytic)
  Uniprot ID: P46977
  ENST ID: ENST00000531491
  CDS Start-End: 241-2082
gctgaacggatggctgagggagccccgcggatcgtttaggaaagccggccagccttctccactcgtctgtttgctgtcctgagatttgaaagtgttatccatgagtttgatccgtactttaattatcggactaccaggttcctggctgaggaggggttttataaattccataactggtttgatgaccgagcctggtaccctttgggacgaatcattggaggaacaatttacccaggtttaatgatcacctctgctgcaatctaccatgtactccattttttccacatcaccatcgacattcggaatgtctgtgtgttcctggcccctctcttctcctccttcaccaccatcgtcacgtaccaccttaccaaagagctcaaggatgcaggggctgggcttcttgctgctgccatgattgctgtagttcctggatatatctcccgatctgtggctggctcctatgataatgaagggattgccatcttttgcatgctactcacctactacatgtggatcaaggcagtaaagactggttccatctgttgggcagctaagtgtgcccttgcttatttctacatggtctcgtcatggggaggttatgtgttcctgatcaacttaattcctctccacgtcctcgtgctgatgctcacaggccgtttctctcaccggatctatgtggcctactgtactgtttactgcctgggcactatactttctatgcagatctcctttgtgggtttccagcctgtcctttcatcagagcacatggcagcctttggggtctttggtctctgccagatccatgcctttgtggattacctgcgcagcaagttgaatccacaacaatttgaagttcttttccggagcgtcatctctctggtaggctttgtccttctcaccgtgggagctctcctcatgctgacaggaaaaatatctccctggacggggcgtttctactcgctgctggatccctcttatgctaagaacaacatccccatcattgcttctgtgtctgagcatcagcccacaacctggtcctcatactattttgacctgcagctcctcgtcttcatgtttccagttggcctctattactgctttagcaacctgtctgatgcccggatttttatcatcatgtatggtgtgaccagcatgtacttttcagctgtaatggtgcgtctaatgctagtgttggcacctgttatgtgcattctctctggcattggagtctcccaggtgctgtccacatacatgaagaatctggacataagtcgtccagacaagaagagcaagaagcaacaggattccacctaccctattaagaatgaagtggcaagtgggatgatactggtcatggctttctttctcatcacctacacctttcattcaacctgggtgaccagtgaggcctactcttctccgtccattgtactatctgcccgtggtggggatggcagtaggatcatatttgatgacttccgagaagcatattattggcttcgtcataatactccagaggatgcgaaggtcatgtcctggtgggattatggctatcagattacagctatggcaaaccgaacaattttagtggacaataacacatggaataatacccatatttctcgagtagggcaggcaatggcgtccacagaggaaaaagcctatgagatcatgagggagctcgatgtcagctatgtgctggtcatttttggaggcctcactgggtattcctctgatgatatcaacaagtttctttggatggtccggattggagggagcacagatacaggcaaacatatcaaggagaatgactattatactccaactggggagttccgtgtggaccgtgaaggttctccagtgctgctcaactgcctcatgtacaagatgtgttactatcgctttggacaggtttacacagaagccaagcgtcctccaggctttgaccgtgtccgaaatgctgagattgggaataaagactttgagcttgatgtcctggaggaagcatataccacagaacattggctggtcaggatatacaaggtaaaggacctggataatcgaggcttgtcaaggacataaatgtcacgtccagctctgatatgcttcgcactgagcacatcacatttaggacgttgaagatttttttttttttttttt

SEQ ID NO: 187178 - DNA, 542 bp, Homo sapiens
  Payload ID: 16851
  Gene Symbol: STT3A
  Gene Name: STT3A, subunit of the oligosaccharyltransferase complex (catalytic)
  ENST ID: ENST00000529886
  CDS Start-End: 190-542
cagttacagagaagccttgagacagatgattggaagcgggtatagatctgagcagtcgttacagtctgatatatgggatgagaacacagtggatctgtgtttgggtacctccacctctttttgagtgcatgattgtacctgcattagttatcagctgatcgtcgtgtgttgccacccattcatgtcaagatgactaagtttggatttttgcgattgtcctatgagaagcaggacacacttttgaagcttctcattctgtcaatggctgctgtattatccttctccactcgtctgtttgctgtcctgagatttgaaagtgttatccatgagtttgatccgtactttaattatcggactaccaggttcctggctgaggaggggttttataaattccataactggtttgatgaccgagcctggtaccctttgggacgaatcattggaggaacaatttacccaggtttaatgatcacctctgctgcaatctaccatgtactccattttttccacatcaccatcgacattcggaatgtctgtgtgtt

SEQ ID NO: 187179 - DNA, 607 bp, Homo sapiens
  Payload ID: 16851
  Gene Symbol: STT3A
  Gene Name: STT3A, subunit of the oligosaccharyltransferase complex (catalytic)
  ENST ID: ENST00000525652
  CDS Start-End: 300-607
atggaggggaaggcgcgtaggatgctggggtgatgagtgtcccgcgctgaggggtatcagaggtggtcagttctttgagggtgggaagaagagggaggtgggacccgctggaacgaccggaagggagaagagagtaaaagatcgtgagagggtgtggaaacgtgtgtaggaaaacggggctggggaaattgcagtctgggaaactagaggcagggtggcaggagatgccacagcttgcagggcacagttgaggagagcaggttgctgatcgtcgtgtgttgccacccattcatgtcaagatgactaagtttggatttttgcgattgtcctatgagaagcaggacacacttttgaagcttctcattctgtcaatggctgctgtattatccttctccactcgtctgtttgctgtcctgagatttgaaagtgttatccatgagtttgatccgtactttaattatcggactaccaggttcctggctgaggaggggttttataaattccataactggtttgatgaccgagcctggtaccctttgggacgaatcattggaggaacaatttacccaggtttaatgatcacctctgctgcaatctaccatgtact

SEQ ID NO: 187180 - DNA, 582 bp, Homo sapiens
  Payload ID: 16851
  Gene Symbol: STT3A
  Gene Name: STT3A, subunit of the oligosaccharyltransferase complex (catalytic)
  ENST ID: ENST00000526726
  CDS Start-End: 1-582
tttactgcctgggcactatactttctatgcagatctcctttgtgggtttccagcctgtcctttcatcagagcacatggcagcctttggggtctttggtctctgccagatccatgcctttgtggattacctgcgcagcaagttgaatccacaacaatttgaagttcttttccggagcgtcatctctctggaaaaatatctccctggacggggcgtttctactcgctgctggatccctcttatgctaagaacaacatccccatcattgcttctgtgtctgagcatcagcccacaacctggtcctcatactattttgacctgcagctcctcgtcttcatgtttccaggtgcgtctaatgctagtgttggcacctgttatgtgcattctctctggcattggagtctcccaggtgctgtccacatacatgaagaatctggacataagtcgtccagacaagaagagcaagaagcaacaggattccacctaccctattaagaatgaagtggcaagtgggatgatactggtcatggctttctttctcatcacctacacctttcattcaacctgggtgaccagtgaggcct

SEQ ID NO: 187181 - DNA, 569 bp, Homo sapiens
  Payload ID: 16851
  Gene Symbol: STT3A
  Gene Name: STT3A, subunit of the oligosaccharyltransferase complex (catalytic)
  ENST ID: ENST00000527606
  CDS Start-End: 212-569
agcagtgatttaaataatgacctttcaataagtggtgggttccgttcatgggagaataggaaactgcgtgagtggtagaggcaacaagttcgaagagctgcgagacgttcccactctctctggtgtagccttggctcaccgaggcgcgcagggagtggaagtgcctgaggataaagctgatcgtcgtgtgttgccacccattcatgtcaagatgactaagtttggatttttgcgattgtcctatgagaagcaggacacacttttgaagcttctcattctgtcaatggctgctgtattatccttctccactcgtctgtttgctgtcctgagatttgaaagtgttatccatgagtttgatccgtactttaattatcggactaccaggttcctggctgaggaggggttttataaattccataactggtttgatgaccgagcctggtaccctttgggacgaatcattggaggaacaatttacccaggtttaatgatcacctctgctgcaatctaccatgtactccattttttccacatcaccatcgacattcggaatgtctgtgtgttcctgg

SEQ ID NO: 187182 - DNA, 2402 bp, Homo sapiens
  Payload ID: 16851
  Gene Symbol: STT3A
  Gene Name: STT3A, subunit of the oligosaccharyltransferase complex (catalytic)
  Uniprot ID: P46977
  ENST ID: ENST00000529196
  CDS Start-End: 207-2324
ggacccggctcctgccagggttgggtgcgccgctgaacggatggctgagggagccccgcggatcgtttaggaaagccggccaggcattccagaaaacagctgcaaaccctgagagatatggctggattgttgacctcctggagtagttaggcctttatttttagttgcaaactgatcgtcgtgtgttgccacccattcatgtcaagatgactaagtttggatttttgcgattgtcctatgagaagcaggacacacttttgaagcttctcattctgtcaatggctgctgtattatccttctccactcgtctgtttgctgtcctgagatttgaaagtgttatccatgagtttgatccgtactttaattatcggactaccaggttcctggctgaggaggggttttataaattccataactggtttgatgaccgagcctggtaccctttgggacgaatcattggaggaacaatttacccaggtttaatgatcacctctgctgcaatctaccatgtactccattttttccacatcaccatcgacattcggaatgtctgtgtgttcctggcccctctcttctcctccttcaccaccatcgtcacgtaccaccttaccaaagagctcaaggatgcaggggctgggcttcttgctgctgccatgattgctgtagttcctggatatatctcccgatctgtggctggctcctatgataatgaagggattgccatcttttgcatgctactcacctactacatgtggatcaaggcagtaaagactggttccatctgttgggcagctaagtgtgcccttgcttatttctacatggtctcgtcatggggaggttatgtgttcctgatcaacttaattcctctccacgtcctcgtgctgatgctcacaggccgtttctctcaccggatctatgtggcctactgtactgtttactgcctgggcactatactttctatgcagatctcctttgtgggtttccagcctgtcctttcatcagagcacatggcagcctttggggtctttggtctctgccagatccatgcctttgtggattacctgcgcagcaagttgaatccacaacaatttgaagttcttttccggagcgtcatctctctggtaggctttgtccttctcaccgtgggagctctcctcatgctgacaggaaaaatatctccctggacggggcgtttctactcgctgctggatccctcttatgctaagaacaacatccccatcattgcttctgtgtctgagcatcagcccacaacctggtcctcatactattttgacctgcagctcctcgtcttcatgtttccagttggcctctattactgctttagcaacctgtctgatgcccggatttttatcatcatgtatggtgtgaccagcatgtacttttcagctgtaatggtgcgtctaatgctagtgttggcacctgttatgtgcattctctctggcattggagtctcccaggtgctgtccacatacatgaagaatctggacataagtcgtccagacaagaagagcaagaagcaacaggattccacctaccctattaagaatgaagtggcaagtgggatgatactggtcatggctttctttctcatcacctacacctttcattcaacctgggtgaccagtgaggcctactcttctccgtccattgtactatctgcccgtggtggggatggcagtaggatcatatttgatgacttccgagaagcatattattggcttcgtcataatactccagaggatgcgaaggtcatgtcctggtgggattatggctatcagattacagctatggcaaaccgaacaattttagtggacaataacacatggaataatacccatatttctcgagtagggcaggcaatggcgtccacagaggaaaaagcctatgagatcatgagggagctcgatgtcagctatgtgctggtcatttttggaggcctcactgggtattcctctgatgatatcaacaagtttctttggatggtccggattggagggagcacagatacaggcaaacatatcaaggagaatgactattatactccaactggggagttccgtgtggaccgtgaaggttctccagtgctgctcaactgcctcatgtacaagatgtgttactatcgctttggacaggtttacacagaagccaagcgtcctccaggctttgaccgtgtccgaaatgctgagattgggaataaagactttgagcttgatgtcctggaggaagcatataccacagaacattggctggtcaggatatacaaggtaaaggacctggataatcgaggcttgtcaaggacataaatgtcacgtccagctctgatatgcttcgcactgagcacatcacatttaggacgttgaagatttttttttttttttttt

SEQ ID NO: 187183 - DNA, 4248 bp, Homo sapiens
  Payload ID: 16852
  Gene Symbol: STT3B
  Gene Name: STT3B, subunit of the oligosaccharyltransferase complex (catalytic)
  Uniprot ID: Q8TCJ2
  ENST ID: ENST00000295770
  CDS Start-End: 210-2690
gcggccgctgctgaggcggagactccccgccgccgcttcctccacccccagtccgccggcctcgcggcgctgagggcgggagcgcgcagagctcttccctcctcctttttcttcctcctcctcctcctcctccgggtccccgcccagcacccctcgcaccaggcggcggcggcggaggaggagagctagacccgccgccggggcacaacatggcggagccctcggccccggagagcaagcacaagtcgtccctcaactcgtccccgtggagtggcctcatggccctgggaaacagccggcacggccaccacgggcccggggcccagtgcgcgcacaaggcggcgggcggcgcggcgccgccgaagccggccccggcggggctgtccggggggctgtcgcagccggctgggtggcagtcgcttctctccttcaccatcctcttcctggcctggcttgccggcttcagctcgcgcctcttcgccgtcatccgcttcgaaagcatcatccacgagttcgacccgtggtttaactatagatcaacacatcatcttgcatctcatgggttctatgaatttttaaattggtttgatgaaagagcatggtatccactaggaagaatagtaggtggtactgtttacccagggttgatgataaccgctggccttattcattggattttaaatacattgaacataactgttcacataagagacgtatgtgtgttccttgcaccaacttttagcggccttacatctatatctactttcctgcttacaagagaactttggaaccaaggagcaggacttttagctgcttgttttattgctattgtaccaggctacatatctcggtcagtagctggatcctttgataatgaaggcattgctatttttgcacttcagttcacatactatttatgggtaaaatctgtaaaaactgggtcagttttttggacaatgtgctgctgcttatcctatttctatatggtctctgcttggggtggttatgtatttatcatcaatcttattccactgcatgtatttgtgttgttactgatgcagagatacagcaaaagagtctacatagcatatagcactttctacattgtgggtttaatattatcaatgcagataccttttgtgggattccagccaatcagaacaagtgaacacatggcagctgcaggtgtctttgcattgctgcaagcttatgctttcttgcagtatctgagagaccgattaacaaaacaagagttccagacccttttctttttgggtgtatcactagctgcaggtgctgtgttccttagtgtcatctatttgacttatacaggttacattgcaccatggagtggcaggttttattcattgtgggatactgggtatgcaaaaatacacattccaattattgcatcagtgtctgagcatcaacctacgacttgggtgtctttcttctttgatctacatattcttgtatgtaccttcccagcaggcctttggttctgcatcaaaaatatcaacgatgaaagagtatttgttgctctatatgcaatcagtgctgtctactttgctggagtgatggtgcgactgatgttgactttgactccagtcgtgtgtatgctgtctgcaattgccttttcaaatgtttttgagcactatttgggggatgacatgaaaagggaaaatccacctgtggaggacagcagtgatgaggatgacaaaagaaaccaaggaaatttgtatgataaggcaggtaaagtgaggaaacatgcaactgaacaggaaaaaactgaagagggattaggccctaatataaaaagcattgtcaccatgttgatgctgatgctattgatgatgtttgctgtccactgtacctgggtcacaagcaatgcctactctagtccaagtgtagtcctggcctcatacaatcatgatggcaccaggaatatcttagatgattttagagaagcttacttttggctaaggcaaaatacagatgaacatgcacgagtaatgtcttggtgggattatggctatcagatagctggaatggctaatagaactacgttggtggataataacacctggaataacagccacatagcactggtgggaaaagctatgtcttctaatgaaacagcagcctataaaatcatgaggactctagatgtagattatgttttggttatttttggaggggttattggctattctggtgatgatatcaacaaatttctctggatggttaggatagctgaaggagaacatcccaaagacattcgggaaagtgactattttaccccacagggagaattccgtgtagacaaagcaggatcccctactttgttgaattgccttatgtataaaatgtcatactacagatttggagaaatgcagctggattttcgtacacccccaggttttgaccgaacacgtaatgctgagattggaaataaggacattaaattcaaacatttggaagaagcctttacatcagaacactggcttgttaggatatataaagtaaaagcacctgataacagggagacattagatcacaaacctcgagtcaccaacattttcccaaaacagaagtatttgtcaaagaagactaccaaaaggaagcgtggctacattaaaaataagctggtttttaagaaaggcaagaaaatatctaagaagactgtttaaatgcactgttctggttcctaacttgaagcagttgtccttgtgagaaccggtctttgcctttagctcatgtcgtgtttcacagcaaagagggtacagaaccatcactggtccaggttaatgtacaaaattttctggcaatgcctgattaaaaaaataaaattggcttgttgagaacagctgttttcgatttctaatgtgaagcaagacagagcactgctgtaaatgtctagcagcagattttttttttattggtacatattatccttcaaatctgagaatttggactaactgcaccaaagaaccctctaatttggtccctggcacatgcatacttgtcaatgtttttattcttttacaagacctgcattttatttgaattacccgaatagcaatatgtaaaatacaagtgacaaaatgtgatgagagcttcttgaaccggtaaactagtacaggtctgagaaagacatattagaagaatcattatacttccttgaattatatttattttcatgtttctctaatgcaaagaatgtttcatcaaatgtatattttctgttgcttactgtttgctctgagaagaagctgctgtttcaaagatggacctctgagtagctaattgattcaagtagtttttttatgttgacacattattactgctgttagcagtcgttttcaccaggtacttacagagcagatttcatacatcattcattcaagggctaaatttatattttttggaaatcatggcaactacacaggatgttgcttaccaggacggagttttggtatcttagtactgaagttagcactatgtttacatgcaaaagattaaggaaaaaacccttaaagtggacaggtatccaaagttcattttctgtgactcatcaaagtgacaaaagacttgtaacaactttgcctggacttttttcattttacaacagttcatccattcacaatgattttgttctctgctccatattttttaatcccttaagcatttgatgaaacactctttagtgctatatgcattttcttacttttgttaaaaatgtgacagttgtcaaaaaatgcactaaaatgtaaatggagattgaacaagttcactttccagcttataggcaactttatacagacttgaacattttctccagttgtttagtaaaagtgaaagagaaagggtttttcctgccacaggatataacttttttttatataacaagcataacacaccactgcttttggtggaaaagtgcagaatagtatgtaccttttatgaagaaaaatgtaatttacaatattcagtgagaatgttactgctgattttcttttccaaggtgtagaatattctttgatttatagaattcatttttgacccagatgatggttcctttacagaacaataaaatggctgaacattttcacaaatagagtgtaacgaagtctggatttctgataccttgtcatttgggggattttattttactttgttgctttaaaattcaatgcagagaagttgttgactgtaggggaaataaagttaattcaaattttgtgttaa

SEQ ID NO: 187184 - DNA, 3433 bp, Homo sapiens
  Payload ID: 16853
  Gene Symbol: STX16-NPEPL1
  Gene Name: STX16-NPEPL1 readthrough (NMD candidate)
  ENST ID: ENST00000530122
  CDS Start-End: 574-1722
ggttcagacaagtccccagaagggagctgcaggcgccctcgagtccaggccccaagcctggctccggttgtccaaagagggcctaggccaggcctctggtgcggaaactgagtcacagccagacctcagggcacggcctagacgcttacgagccaaagttaggggtagagagcagagacctccggggggtctcagggagtagggggcttcagggcctcccagtctagagccggattggcgagttagacgcttgtagatccaaggttggattggggtggggtctctgggacgttggatcgctacgcaaggattggggggattcaagtgcttagagatcgaagtctgccctgggtagggggagtcagacaattggaaagcctaggtagttatttggggaggggtctctacgccttggcgaagcgcacagctgcatctttttggcttgaggcctgaggccttgtcgagaagcttccgtgaaagggtgggccagccgggccacgagaaagaaagtgaataaatcaggaatataagtgggcggggggcccctgagaggggggtcgcaaagggtgagacatggccaccaggcgtttaaccgacgctttcttgttgttgcggaataattccatccaaaaccggcagctgttagccgagcaagtgagtagtcacatcacctccagccctctgcattcacgtagcattgctgcggagctggacgagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacagtcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggacttctcccacgtggaaggccttctttctcaatctcttcgcctgtggaagtcctattacatctgtcagggcatggccttagtctctcaccctctaggaagatcctccagctgtctcagtcctctggagtgccgtgtgcctgtctgcaacgtatttgcaaacagaaaaaagagtgagagatcttcatacacacttgcctgctctgtgccaggaactggaggaaaaaaaaacaacaaaaagtcaaaaagacctgccttcaggatgctgaagctctagtctgtggtgtttccaaggggccagggaccatggctcagagctgagcagacagacctggagcctgtggacagggaaggctggttatgaagaagaaactcaaaataacaggagtggcttatggaactacatggagctctggcaggctgccctgagcacgctcaaccccaaccccacggacagctgtcccctctacctgaactacgccaccgtggctgccctgccctgcagggtgagccggcacaacagcccctcggccgcccacttcatcacgcggctggtgcggacctgcctgccgcccggagcgcatcgctgcattgtgatggtctgcgagcagccggaggtctttgcttccgcctgtgccctggcccgggccttcccgctgttcacccaccgctcaggtgcctctcggcgcttggagaagaagacggtcaccgtggagtttttcctggtgggacaagacaacgggccggtggaggtgtccacattgcagtgcttagcgaatgccacagacggcgtgcggctagcagcccgcatcgtggacacaccctgcaatgagatgaacaccgacaccttcctcgaggagattaacaaagttggaaaggagctggggatcatcccaaccatcatccgggatgaggaactgaagacgagaggatttggaggaatctatggggttggcaaagccgccctgcatcccccagccctggccgtcctcagccacaccccagatggagccacgcagaccatcgcctgggtgggcaaaggcatcgtctatgacactggaggcctcagcatcaaagggaagagggcacggaaacgaatacagtggctcccggacctctttgggactgtggcctgatactccagcacagggggtactaccatgccggggatgaagcgagactgcgggggtgctgcggccgtcctgggggccttcagagccgcaatcaagcagggtttcaaagacaacctccacgctgtgttctgcttggctgagaactcggtggggcccaatgcgacaaggccagatgacatccacctgctgtactcagggaagacggtggaaatcaacaacacggatgccgagggcaggctggtgctggcagatggcgtgtcctatgcttgcaaggacctgggggccgacatcatcctggacatggccaccctgaccggggctcagggcattgccacagggaagtaccacgccgcggtgctcaccaacagcgctgagtgggaggccgcctgtgtgaaggcgggcaggaagtgtggggacctggtgcacccgctggtctactgccccgagctgcacttcagcgagttcacctcagctgtggcggacatgaagaactcagtggcggaccgagacaacagccccagctcctgtgctggcctcttcatcgcctcacacatcggcttcgactggcccggagtctgggtccacctggacattgctgcaccggtgcatgctggtgagcgagccacaggcttcggtgtggccctcctgctggcgctcttcggccgtgcctctgaggaccctctgctgaacctggtgtccccactgggctgtgaggtggatgtcgaggagggggacctggggagggactccaagagacgcaggcttgtgtgagcctcctgcctcggccctgacaaacggggatcttttacctcactttgcactgattaattttaagcaattgaaagattgcccttc

SEQ ID NO: 187185 - DNA, 3507 bp, Homo sapiens
  Payload ID: 16854
  Gene Symbol: SUB1
  Gene Name: SUB1 homolog, transcriptional regulator
  Uniprot ID: P53999
  ENST ID: ENST00000265073
  CDS Start-End: 129-512
gccccatcacgtgaccgcagccccagcgcggcggggccggcgtctcctggctgccgtcacttccggttctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaactgttgtggccttttttgatcataagagttggtactgtttaaggccaaaagtaacagtttttatagatcttttagtttcaactcagcttttacaataaaaaggatttgtattgcattgagtttataaacttttggtttgtgaacttcatatttgatcttttctcttccaatcaaatgtctaggcttgtttgacttccacccccaatggtttttcactctttttatttacttcattttcctttaataacttaatctcttcatgttcagtttttacttcactctttattcttttctttgattatggtatgcttatttggaaagtcagtgaaactgtcaaaatgttatctcaataagatacttatatgagaactacaatcaccgaatctactgtattcaatattagcagatctaatttgataaacaacatggcttgtgtgaaaactgagcaggtgtttgtttacccatagtgttctgtgtagttattgcttagtctgcagaaaataatgacttagatgagatgtctgacttgctttcacttattaaacatgttcaccatgggatgatgtctgtaacatcagatattgttcaactagactaggatttaataaaaattgtgaaagcttactggcctaacattttattttataatattgggtatgaattatatgtagccagagatgtcattaagctttactgttatagtaggtaatatggttagtttgtagggaaaagagcatatgagcacatgcttgtgtattttggcctttgccccagtagaacagaccaatggcattctagacttgatgatactaagttttagcagacactagtaagtggtttgtatttaaccatactgatgaagcagacagattgaggcacagattttagtggctttgtggcaataaatagggcatggtgtgccttaggaaaagaatgtttataaagggaattataactgaaattaaaggaggcggcagtgaagaggaaataattctcttctatctaaatgatatacatatgatattttgagatttttataacagcagtggaacacaattctaggtagagtagaaaaaggaaagttttaaagacatataaaagattcttgttgacaaattatttttggtagcaaatctcaaatggttacctgctattaaggtctgccatattagagttttgcactattttgctaccaagtttgattcatacatctaaaacattttgtagttacttgtcaaggacttaatttgaaaatcatttgccaggccacatagttatcaatttttttttctatcagctattctgttgtatttctaaaacattttttagatgactttttaaagtatatttagcagtaaccttatgaggttcaaattggtaaatctcttgtaatttagccttcatcgaataataggtaccagtgtattaaaaatgtgtattttttgcagccccttgaaccagagtaggttcagagaaactcccaaagtttgtactttagacacatcatgcttgattggtaacttccctccttttttggggaacatgtttgtgtcctattaacttaattggatagatttttaaatatttcttatttttggcacacggaaagggtagttcgagtacagaactttgatttttggtgtagatgcagagggaatgatgggtaaatttcctaggtttatgtgaatttagggggtgtatgcattttgaaacaatctactaacagatggtgctgaaatctattacctacatgttttctagttgttcagcattatgttaatgaagcctccatataaggagtgtttctctggcacagttggtaagttgactgctaacttcatttaaatgtgttactggatatgcagtatactgaaattattaatcagtttgtgtataggaaaagagaactgggttaaaagcaaattaacttgttctgaaaagaaagtatagattaattttgttttctgtttaaattttatctccttggtaaagatttttttttcctgggcagaaaacttggcatttttaggcgtagataccttaccttacaatgccaaaatgaatttaattccagtactcaggtttttccctttaacagactctatgtgtatcagggctttctaatgggtttttcctcttcgtttttaaaatgtgagtagcatttgaccaatttccagtgctcttagcattttacttaaagaacaaccactacaaaagaaaatctttgtaatttgattgtcttttgctttgcttcattaatgcctaagaacttaagaatactcctacctcattagctactcaagatgctgtgacgatcaaatctattctacataatgcgtttagaaacaaagacttgggtgaaaaatgaaataagtatattctgacttggctattgaggggaaaattcagtattaagtgttcctcacaggagatatgttagcagaatactataaaagtttgaaatttttaaaaagtaaaagtacttaaatttaggtatctctcctgaaattctttgcagttcattttttatggcagttaatccagtgaaacactcaaaagtttttttttttttaaaagtgtttttccagataaactgtagggtgaacattcacataatcacaaatatgtaattctgtaattgtggaatgcttgtatgctttgttttcgtacatcttccatggagatgtctgaatataatactccatctgtgaatattttaaatgttgaaataaaagtaagaaatgtg

SEQ ID NO: 187186 - DNA, 908 bp, Homo sapiens
  Payload ID: 16854
  Gene Symbol: SUB1
  Gene Name: SUB1 homolog, transcriptional regulator
  Uniprot ID: P53999
  ENST ID: ENST00000506237
  CDS Start-End: 286-669
aaaacagtcctcttagtgcaccagaagggaccttttggcaagtggcatcttgccagaaaattaactcaaaacaaatccctaacagctcagagatggtggaggggaatttcagaaacagtcagcagggcagggccatgcaactgcttacaggaattgcctcactcacactttgatgttgattctctgcagagcttccgctgcttcaaaacggcgtgcaggagtcagagacattacatcaggaagatactgcagagatattctactccatctcattcattgtacaggatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaat

SEQ ID NO: 187187 - DNA, 684 bp, Homo sapiens
  Payload ID: 16854
  Gene Symbol: SUB1
  Gene Name: SUB1 homolog, transcriptional regulator
  Uniprot ID: P53999
  ENST ID: ENST00000512913
  CDS Start-End: 185-568
gcagagcttccgctgcttcaaaacggcgtgcaggagtcagagacattacatcaggaagatactgcagagatattctactccatctcattcattgtacagattctaaactccctgaaggagacaaattaccagtggacaagaacacagcctctggagtccaataggcctggtgcattcattagggatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaaga

SEQ ID NO: 187188 - DNA, 1658 bp, Homo sapiens
  Payload ID: 16854
  Gene Symbol: SUB1
  Gene Name: SUB1 homolog, transcriptional regulator
  ENST ID: ENST00000511615
  CDS Start-End: 69-323
ttccggttctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcaggaattattcataacctttatcacaggggtccctcctgcacaggaggtgagcggtgtgtgagtgaacattgcagcccgagctctgcctcctgtcagatcagcagcggcattagattctcataggagcgcgaaccctattgtgaactgcgcatgcaagggatctaggttgtgcgttccttattccttatgagaatctaatgcctgatggtgggataatttttatcctgaaacgatcacctttccccttccctacctgctgtggaaaaattgtcttccgtgagactggtccctggtgccaaaaagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaactgttgtggccttttttgatcataagagttggtactgtttaaggccaaaagtaacagtttttatagatcttttagtttcaactcagcttttacaataaaaaggatttgtattgcattgagtttataaacttttggtttgtgaacttcatatttgatcttttctcttccaatcaaatgtctaggcttgtttgacttccacccccaatggtttttcactctttttatttacttcattttcctttaataacttaatctcttcatgttcagtttttacttcactctttattcttttctttgattatggtatgcttatttggaaagtcagtgaaactgtcaaaatgttatctcaataagatacttatatgagaactacaatcaccgaatctactgtattcaatattagcagatctaatttgataaacaacatggcttgtgtgaaaactgagcaggtgtttgtttacccatagtgttctgtgtagttattgcttagtctgcagaaaataatgacttagatgagatgtctgacttgctttcacttattaaacatgttcaccatgggatgatgtctgtaacatcagatattgttcaactagactaggatttaataaaaattgtgaaagcttactggcctaacattttattttataatattggg

SEQ ID NO: 187189 - DNA, 580 bp, Homo sapiens
  Payload ID: 16854
  Gene Symbol: SUB1
  Gene Name: SUB1 homolog, transcriptional regulator
  ENST ID: ENST00000510442
  CDS Start-End: 384-580
gttcgactgctagagccgagcgaagcgtgagtgcgcgggaccccctacccctactcctcggggcccccaccctcccagccgggccgtgagctgccttcggccctccactcctctcgccggcaatggccgcgggaaatggcggctctgccttacctcccccttcccctcggcgtccccggcccccttctccgtttctgactccacgcctgacgcgctgtgggcccttccgcggtagactcctgtccccggggagccgagtcgaggcggcgggcgctgcggcccggggcggtagattgagggcggccggggagtgaggagtcgcggggagagagtcgcggcgtccccgggacaatgcggcggcggcctgcctaggctcattaaggatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcaggt

SEQ ID NO: 187190 - DNA, 771 bp, Homo sapiens
  Payload ID: 16854
  Gene Symbol: SUB1
  Gene Name: SUB1 homolog, transcriptional regulator
  Uniprot ID: P53999
  ENST ID: ENST00000515355
  CDS Start-End: 190-573
gtcagtcgcgagcgaacgaccaagagggtgttcgactgctagagccgagcgaagccaaaggctgaagatttcgtttctctttttaaagttgcgttttgtataaattctacaatagtggtttcagtatcagttacttgaattacaagctgcttctccccccacccccacattggaacaggctcattaaggatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattac

SEQ ID NO: 187191 - DNA, 562 bp, Homo sapiens
  Payload ID: 16854
  Gene Symbol: SUB1
  Gene Name: SUB1 homolog, transcriptional regulator
  Uniprot ID: P53999
  ENST ID: ENST00000502897
  CDS Start-End: 113-496
gaccaagagggtgttcgactgctagagccgagcgaagctggtttcagtatcagttacttgaattacaagctgcttctccccccacccccacattggaacaggctcattaaggatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggct

SEQ ID NO: 187192 - DNA, 665 bp, Homo sapiens
  Payload ID: 16855
  Gene Symbol: SMR3A
  Gene Name: submaxillary gland androgen regulated protein 3A
  Uniprot ID: Q99954
  ENST ID: ENST00000226460
  CDS Start-End: 97-501
acctttattttctgtctttcaactggcaagagtcattttgaccagcaggttaatcaactctaagacagatcctcacgcaaagaggcaactgaaaggatgaaatcactgacttggatcttgggcctttgggctcttgcagcgtgtttcacacctggtgagagtcaaagaggccccaggggaccatatccacctggaccactggctcctcctcctccaccatgttttccttttggaacaggatttgttccaccaccccatcctccaccctatggtccagggagatttccaccacccctttctccaccctatggtccagggagaatcccaccatcccctcctccaccctatggtccagggagaattcaatcacactctcttcctcctccttatggcccaggttatccacagccaccttcccaaccaagaccctatccacctggacctccatttttccctgtaaattctccaactgatcctgccctccctactcctgcaccctaaatacagacaactgcaacaggtgccaccacccacaaaagacaacactaccctcgtaactactgcttctactacccaaaaataagaatttcaacactacttccaagagacttttagataaaatcacttccatttttggatgagaataaagatttccaaagcactga

SEQ ID NO: 187193 - DNA, 785 bp, Homo sapiens
  Payload ID: 16856
  Gene Symbol: SMR3B
  Gene Name: submaxillary gland androgen regulated protein 3B
  Uniprot ID: P02814
  ENST ID: ENST00000304915
  CDS Start-End: 150-389
gccaacagaaatccattacaatatataagagctaagatttcttgtcccttttcacctttatttgccgtctttcaactggcaagagtcattttgaccagcagattaatcaactgtaagacagatcctcacacaaagaggcaactgaaaggatgaaatcactgacttggatcttgggcctttgggctcttgcagcgtgtttcacacctggtgagagtcaaagaggccccaggggaccatatccacctggaccgctggctcctcctcaaccttttggcccaggatttgttccaccacctcctcctccaccctatggtccagggagaatcccacctcctcctcccgcaccctatggtccagggatatttccaccaccccctcctcaaccctaaggtccaccactccatcctgatgccccaggttatccacagcctccttcccgaccaagaccctatccacctggacctccatttttccctgtaaattctccaactgatcctaccctccctactcctgcaccccaaatatgaacaactgcagcaggtgccaccaccaccacaaaagacaccactacccttgtaactactgcttctactacccaaaatatgaattccaacactgcttccaagagacatttacataaaattgcttccatttttggatgagaatgaaaaattccaaaagtgctgagctttggggagaaataatcttagaaagaaattgtagaaaaaacccatgcagacataacatttataccaatgaggcaaaaataaagaattgagcaccaa

SEQ ID NO: 187194 - DNA, 489 bp, Homo sapiens
  Payload ID: 16856
  Gene Symbol: SMR3B
  Gene Name: submaxillary gland androgen regulated protein 3B
  Uniprot ID: P02814
  ENST ID: ENST00000504825
  CDS Start-End: 192-431
aacagaaacaagttgctgtgaattactcaacaaggtcctgtgtacttagctgacatgtggtgatggggtgaaaagaatgagtatgtgtgattcttcttaatattgttatttcaccctgattcaagagtcattttgaccagcagattaatcaactgtaagacagatcctcacacaaagaggcaactgaaaggatgaaatcactgacttggatcttgggcctttgggctcttgcagcgtgtttcacacctggtgagagtcaaagaggccccaggggaccatatccacctggaccgctggctcctcctcaaccttttggcccaggatttgttccaccacctcctcctccaccctatggtccagggagaatcccacctcctcctcccgcaccctatggtccagggatatttccaccaccccctcctcaaccctaaggtccaccactccatcctgatgccccaggttatccacagcctccttcccgaccaagac

SEQ ID NO: 187195 - DNA, 783 bp, Homo sapiens
  Payload ID: 16856
  Gene Symbol: SMR3B
  Gene Name: submaxillary gland androgen regulated protein 3B
  Uniprot ID: P02814
  ENST ID: ENST00000614072
  CDS Start-End: 150-389
gccaacagaaatccattacaatatataagagctaagatttcttgtcccttttcacctttatttgccgtctttcaactggcaagagtcattttgaccagcagattaatcaactgtaagacagatcctcacacaaagaggcaactgaaaggatgaaatcactgacttggatcttgggcctttgggctcttgcagcgtgtttcacacctggtgagagtcaaagaggccccaggggaccatatccacctggaccgctggctcctcctcaaccttttggcccaggatttgttccaccacctcctcctccaccctatggtccagggagaatcccacctcctcctcccgcaccctatggtccagggatatttccaccaccccctcctcaaccctaaggtccaccactccatcctgatgccccaggttatccacagcctccttcccgaccaagaccctatccacctggacctccatttttccctgtaaattctccaactgatcctaccctccctactcctgcaccccaaatatgaacaactgcagcaggtgccaccaccaccacaaaagacaccactacccttgtaactactgcttctactacccaaaatatgaattccaacactgcttccaagagacatttacataaaattgcttccatttttggatgagaatgaaaaattccaaaagtgctgagctttggggagaaataatcttagaaagaaattgtagaaaaaacccatgcagacataacatttataccaatgaggcaaaaataaagaattgagcacc

SEQ ID NO: 187196 - DNA, 1117 bp, Homo sapiens
  Payload ID: 16857
  Gene Symbol: SDHAF1
  Gene Name: succinate dehydrogenase complex assembly factor 1
  Uniprot ID: A6NFY7
  ENST ID: ENST00000378887
  CDS Start-End: 77-424
ctttggcctttgctggctgtgtggcggctccgcggttcgcaggtcgttcgctgagcgtctctgcttagccgcggtcatgagccggcacagccggctgcagaggcaggttctgagcctgtaccgcgatctgctgcgcgccgggcgtgggaagccgggcgccgaggcgcgagtgcgggcagagttccggcagcatgcgggcctgccgcggtccgacgtgctgcgcatcgagtacctgtaccgccgcgggcggcgccagctgcagctgctacgctcgggccacgccaccgccatgggcgccttcgtacgcccgcgggccccgaccggggagcctggcggcgtgggttgccagcctgacgacggcgacagtccaaggaacccccacgacagcacgggggcaccggagacccgccccgacggacggtgacaggcgaagagccgaactcgctcgatggcgtggtggagccaggaggctcgcctgactgcatggggggactggggaacccgcctaaggtgagaggtcttaagagactagcttgacgaattggggatgtcagagactcctccttggcgacgcagggggcctagagagccccgtgatggacggcaagggaggcccgccttttccgatgcttggagacaggtcggtgctcctcccccatgagggcttggggcggcctgggacgctggcgggctggacagtgtcaagccaagagctacttgcccgaaggtacggggagccaggacgacccccggtggacagggagagcctgagacgcccttctcttgacccctgagaacatacccacttctggctcctcaaggagtctcccctctcctgtatttaactctgagaagtgcagactttttgctgagaacgttttgggaaggtgccctgatgagcggtgagaagcccggaatccccttctggaaaactttcccccattaattgtgacaagccaggaccatgaggaaggggtaggggtctatcaccctggttgatcaactgaagacccccaaaggcccctacttgatggttttgaggggcaacattgactcatttgccccttccctctcggaatgttggacaaagggaataaaattggggatatgtctactt

SEQ ID NO: 187197 - DNA, 2033 bp, Homo sapiens
  Payload ID: 16858
  Gene Symbol: SDHAF2
  Gene Name: succinate dehydrogenase complex assembly factor 2
  Uniprot ID: Q9NX18
  ENST ID: ENST00000301761
  CDS Start-End: 75-575
cgtggtcggctggccgggcggctaggagttcccggaagtgcccgcgcagccggtttccggtgcaggtggggaaaatggcggtgtctacagtgttctcgacttcgtcgctgatgcttgctctgtcaaggcacagcctattgtctcctttgctcagtgtgacatcattcagacgcttctacagaggtgacagcccaacagattcccaaaaggacatgattgaaatccctttgcctccatggcaggagagaactgatgaatccatagaaaccaaaagagcccgcctgctctatgagagcagaaagaggggaatgttggaaaactgcattcttcttagtctttttgctaaagaacatctgcagcacatgacagaaaagcagctgaacctctatgaccgcctgattaacgagcctagtaatgactgggatatttactactgggccacagaagctaaaccagccccagaaatatttgaaaatgaagtcatggccctgctgagagactttgctaaaaacaaaaacaaagagcagagactgcgtgccccagatcttgagtacctctttgaaaagccacgttgagctgtgctccacggcctggcatgggggttcagtctgtggatggtaactacttatgatggacgttagccttgcttccggcttcttagatgcccagctgccctaccccagaccactggtcctgcctcaagtgatggacataaccctctcctaggacatacatgtaaatgcacaatgtgactcattctcatacttttttgttcagctctgagcctcaaaagtgatttgtcagcagcgctggcatgcaggctttgcctggctgctatctctagaggcaagtctgccacgagagggcactgcaggcgaagcagttgtgcttgctcattgcctcagcccaagtgtactcaaagaaaagaggcagccagctgtgcgtgctgtatggaaagcctcccgccctccctgcagctccccgccctcagtggcccagggctttgttgaagtggaactccccacttccaacctggtatggctccttctgcgaagggaagctgatcccagcctcctgagctgaatccttcaaaggcacagcaggcagaatgagggccacaggcaggagtggtgtgggcacactgcttaggagtcaacatcttcatcattgggctttctttaaaacgtgcactttgtaatttgaaagagaattattaaagcatactgaaaaaaggaaatttacaatttcccagccctcacaattaattttaattttgtctattttcatataacccatagtcatgtttatagagttttacaagttcacaattacaggttttattttcatgtagcactatagaaaactttccccctcattcctacagtcttcacaattagttgactaaataataatacataagaaataatatattagaatgaattagttagaagtgtttttaaaagctctagggctgtgtgacttctgtgttgctagtggtgccctccctggaggggttttgccctcagagctgtaatctaggcagtagaatcagtcacccagactggaccaggtgcatctaaaggtgttgactagaagaaggtcggccagatttgatgagcaggtggttggtgattataggagccgcacacagggactacacacgcacatgtttccagcattgttgagctccagggttcctacagagccacctcatggttcctgcctgctcttcagtatccctggtggctcaggagggaagggaagagatctagcctttacgtaatcacagttaagcctcacagcactctagactagtggtgttacctgtattttatacataagaaagtgggctcagagagaggaagtaatttgtccaaggtcaggtagctattgagtcgaaaaagcagaatttagtatagctcagtctgcctccaaagctcttgaactttctactagaacacactgccttactgctggaaatttaatagaagtctctgtttgggaaagctgtggcaaatagatgtgacagttct

SEQ ID NO: 187198 - DNA, 555 bp, Homo sapiens
  Payload ID: 16858
  Gene Symbol: SDHAF2
  Gene Name: succinate dehydrogenase complex assembly factor 2
  ENST ID: ENST00000359614
  CDS Start-End: 23-412
gtttccggtgcaggtggggaaaatggcggtgtctacagtgttctcgacttcgtcgctgatgcttgctctgtcaaggcacagcctattgtctcctttgctcagtgtgacatcattcagacgcttctacagaggtgacagcccaacagattcccaaaaggacatgattgaaatccctttgcctccatggcaggagagaactgatgaatccatagaaaccaaaagagcccgcctgctctatgagagcagaaagaggggaatgttggaaaactgcattcttcttagtctttttgctaaagaacatctgcagcacatgacagaaaagcagctgaacctctatgaccgcctgattaacgagcctagtaatgactgggatatttactactgggccacaggctggagtgcaatggcatgatctcggctcactgcaacctctaccttccaggttcaagcgattctccagcctcagcctcctgagtacctgggattacagaagctaaaccagccccagaaatatttgaaaatgaagtcatggccctgctgagagactttgctaaa

SEQ ID NO: 187199 - DNA, 1077 bp, Homo sapiens
  Payload ID: 16858
  Gene Symbol: SDHAF2
  Gene Name: succinate dehydrogenase complex assembly factor 2
  ENST ID: ENST00000542794
  CDS Start-End: 106-303
gcaccttccggctcagctcctccgtggctgccgtggtcggctggccgggcggctaggagttcccggaagtgcccgcgcagccggtttccggtgcaggtggggaaaatggcggtgtctacagtgttctcgacttcgtcgctgggaattggtttgtttgttgctgttggctcagtgtctccatcggggaaggaggatctggggtttcctactccaccatcttcacctcttgctgaggtcaccaccttgacatcatatcttgataagttgtcaacttctctggattgggagcctttgggggattagggatcatgctgtctctgtgtgctcaggatttgacacagatgcttgctctgtcaaggcacagcctattgtctcctttgctcagtgtgacatcattcagacgcttctacagaggtgacagcccaacagattcccaaaaggacatgattgaaatccctttgcctccatggcaggagagaactgatgaatccatagaaaccaaaagagcccgcctgctctatgagagcagaaagaggggaatgttggaaaactgcattcttcttagtctttttgctaaagaacatctgcagcacatgacagaaaagcagctgaacctctatgaccgcctgattaacgagcctagtaatgactgggatatttactactgggccacagaagctaaaccagccccagaaatatttgaaaatgaagtcatggccctgctgagagactttgctaaaaacaaaaacaaagagcagagactgcgtgccccagatcttgagtacctctttgaaaagccacgttgagctgtgctccacggcctggcatgggggttcagtctgtggatggtaactacttatgatggacgttagccttgcttccggcttcttagatgcccagctgccctaccccagaccactggtcctgcctcaagtgatggacataaccctctcctaggacatacatgtaaatgcacaatgtgactcattctcatacttttttgttcagctctgagcctcaaaagtgatttgtcagcagcgctggcatgcaggctttgcctggctgctatctctagag

SEQ ID NO: 187200 - DNA, 438 bp, Homo sapiens
  Payload ID: 16858
  Gene Symbol: SDHAF2
  Gene Name: succinate dehydrogenase complex assembly factor 2
  ENST ID: ENST00000543265
  CDS Start-End: 4-270
aaaatggcggtgtctacagtgttctcgacttcgtcgctgatgcttgctctgtcaaggcacagcctattgtctcctttgctcagtgtgacatcattcagacgcttctacagaggtgacagcccaacagattcccaaaaggacatgattgaaatccctttgcctccatggcaggagagaactgatgaatccatagaaaccaaaagagcccgcctgctctatgagagcagaaagaggggaatgttggaaaactgcattcttcttagaagctaaaccagccccagaaatatttgaaaatgaagtcatggccctgctgagagactttgctaaaaacaaaaacaaagagcagagactgcgtgccccagatcttgagtacctctttgaaaagccacgttgagctgtgctccacggcctggcatgggggttcagtctgtggatggt

SEQ ID NO: 187201 - DNA, 835 bp, Homo sapiens
  Payload ID: 16858
  Gene Symbol: SDHAF2
  Gene Name: succinate dehydrogenase complex assembly factor 2
  ENST ID: ENST00000542074
  CDS Start-End: 43-129
cggaagtgcccgcgcagccggtttccggtgcaggtggggaaaatggcggtgtctacagtgttctcgacttcgtcgctgaagctaaaccagccccagaaatatttgaaaatgaagtcatggccctgctgagagactttgctaaaaacaaaaacaaagagcagagactgcgtgccccagatcttgagtacctctttgaaaagccacgttgagctgtgctccacggcctggcatgggggttcagtctgtggatggtaactacttatgatggacgttagccttgcttccggcttcttagatgcccagctgccctaccccagaccactggtcctgcctcaagtgatggacataaccctctcctaggacatacatgtaaatgcacaatgtgactcattctcatacttttttgttcagctctgagcctcaaaagtgatttgtcagcagcgctggcatgcaggctttgcctggctgctatctctagaggcaagtctgccacgagagggcactgcaggcgaagcagttgtgcttgctcattgcctcagcccaagtgtactcaaagaaaagaggcagccagctgtgcgtgctgtatggaaagcctcccgccctccctgcagctccccgccctcagtggcccagggctttgttgaagtggaactccccacttccaacctggtatggctccttctgcgaagggaagctgatcccagcctcctgagctgaatccttcaaaggcacagcaggcagaatgagggccacaggcaggagtggtgtgggcacactgcttaggagtcaacatcttcatcattgggctttctttaaaacgtgcactttgtaattt

SEQ ID NO: 187202 - DNA, 559 bp, Homo sapiens
  Payload ID: 16858
  Gene Symbol: SDHAF2
  Gene Name: succinate dehydrogenase complex assembly factor 2
  ENST ID: ENST00000537782
  CDS Start-End: 23-424
gtttccggtgcaggtggggaaaatggcggtgtctacagtgttctcgacttcgtcgctgatgcttgctctgtcaaggcacagcctattgtctcctttgctcagtgtgacatcattcagacgcttctacagaggtgacagcccaacagattcccaaaaggacatgattgaaatccctttgcctccatggcaggagagaactgatgaatccatagaaaccaaaagagcccgcctgctctatgagagcagaaagaggggaatgttggaaaactgcattcttcttagtctttttgctaaagaacatctgcagcacatgacagaaaagcagctgaacctctatgaccgcctgattaacgagcctagtaatgactgggatatttactactgggccacaggttcaagcgattctccagcctcagcctcctgagtacctgggattacagaagctaaaccagccccagaaatatttgaaaatgaagtcatggccctgctgagagactttgctaaaaacaaaaacaaagagcagagactgcgtgccccagatcttgagtacctctttgaa

SEQ ID NO: 187203 - DNA, 523 bp, Homo sapiens
  Payload ID: 16858
  Gene Symbol: SDHAF2
  Gene Name: succinate dehydrogenase complex assembly factor 2
  ENST ID: ENST00000534878
  CDS Start-End: 24-449
ggtttccggtgcaggtggggaaaatggcggtgtctacagtgttctcgacttcgtcgctgatgcttgctctgtcaaggcacagcctattgtctcctttgctcagtgtgacatcattcagacgcttctacagaggtgacagcccaacagattcccaaaaggacatgattgaaatccctttgcctccatggcaggagagaactgatgaatccatagaaaccaaaagagcccgcctgctctatgagagcagaaagaggggaatgttggaaaactgcattcttcttagtctttttgctaaagaacatctgcagcacatgacagaaaagcagctgaacctctatgaccgcctgattaacgagcctagtaatgactgggatatttactactgggccacaggtactgggtatgataagcagcataatgtgaaaataggacagtttaggctgatttgagtctagaattgtatcctagataatttttttctttcttttttttttttgagactgagtttcactctcgttgccca

SEQ ID NO: 187204 - DNA, 659 bp, Homo sapiens
  Payload ID: 16858
  Gene Symbol: SDHAF2
  Gene Name: succinate dehydrogenase complex assembly factor 2
  ENST ID: ENST00000536250
  CDS Start-End: 17-214
ggtgcaggtggggaaaatggcggtgtctacagtgttctcgacttcgtcgctgggaattggtttgtttgttgctgttggctcagtgtctccatcggggaaggaggatctggggtttcctactccaccatcttcacctcttgctgaggtcaccaccttgacatcatatcttgataagttgtcaacttctctggattgggagcctttgggggattagggatcatgctgtctctgtgtgctcaggatttgacacagatgcttgctctgtcaaggcacagcctattgtctcctttgctcagtgtgacatcattcagacgcttctacagaggtgacagcccaacagattcccaaaaggacatgattgaaatccctttgcctccatggcaggagagaactgatgaatccatagaaaccaaaagagcccgcctgctctatgagagcagaaagaggggaatgttggaaaactgcattcttcttagtctttttgctaaagaacatctgcagcacatgacagaaaagcagctgaacctctatgaccgcctgattaacgagcctagtaatgactgggatatttactactgggccacaggtactgggtatgataagcagcataatgtgaaaataggacagtttaggctgatttgagtctagaattgtatcct

SEQ ID NO: 187205 - DNA, 731 bp, Homo sapiens
  Payload ID: 16859
  Gene Symbol: SDHAF3
  Gene Name: succinate dehydrogenase complex assembly factor 3
  ENST ID: ENST00000360382
  CDS Start-End: 2-208
tatgccggggcggcacgtttctcgagtccgggcattgtacaagcgcgtcttgcagctgcaccgtgttctgcccccggacctcaaatccctgggcgaccagtacgtgaaagacgaatttaggagacataagaccgttggttctgacgaggcacagcgtttcttgcaagaatgggagggtatgtccagaaatcttgatgcatgtatctgaaaagaaaatttctgtttcatgtgaagaattccgatttggtactttcagtgtatgcaacagcgttattgcaacaggctaacgaaaacagacaaaattcaactggaaaagcatgttttggcaccttcctcccagaagaaaaacttaatgactttcgtgatgaacaaattggacagttgcaggagctgatgcaagaagccacaaaacccaataggcaatttagtatttctgagtctatgaaaccaaaattttagtctatacaacaaagcttaataagacatgcaaaaatttagaacccctactttaactgtcattggtttttgaaatatatttaagctttgaaaacacctgttattaatgaaatactcttttattttggatattatgattgcagtatatggatcaagatcactagtgacaattgaaaaaaactattggaataatagcacttgtatgaaattcagttttggaactaaacagcaaatttctagaattttgctgaaaatgttttaaaatgctattctca

SEQ ID NO: 187206 - DNA, 2060 bp, Homo sapiens
  Payload ID: 16859
  Gene Symbol: SDHAF3
  Gene Name: succinate dehydrogenase complex assembly factor 3
  Uniprot ID: Q9NRP4
  ENST ID: ENST00000432641
  CDS Start-End: 1135-1512
agcctgtgattggctgaagctcagctacttgtcacaagaatatactctcagttgcagttaatttacatactaagttaggttgcagttccctacatagcaactcagagtagggaggaaattttaggccaaatttaatttaaattatgttggagcatgaccaaagttggtcatgaccagaagctgaacacagatatggaagctaacacaatatccagtggagagagattgtggtagagtacatggggcgaaatggttgatttctgcatttttgttggtgacgccatcaggatttgctgaagaaccaaacgtgtgacaggaaaggacaacacaaggagctgccagctttggaaaccagttctactctcagtattaccttcgcaaaagatagagctttgtaaatttctagattcctcgttcttattatcctagactatttaaccagaatctccagggtcgtggtcctggaaacaatacgtttaaaactcttcccaaggatccttcagcagccaacttgactttggctaaggagtccgccagctctgggctcacttgggttgtttgcaaggaagagcccatgcccagagtataaattgggagaacagcgctgtgcaaagagcgtgggttggtgagctagtggatggcgagattaatctcactctgatccctaaagcagggtgcagtaatactctaaatgcctcaaatgggttgggaaccatggaaggaatcccggaggagcccgatcttaacgaagcttttctcaggcctttggtaggaggacagaaacgaagttgaatgaaaaagacagtggagtgggactgagaaatgacaacggcccaccacagacctctctctttcaaggcctgtgtcgtcaggacgcaggccagaagaagccacgacgaggcgcaggcgcgactccacgagggccacgcccctcctagagaaggaccgacccgttttccgcccgcagcggagcttgggtttccgggaggacctgattgtgcaagggaccaaaccggatagaggtcgcgcgccctctttcgtctgccttccggttcactaatacgcaagttcgcagaagtgcgggaacgcgccgtccctctgcgcaggcgcagtcggcggtcggcgtggggcgctatgccggggcggcacgtttctcgagtccgggcattgtacaagcgcgtcttgcagctgcaccgtgttctgcccccggacctcaaatccctgggcgaccagtacgtgaaagacgaatttaggagacataagaccgttggttctgacgaggcacagcgtttcttgcaagaatgggaggtgtatgcaacagcgttattgcaacaggctaacgaaaacagacaaaattcaactggaaaagcatgttttggcaccttcctcccagaagaaaaacttaatgactttcgtgatgaacaaattggacagttgcaggagctgatgcaagaagccacaaaacccaataggcaatttagtatttctgagtctatgaaaccaaaattttagtctatacaacaaagcttaataagacatgcaaaaatttagaacccctactttaactgtcattggtttttgaaatatatttaagctttgaaaacacctgttattaatgaaatactcttttattttggatattatgattgcagtatatggatcaagatcactagtgacaattgaaaaaaactattggaataatagcacttgtatgaaattcagttttggaactaaacagcaaatttctagaattttgctgaaaatgttttaaaatgctattctcatccagccatattagtcttctggcttttctttagcttcatcaaataagcatgttgtgataatgatagatgtacaattccaacaaggttattattttttaaatacattgtcattctgaacattttatcacttctagtttaataatacatacatgatttttcttctgaatgtctcttctccctgcatcactgttcattcacaatgaaaggttaggaagaagctttaaaattcactattttactatcaatcatttgtataataaactatacaaagtataa

SEQ ID NO: 187207 - DNA, 1196 bp, Homo sapiens
  Payload ID: 16860
  Gene Symbol: SDHAF4
  Gene Name: succinate dehydrogenase complex assembly factor 4
  Uniprot ID: Q5VUM1
  ENST ID: ENST00000370474
  CDS Start-End: 25-351
gcggaggctcggggagtcggcgccatgaccccatcgaggcttccctggttgcttagctgggtctcggccacggcgtggagagcggcaagatcaccccttctgtgtcattctctgaggaaaacaagttcttctcaaggaggaaagtctgaacttgtcaaacagtcccttaagaagccgaagttaccagaaggtcgttttgatgcaccagaggattcccatttagagaaagaaccactggaaaaatttccagatgatgttaatccagtgaccaaagaaaaaggtggacccaggggcccagaacctacccgatatggagattgggaacgaaaaggacgctgtattgatttttaagtcgcatattctttaacttcaatattgttttctgaatatgtacatctgaattaacttatttctgattattttctttctttatatcctttatgtcgtgtagtttgtataatgtgtttaaatatatatatatatgatggctttggaagaaaatatgctgctgtaaattaggaaagggagaccagcctgaccaatatggagaaatctcgcctttactaaaaatacaaaattagccaggcgtggtggcatgcacctgtaatcccaactactctggaggctgaggcaggagaatggcttaaacccaggaggtggaggttgcggtgagctgaggtcgcgccattgcactccagcctgggcaacaagagcgaaactccgtctcaaaaaaaaagataggaaagggaaaatattttttcattaacatatattaatttaatgagtatagaaatgattcttgtttttttgagacagagtctctctctctcacccaggctggagtggagtggcactatcccaactcactgcaacttccgccccgccaggttcaagcaattctcctgcctcagcctcctgagtagctgggattacagacacccaccattgcgcctggctaatttttgtatttttagtaaagacaaggtttcaccatgttagccaggctggtctcgaactcctgacctcagttgatccacctgcctcagcctcccaaagtgctgggattgcaggtgtgagccaccacgcccagcctagaaatgattcttagagctgtaggcctttacttcatcatttttcagtttaaattaatcagttgcttataaaatgcatacataaataaaataatttttaaaaaa

SEQ ID NO: 187208 - DNA, 2390 bp, Homo sapiens
  Payload ID: 16861
  Gene Symbol: SDHA
  Gene Name: succinate dehydrogenase complex, subunit A, flavoprotein (Fp)
  Uniprot ID: P31040
  ENST ID: ENST00000264932
  CDS Start-End: 116-2110
tccggcgtggtgcgcaggcgcggtatcccccctcccccgccagctcgaccccggtgtggtgcgcaggcgcagtctgcgcagggactggcgggactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcacagggaggaatcaatgctgctctggggaacatggaggaggacaactggaggtggcatttctacgacaccgtgaagggctccgactggctgggggaccaggatgccatccactacatgacggagcaggcccccgccgccgtggtcgagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggaaggtctctgcgatatgataccagctattttgtggagtattttgccttggatctcctgatggagaatggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccctacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtccatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacggacctggtggagaccctggagctgcagaacctgatgctgtgtgcgctgcagaccatctacggagcagaggcacggaaggagtcacggggcgcgcatgccagggaagactacaaggtgcggattgatgagtacgattactccaagcccatccaggggcaacagaagaagccctttgaggagcactggaggaagcacaccctgtcctatgtggacgttggcactgggaaggtcactctggaatatagacccgtgatcgacaaaactttgaacgaggctgactgtgccaccgtcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgaacaaactttcttttatttccaaa

SEQ ID NO: 187209 - DNA, 630 bp, Homo sapiens
  Payload ID: 16861
  Gene Symbol: SDHA
  Gene Name: succinate dehydrogenase complex, subunit A, flavoprotein (Fp)
  ENST ID: ENST00000509564
  CDS Start-End: 1-306
ggaatggtctggaacacggacctggtggagaccctggagctgcagaacctgatgctgtgtgcgctgcagaccatctacggagcagaggcacggaaggagtcacggggcgcgcatgccagggaagactacaagagtaataagaaacgtgatggtgtttctggcctcaggtgcggattgatgagtacgattactccaagcccatccaggggcaacagaagaagccctttgaggagcactggaggaagcacaccctgtcctatgtggacgttggcactgggaaggtcactctggaatatagacccgtgatcgacaaaactttgaacgaggctgactgtgccaccgtcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgaacaaa

SEQ ID NO: 187210 - DNA, 704 bp, Homo sapiens
  Payload ID: 16861
  Gene Symbol: SDHA
  Gene Name: succinate dehydrogenase complex, subunit A, flavoprotein (Fp)
  ENST ID: ENST00000515815
  CDS Start-End: 1-380
ccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagagtaataagaaacgtgatggtgtttctggcctcaggtgcggattgatgagtacgattactccaagcccatccaggggcaacagaagaagccctttgaggagcactggaggaagcacaccctgtcctatgtggacgttggcactgggaaggtcactctggaatatagacccgtgatcgacaaaactttgaacgaggctgactgtgccaccgtcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgaacaaa

SEQ ID NO: 187211 - DNA, 583 bp, Homo sapiens
  Payload ID: 16861
  Gene Symbol: SDHA
  Gene Name: succinate dehydrogenase complex, subunit A, flavoprotein (Fp)
  ENST ID: ENST00000509632
  CDS Start-End: 30-299
ggcgggactgcgcggcggcaacagcagacatgtcgggggtccggggcctgtcgcggctgctgagcgctcggcgcctggcgctggccaaggcgtgcactgacacagcttgcaaactgttcgaaagcagtttaatcagaggaaaaagaaaaccaagaaacttcaatagttactggttaactgcttacttcagtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcacagggaggaatcaatgctgctctggggaacatggaggaggacaactggaggtggcatttctacgacaccgtgaagggctccgactggctgggggaccaggatgccatccactacatgacggagcaggcccccgccgccgtggtcgag

SEQ ID NO: 187212 - DNA, 2067 bp, Homo sapiens
  Payload ID: 16861
  Gene Symbol: SDHA
  Gene Name: succinate dehydrogenase complex, subunit A, flavoprotein (Fp)
  ENST ID: ENST00000504309
  CDS Start-End: 54-1805
gcaggcgcagtctgcgcagggactggcgggactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcacagggaggaatcaatgctgctctggggaacatggaggaggacaactggaggtggcatttctacgacaccgtgaagggctccgactggctgggggaccaggatgccatccactacatgacggagcaggcccccgccgccgtggtcgagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggaaggtctctgcgatatgataccagctattttgtggagtattttgccttggatctcctgatggagaatggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccctacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtccatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaaggtgcggattgatgagtacgattactccaagcccatccaggggcaacagaagaagccctttgaggagcactggaggaagcacaccctgtcctatgtggacgttggcactgggaaggtcactctggaatatagacccgtgatcgacaaaactttgaacgaggctgactgtgccaccgtcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgaacaaa

SEQ ID NO: 187213 - DNA, 2148 bp, Homo sapiens
  Payload ID: 16861
  Gene Symbol: SDHA
  Gene Name: succinate dehydrogenase complex, subunit A, flavoprotein (Fp)
  Uniprot ID: P31040
  ENST ID: ENST00000510361
  CDS Start-End: 39-1889
gcagggactggcgggactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcacagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggaaggtctctgcgatatgataccagctattttgtggagtattttgccttggatctcctgatggagaatggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccctacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtccatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacggacctggtggagaccctggagctgcagaacctgatgctgtgtgcgctgcagaccatctacggagcagaggcacggaaggagtcacggggcgcgcatgccagggaagactacaaggtgcggattgatgagtacgattactccaagcccatccaggggcaacagaagaagccctttgaggagcactggaggaagcacaccctgtcctatgtggacgttggcactgggaaggtcactctggaatatagacccgtgatcgacaaaactttgaacgaggctgactgtgccaccgtcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgaac

SEQ ID NO: 187214 - DNA, 1952 bp, Homo sapiens
  Payload ID: 16861
  Gene Symbol: SDHA
  Gene Name: succinate dehydrogenase complex, subunit A, flavoprotein (Fp)
  ENST ID: ENST00000617470
  CDS Start-End: 116-1675
tccggcgtggtgcgcaggcgcggtatcccccctcccccgccagctcgaccccggtgtggtgcgcaggcgcagtctgcgcagggactggcgggactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcacagggaggaatcaatgctgctctggggaacatggaggaggacaactggaggtggcatttctacgacaccgtcactggcgacggcacggccatgatcaccagggcaggccttccttgccaggacctagagtttgttcagttccaccctacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtccatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacggacctggtggagaccctggagctgcagaacctgatgctgtgtgcgctgcagaccatctacggagcagaggcacggaaggagtcacggggcgcgcatgccagggaagactacaaggtgcggattgatgagtacgattactccaagcccatccaggggcaacagaagaagccctttgaggagcactggaggaagcacaccctgtcctatgtggacgttggcactgggaaggtcactctggaatatagacccgtgatcgacaaaactttgaacgaggctgactgtgccaccgtcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgaacaaactttcttttatttcc

SEQ ID NO: 187215 - DNA, 1153 bp, Homo sapiens
  Payload ID: 16862
  Gene Symbol: SDHB
  Gene Name: succinate dehydrogenase complex, subunit B, iron sulfur (Ip)
  Uniprot ID: P21912
  ENST ID: ENST00000375499
  CDS Start-End: 152-994
acccgggaaaccggaagccgcctcccacttggttgctcgtacgcggctagtgggtcctcagtggatgtaggctgggcgccgcgatgttcgacgggacaccggcggagagcgacctcggggttaaggggtggggctgacgtcaggagccaagatggcggcggtggtcgccctctccttgaggcgccggttgccggccacaacccttggcggagcctgcctgcaggcctcccgaggagcccagacagctgcagccacagctccccgtatcaagaaatttgccatctatcgatgggacccagacaaggctggagacaaacctcatatgcagacttatgaagttgaccttaataaatgtggccccatggtattggatgctttaatcaagattaagaatgaagttgactctactttgaccttccgaagatcatgcagagaaggcatctgtggctcttgtgcaatgaacatcaatggaggcaacactctagcttgcacccgaaggattgacaccaacctcaataaggtctcaaaaatctaccctcttccacacatgtatgtgataaaggatcttgttcccgatttgagcaacttctatgcacagtacaaatccattgagccttatttgaagaagaaggatgaatctcaggaaggcaagcagcagtatctgcagtccatagaagagcgtgagaaactggacgggctctacgagtgcattctctgtgcctgctgtagcaccagctgccccagctactggtggaacggagacaaatatctggggcctgcagttcttatgcaggcctatcgctggatgattgactccagagatgacttcacagaggagcgcctggccaagctgcaggacccattctctctataccgctgccacaccatcatgaactgcacaaggacctgtcctaagggtctgaatccagggaaagctattgcagagatcaagaaaatgatggcaacctataaggagaagaaagcttcagtttaactgtttccatgctaaacatgatttataaccagctcagagctgaacataatttatatctaatttgagttcctttaaagatcttggttttccatgaatacagcatgtataataaaaattttaagaaataaatgttattctactttattaacaaaaaaaaaa

SEQ ID NO: 187216 - DNA, 649 bp, Homo sapiens
  Payload ID: 16862
  Gene Symbol: SDHB
  Gene Name: succinate dehydrogenase complex, subunit B, iron sulfur (Ip)
  ENST ID: ENST00000491274
  CDS Start-End: 50-649
agagctccctgtactttcccaacagtatcgctctttatattcatcgtgaatgtttaatttaactcttgttcactacaaagcctcccgaggagcccagacagctgcagccacagctccccgtatcaagaaatttgccatctatcgatgggacccagacaaggctggagacaaacctcatatgcagacttatgaagttgaccttaataaatgtggccccatggtattggatgctttaatcaagattaagaatgaagttgactctactttgaccttccgaagatcatgcagagaaggcatctgtggctcttgtgcaatgaacatcaatggaggcaacactctagcttgcacccgaaggattgacaccaacctcaataaggtctcaaaaatctaccctcttccacacatgtatgtgataaaggatcttgttcccgatttgagcaacttctatgcacagtacaaatccattgagccttatttgaagaagaaggatgaatctcaggaaggcaagcagcagtatctgcagtccatagaagagcgtgagaaactggacgggctctacgagtgcattctctgtgcctgctgtagcaccagctgccccagctactggtggaacggagacaaatatctggggcctgcagttcttatgcag

SEQ ID NO: 187217 - DNA, 702 bp, Homo sapiens
  Payload ID: 16862
  Gene Symbol: SDHB
  Gene Name: succinate dehydrogenase complex, subunit B, iron sulfur (Ip)
  ENST ID: ENST00000463045
  CDS Start-End: 334-702
ataggtcatttttgtaattccaggcaaggtctttgcagggcctcctgagggcaacagaaaatagaagagccccaaggcctccccttccttgtgggaatgtacatgtatacccacaaaagccacctcaaaagaattcagtaatgagcttggtgtgttacctgtgggtaacattcaggttcaggttctgaattctttttatgcttatagtctgaccactgaaccacaattctgcctgcctcccgaggagcccagacagctgcagccacagctccccgtatcaagaaatttgccatctatcgatgggacccagacaaggctggagacaaacctcatatgcagacttatgaagttgaccttaataaatgtggccccatggtattggatgctttaatcaagattaagaatgaagttgactctactttgaccttccgaagatcatgcagagaaggcatctgtggctcttgtgcaatgaacatcaatggaggcaacactctagcttgcacccgaaggattgacaccaacctcaataaggtctcaaaaatctaccctcttccacacatgtatgtgataaaggatcttgttcccgatttgagcaacttctatgcacagtacaaatccattgagccttatttgaagaagaaggatgaatctcaggaaggcaagcagcagtatctgcagtccatagaagagcgtgagaaactg

SEQ ID NO: 187218 - DNA, 1127 bp, Homo sapiens
  Payload ID: 16863
  Gene Symbol: SDHC
  Gene Name: succinate dehydrogenase complex, subunit C, integral membrane protein, 15kDa
  Uniprot ID: Q99643
  ENST ID: ENST00000342751
  CDS Start-End: 26-478
acttccgtccagaccggaacccaagatggctgcgctgttgctgagacacgttggtcgtcattgcctccgagcccactttagccctcagctctgtatcagaaatgctgttcctttgggaaccacggccaaagaagagatggagcggttctggaataagaatataggttcaaaccgtcctctgtctccccacattactatctacagttggtctcttcccatggcgatgtccatctgccaccgtggcactggtattgctttgagtgcagatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcaaaaactccccttttttgcccacagcttgcctactctcggcctagaagcagttattctctctccatattgggctttgatttgtgctgagggtcagcttttggctccttcttcctgagacagtggaaacaatgccagctctgtggcttctgccctggggatgggccgggttggggggtgggttggtgaggctttgggtgccactgcctgtgggttgctggcttaaaggacaattctcttcattggtgagagcccaggccattaacacctacacagtgttattgaaagaagagaggtgggggtggaggggaattagtctgtcccagctagagggagataaagagggctagttagttcttggagcagctgcttttgaggagaaaatatatagctttggacacgaggaagatctagaaaattatcattgaacatattaatggttatttctttttcttggatttccagaaaagcctcttaattttatgctttctcatcgaagtaatgtaccctttttttctgaaactgaattaaatactcattttatc

SEQ ID NO: 187219 - DNA, 13566 bp, Homo sapiens
  Payload ID: 16863
  Gene Symbol: SDHC
  Gene Name: succinate dehydrogenase complex, subunit C, integral membrane protein, 15kDa
  Uniprot ID: Q99643
  ENST ID: ENST00000367975
  CDS Start-End: 150-659
agctaggcagagctgagcggagaagctccagagccttttaaagagactctcgtcacatgacacccccaaccccgacccccagccggcgcgcctccgccctcgggtggcggggccgcctggcgtcacttccgtccagaccggaacccaagatggctgcgctgttgctgagacacgttggtcgtcattgcctccgagcccactttagccctcagctctgtatcagaaatgctgttcctttgggaaccacggccaaagaagagatggagcggttctggaataagaatataggttcaaaccgtcctctgtctccccacattactatctacagttggtctcttcccatggcgatgtccatctgccaccgtggcactggtattgctttgagtgcaggggtctctctttttggcatgtcggccctgttactccctgggaactttgagtcttatttggaacttgtgaagtccctgtgtctggggccagcactgatccacacagctaagtttgcacttgtcttccctctcatgtatcatacctggaatgggatccgacacttgatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcaaaaactccccttttttgcccacagcttgcctactctcggcctagaagcagttattctctctccatattgggctttgatttgtgctgagggtcagcttttggctccttcttcctgagacagtggaaacaatgccagctctgtggcttctgccctggggatgggccgggttggggggtgggttggtgaggctttgggtgccactgcctgtgggttgctggcttaaaggacaattctcttcattggtgagagcccaggccattaacacctacacagtgttattgaaagaagagaggtgggggtggaggggaattagtctgtcccagctagagggagataaagagggctagttagttcttggagcagctgcttttgaggagaaaatatatagctttggacacgaggaagatctagaaaattatcattgaacatattaatggttatttctttttcttggatttccagaaaagcctcttaattttatgctttctcatcgaagtaatgtaccctttttttctgaaactgaattaaatactcattttatctttgactctccttgaaatctagagaaaccaagaaaatggctgttgggaaggaaccaatttcctcctcttccctcgggtctcaggcatttacatcctccctctccccgcaatctgacctttaccaggagggaaacagttctcctacatctcatcattggaaaagttttcagggaatcagatagaacttagccagagatttaaatatcacagaaaagcctcagagaaggaaggagaaaaagaaaagaagtgacgcatgtagagtgcttttgggttataggcaccaaaatcccattaaggactgattataagcttcatggtacagttcagcaaattatgattcattgaggggcacagaggaccagtgttggtgacagctaggggatgatgacctgaggttataggcttggggtgaatgaagcatagagtttttttttaaaaaagaagggattgttgaaaacctggcaaaaatgtataatttaatgagaaaacttgctgcttttaaaatccatataggccaggctttagcaggcatgctgttttgatagtttttgggaactctggaataagagacttatctcatctgtcacttcgagttgttggccagccagttaaagctgtgggtcgaagaggggaaatgttaactggctggtgtcaattggataggaagaccttagttaaggtggggacccgctgttttaacagtcttcattcagggtcccaaatagtatttggctttaagtaatgattggttttccctttttactagaggggccctgggaagtccttgtacctttcctccattttaaaccagctgttctctactttgtccttggaatgagggacaagtgatcatgacagaacactttgtcattgggactgggaaaggtttggcaagggcattaaatttaacagccagtgccaggaaaatataaaatggggtcaatgataaacagctgttagaggctggaaaatgggtagggcagttgaattttttggtggtttcgtaccatttgggtgattgaagcatggtagtgggtgggtggggggtgtgacagagcatcatgtttgttattctgccttaaatttctacttactgtctttttcttctctgtcttccaatcactttaatatcttcaattttcaaactatatttgtacttgggcttagatagaaagtcttacacaagcatagtatcttctactttggttttccctaccttttcttccccaccttctccaaacacacatatacatactctactcaattctatttctgattttgtagttgttagttgtccatgctcaggataaaaaatgagtgggtagggttgagggactggttctttgaggttctgccctttttccatgattcagaccaactttctcttggtcatttctggagtataactgactcaattcttgtaaaaatgtgttccacccaaaccactgtatgttcttttccctactttattttctcctaccttccttctcctaattgtgttacaagaggcagccatagcaagaatggaaaatccagatcagtaaaagattcaacaaaaaaaagtttattttccaaatttgcttttactcccaccccaaaatttccctgtttcacagttctgactgggggctcttgtttatttcactgagtcgctatacgggtttttcagtgtgtggccacttggtccatatgaagttccaggtttgtatttctggacctcagctagattaggccctgcccagagttctagcatacgtggacttccaggtgggctcttaggatttggctggtctttggggacctggagtatgacctgcagaggggtgtgagctttggagttcatctggggaattgaggttggcagctggggagcttggaattatggttggacttcgtgcttgttgtacagtctttgtgatagacttctttctgagtttcttctgactgtctggatcatggggctgtcagtgataagagtgggagagatagtcatgtctctggtcaggcccggatcattcctaatgcacctcaggattctaactccctttctccccataccatgggcagtagatcaagtttcaaataagaaaagttaaatttgatttctctaaccaccctcccccaccttgagattagatcattttctactgttgggggtatgatgtccttagcccatcccttcaggcctcagaaggtgattaaggactagtcaagataagacaaattggttagaggtcccccatgctgggatagtggtggcataacaatagacattttttgaggttgaaaagaaattgagactacagggttttgggttagatgggaagaatagataccttgcctaagatttcaggacacagcccattggaggccttgagtaaatcaggatttttctgtatccatttggtgagggaggcagcaccagcagttgtacgggaggtcagggtcacccgagcagggggtatcttcagaggcatttgccaggtgcccatgaaggaaccccaaggatttgcctaaaaatgaaaagggattcctcagtagggcttctcactcccagtaactgacttagacctctgtattatttcctttctttacctttaggaatgcatggttatgaaacaagactgaaagcataatcttcccacccttccttatccccctccctcatttaggctttgcaggcctaattttttcatcccctttactctgccaacttaaattccacatccttaggccgagtgtggcaaaggagtacccactgcacaaatgtcatcacctgaaggctttcatttatacagatcattgatcaatttaagaacttctgaagggtgctaaacacaactctatcctgctgggtaagctggccggaagttcaggggctctcacattacaacatgaattagattaaactttaattttcccgataatggctgtgagagactgcacatctcccagttctgtgccttaattatttgactttcttgataggagtgaagatagtatctcaccttggaacggggcacagaaggcagtagatgaccacgatcgttggcaataatttgagtgtagccttcatgagaagagatgctctggggtacaagtgggagagataaaggtttgtgaggggaaaaagggaagtatttggggagcttggtcagagaaggatatgggagtttagagaatgctaaaaggagttaattgacagggagagcatgaggctatcttgtaggtgcactgaacatggaatacctcttttgttggcttagtgggagaccagttctgcagatacttggatgagaaagccttttcatactgtggagagaaagataagtagccctatgagacttcaaggccccaaacccaggaaatgaagactaggcacaattctttagatttgaagaccaaaggcctgaccaaccatgtaggctttaagtcactatgacaagggtgtaatttgtttggtctagatgtgtgctgtccagcatggagccgggagccacatggagctgttgagcacctgaaatatgactagttcaaattgaggtgctttgtaaatatgaaatatgctgaatttttaagtttttttcttttctttttttttttgagataggatcttggtctgccacctgggttggagtcagtggcatgatcctagctcactgcagccttggacacctgggttcaagcgatcctcctccctcagactcacaggtagctgggactacaggtgcatgccaccatgtccagctaatttttaaatttacttgtagagacgaggtctcaccatattgcccagggtggtctcaaacccctggcctcaagcgatccttgtgcctcagcctcccaaagtgttgggattacagacgtgagctacaacacccagcaggttttggagatttagtacaaaaaaagaacgtaaaatgtctgattataattttttaaatactgattaaatgttgaaataatatttggatttattgggttaaattcaatatatttaaattttatgttttaattttttcatgtagctactagaaaatttaaaattacatttgtgggtcgcactctttttgttgggcagcactggtctagatcaggagttggtaaactatggcctatgggccatatccatattgctgcctgtttggggatggcctgagagtaagggtgatttttatagatgaacatttacaattgattcagtcaaatggaacactaactttgaatcccagttaagtgaaatgttttctcaacccccaaaattccattattttcattagtagtacaaaaaattgtactcagttatattttgaatttgtcaaaaatgttatggaaaaatgtttttctttaattatgcaagtagctacagaatatttttgactttgccacttggcctgcaaagcctaaaatttttacactccgcccttttacagaaaaaaaattgccaacttctggtttacaccctacaaatttaaccaagagatacctttggatcgcccctgggctctctctatccctgaggaggtaaaatattatctcactccactctcagctatctgttcaaagatcagaatcctatgagaggggacagtccaaagatagaatctgaaaaacaaaagtaaacgttaaagaaatggagaatgggaacttacctggttggcactgtagttagtggccatgatcttgtgctgtttacactcgttgcttggcaactgcagaaggccgacctcctgggactaccaatgagcagaggctgcctttctcttctgcttattattattcacttccttggctcacactgcccccatttgttttctctggaacttagattcatttttattttacagacgggaaagactgagtaaatgtgagaaaattagctgaatagccactactttttttctggcataacctacccctgcttaagaacttccacgggcctttgattggggtttttaaccactttaacaaaccatgtaaccctgagagctatgcttgttggacaacatggtgtaatgtaccacaggctgtagagccagatactggggtttgaatccttattcaacatgggaacataggagctatatgacattaaacaactgtcttgtcttcactaaatttctatcaactcatttgtattgtggggataatagagcctgcttttacagggtaagtgagataaaatgaataaagtgtctagacaatatcatagcatagtaggtattcaatcctggtgagatcctgtttataaggcccactactttgtcttatcaggcagaataacaaaggaacaatatttaaaaagcaactagctcaaatctgtccccagaaggaaaaacatatcttgtccttggtccttaaaaaatttcctctgtcactgtctagaatcagcacctaagaacacaggcgtttagtgttgactggaataaaatggaatcgggtgctggtgcagggagattgagcagggatgaagagagaaaatcacagagtggaaaggatcaggtttggagagttcaatggggggctgccaggacataagcctaatatgtgtgggacaaggaaacccctctgaaactcataaaatggtattgtaatacccatctatgaggtggttaggagaattaataagtaagtagaactgtgctttgtgaattgtaaagtgaatttatatataaggtgtcaagatgaaagggaaaaactaagaaataagttgcccaaagatatcattaggaccaggagaccattataaagtatatccaggccgggcacggtggctcatgcctgtaatcccagcactttgggtggccgaagcagacggatcacaaggtcaggagttcgagaccagcctggccaacatggagaaaccctgtctctactaaaaatacaaaaaattagccaggcatggtggtgcatgcctctaatcccagctactcgggaggctgaggcaggagaattgcttgaacccgggaggcggaggttgcaatgagcagagatcatgctactactgcacttcagcctgggcgacagcgtgagactccgtctcaaaaaataaaaaataaataaagtatatccatcagtcccttctcttttccttcttcccccaaaatcctcatcttaaccaacacaccaagtataagagcactcctatgcttctgcagatggagggaagaacagctcttgttttataggctctggagttaatacctggataatgtgagatctggaaagataactcatgagcttagtccctgtggttcttatcactctctagagaagagttctttaaggaccaaggactatctttgctctaggatatccattttggccctttaatctgcaatgataggctagcattatttctcttagaatttgtcttcagttggtatgcctccctctgcctttctgataggaatgtaatgataaatgatgactgcactcatttttaaaagttaaccagtttttgttcaattgaaaaagtaatgtacatggaaaaaatttcatgtttacaggatgttcagtgaaaagcaaatctccatttgatttcaactctcagtcttgctcctcagggcaactgctgttactcatttcttgtgtctccttccagaaatcttctctgcatacaaacactaatgagagagctgtccacattgctttttgatttgctttttgactatcttggggattatgtttttatcataatattccattttgggatgcaccatagtttgttcagacccatatggatgaccatttagtttatttatagtcttttgctaataaggacattgctgtaatgaaaaatccctatgtatctttatgaatatgtatgtatgtatttttatgtacatatgtgatctgtaggataaatgttttaaagtacattgcaaagtcaaaagggtttgtgcatttaaaataagtagataggccgggtgcggtggctcacatctgtaatcccagcactttgggaggctgaggcgggcgatcacgaggtcaggagatcgagaccatcctggctaacatggtgaaaccccatctctactaaaaatacaaaacattagctgggcgtgtggcgggggcctgtagtcccagctactcaggaggctgaggcaggagaatggcgtgaacccaggaggcggagcttgcagtgagccacgatcgcgccactgcagtccagcctgggagacagagcgagactccgtctcaaaaataaataaataaataaaataaaataagtagataatgtcaaattaccactgaaagacattgtgccagtttgtacttctaccagtggtgtatgatggcgtatgagtgcctagttctctgctttcttttcaacatcatcgttttttctttttttttcagtttaaaccaattttaattgaactaatagaattgaactaatagaactaattgattgaactagtagaactaatgttaactgagcagttactatatacatgccaggcacagttctaattgctttactacattttctcatttagttctcaacccaaccaaggaaactggagaatacacagtgaggagtagagccaggatttaatcccaagtattctgactctagagccagcagttttaaccattatatcatattgcttgttaagctgtaggttaaacatggtatataattttattttttgtttttgttttgagacggtctccctgccgcctaagctctggagtgcagtggttccatcaatatcctgaggtcaagcaatcctcccaccttagcctcccaagtagttgggagtataggcatgagctaccatgcccagctaatttaaaaaaacaaattttttttaagagatagggtcttaactatattgttcctcttgtcttgaattcatggcctcaagtgattcttcgacctctggaagtgttgagattacaggcacgagccaccacacccacccaacatggtatatcattgttttaaatttgcatttctttaattagggtgtttttatatgtgtataaactgtttttattttaatttttttccctgaaaatggcctttaatgtattttgccacttactattgggctgttgacttttttttttgaaaccagtcctccctctgtcacccaggctggagtgcagtggcatcatcttggttcactgtaacttctgcctctcaggtccaaacaatcctcccacctcagcctcccgaataactggaactacagggatgcaccaccacacccagctgattttttaattttttttgtagagatgggattttgccatgttgcccaggctggttttgaactcctgggctcaagccatctgcccacctcagcttcccaaaaagctgggattacaggcttgagccactgcacccagcctgttgatcatgttcattaatctgtttgaactccatatattaaggaaattagtcctttgtcaaatatgttgcaaatattccctccaatttgtcacttactttcattttgttggtggtttttctgttttgttgttgtttttctgtgggtttttttttttttttttgccatggacatgtttttagtacttatgtagtagtcagatgtattactcattttttctgtgctctggatcttatgctttgaatggctttttgtgaattccaatattttaaaaataatttacccctagcttcagttcttacatttaaatatttgttccttctggaattttagtgaatgtggacaaggttatgcttcagttgccttaactagttgccttggcatcattaataagttttcttttcctctactgatttgaaatgccatttttaatgtattccctaacatatttgggtctgtttctggatcctctaacccactgttctagagagaaaggtgatcgttttagattatttgtctctctgtaatctaaaatccaaggtacacgctgggcacagtggctcacacgtgtaatcctagcactttcggaggctgaggcaggtggaacagttgaggacagaagttcgagaccagcctgaccaacatggcgaaactctgtttctactaaaaatacaaaaattagctgggcatggtgacacgtgcctgtagtcccagctactcgggaggctgaggcaagagaatcgcttgaacccgggaggtggaggttgcagtgagccgagattgcgccactgcactccatcccccgggcgacagagtgagactccatctcaaaaaaaagaaaaaaaaaggccaggcgcggtgactcacgcctgtaatcccagtactttgagaggctgagacgggaggatcacgagatcaagagatggagaccatcctggccaacatggtgaaaccccgtctctactaaaaatacaaaaattagctgggcgtagtggcgcgcgcctgtagtcccagctactccagaggctgaggcagaagaatcgcttgaacccgggaggcggaggttgcagtgagccgagattgcgccactgtgctccagcctggcgacagagtgagactccgtctaaaaaaaaaaaaaaaaaaatccaaggtggagtcctggcttgatcctatgtgaattctaatatttaagatttcaggccgggcgcggtggctcaggcctgtaatcccagcactttgggaggcccaggggggtggatcacaaggtcaggaaatcgagagcatgctggctaacacggtgaaactccgtctctgctaaaaatacaaaaaattagcccggcgtggtggggggtgcctgtagtcccagctactcgggaggctgaggcaggagaatggcgtgaacccgggaggtggagctggcagtgagccgagatcgcgccactgcactccagcctgggcgacagagcgagactccgtctcaacaaaaaaaagatttcactaggaaattgtaatatcagtagtaacaggcaattttaagcttctaataaaagtgtattgaattttagcctttcttcagatgaactggttgacttcaggtacagcagatggtcttttactaggaccagatttacttcttccaaagttggaagggctctttaaaggccccatcctttacgtatgccttaagatacttttttccattcacttaaattctttgatgactgaaactaaaccattaggaaatcttttatttggactgagattatctgctattgaagtacaagtttaacctgtactctataggcgatgtgtacattggacctacgtgaaggcaaccaccagcataagtactagagtcacattgcctggattaaattctggctttgcctaaatgtgtggccttacacaagttaatctttctgggtctcagtacccttacatgtaaaatggggataatcttagttttgagcattaaatatatgtaacatgctaatagggtgcaagatgcataatgaatgctcaattattttagcattattattggcttaagactgccaagtaagaagtactcattcaggttaccttaaacaaaaaaggggaagtggggaaattataattaataggagtatttaacagattccaaaggtaggaagtatagtttgggcttcaaaggatactagaatttcaaagatagaacatgatcagaaagattttctgtttcttctttatcatctctgtttctcactgcctttattcttttcttttctttttttttttttttttgagatggagtttcgctcttgttgcccaggctggagtgcaatgtgcgatctcggctcaccgcaacctccgcctcccgggttcaagcgagcgattctcctgcctcagcctcccgagtagctgagattttaggcatgcaccaccacacccggctaattttgtatttttagtagagacagggtttctccatgttggtcaggctggtctcgaatgcctgacctcagttgatccgcccacctcagcctcccaaagtgctgggattacaggcgtgagccaccgcgcccggcctcccatggcaatttttaaaaccagaaaaaattattagtaaccccttcatagtaaaaatggggcatttatctcatctattacacagtgtaaccacctgaatcactgtctctagttataccatcagctctctactaaggtttcttctaagtagctccaaggtgccctccatgtcacctcactgggtcaggtgttgatgggtcttggataggagacctggcttttgccccatttcctgggctaacaggatttcatccaaccaagctactggccaaattttgaactattcaaacaccctggtttttgtagatttccttataggaaatgaaggcgtagttctgacccctgaagagatgcatggctacaaatgtaaaagctatagtttcaaaacttctctatagagttaaaatagctgatccagttttctttcctgagactaaggctccctctctcggagactgctgttacatctctcctttccactgacaataccacaaaagaataatattcttgataagatccccttcctgaggagccaaagaacaagctttgtatactccccacacactgcctatggggtagccctctctgcagcattcatagagctatttaacactatttctttttcttttctttcattcctttttttttttttttttttttgagacagaatcttgctctgttgcccaggctggagtgcagtggcaccatctcagctcactgcaacctccgcctcccaggttcaagtgatcctcctgcttcagcccccctccatagctgggattataggcacacaccagcatgccctgctaattttagtatttttagtagagacagggtttcgccatgttggccaggctggtctggaactcctgacgtcaggtgatccacctgccttggcctcccaaagtcgttggattacaggcgtgagccactgtgcctggcctataacactatttcttaaaacaaaacaaaaagaccaaagaacaagctttaaacaaccaaaatgactgaaaagacatcagtatctctcactagtggtgtgaattaagtttgtttacttgcataactaagaataaatgatggttataatggcaccagtataggatatcttggctatgtgctttaacaatatacaggttgaccatgaagtctggaaatagatactattattttatcatgtatttaaatatattaataaaccattaatatgtattcattaa

SEQ ID NO: 187220 - DNA, 369 bp, Homo sapiens
  Payload ID: 16863
  Gene Symbol: SDHC
  Gene Name: succinate dehydrogenase complex, subunit C, integral membrane protein, 15kDa
  Uniprot ID: Q99643
  ENST ID: ENST00000392169
  CDS Start-End: 19-369
tccagaccggaacccaagatggctgcgctgttgctgagttggtctcttcccatggcgatgtccatctgccaccgtggcactggtattgctttgagtgcaggggtctctctttttggcatgtcggccctgttactccctgggaactttgagtcttatttggaacttgtgaagtccctgtgtctggggccagcactgatccacacagctaagtttgcacttgtcttccctctcatgtatcatacctggaatgggatccgacacttgatgtgggacctaggaaaaggcctgaagattccccagctataccagtctggagtggttgtcctggttcttactgtgttgtcctctatggggctggcagccatgtga

SEQ ID NO: 187221 - DNA, 460 bp, Homo sapiens
  Payload ID: 16863
  Gene Symbol: SDHC
  Gene Name: succinate dehydrogenase complex, subunit C, integral membrane protein, 15kDa
  Uniprot ID: Q99643
  ENST ID: ENST00000432287
  CDS Start-End: 25-432
cttccgtccagaccggaacccaagatggctgcgctgttgctgagacacgttggtcgtcattgcctccgagcccactttagccctcagctctgtatcagaaattggtctcttcccatggcgatgtccatctgccaccgtggcactggtattgctttgagtgcaggggtctctctttttggcatgtcggccctgttactccctgggaactttgagtcttatttggaacttgtgaagtccctgtgtctggggccagcactgatccacacagctaagtttgcacttgtcttccctctcatgtatcatacctggaatgggatccgacacttgatgtgggacctaggaaaaggcctgaagattccccagctataccagtctggagtggttgtcctggttcttactgtgttgtcctctatggggctggcagccatgtgaagaaaggaggctcccagcatcatcttcc

SEQ ID NO: 187222 - DNA, 369 bp, Homo sapiens
  Payload ID: 16863
  Gene Symbol: SDHC
  Gene Name: succinate dehydrogenase complex, subunit C, integral membrane protein, 15kDa
  Uniprot ID: Q99643
  ENST ID: ENST00000513009
  CDS Start-End: 19-369
tccagaccggaacccaagatggctgcgctgttgctgagacacgttggtcgtcattgcctccgagcccactttagccctcagctctgtatcagaaattggtctcttcccatggcgatgtccatctgccaccgtggcactggtattgctttgagtgcagatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttag

SEQ ID NO: 187223 - DNA, 571 bp, Homo sapiens
  Payload ID: 16863
  Gene Symbol: SDHC
  Gene Name: succinate dehydrogenase complex, subunit C, integral membrane protein, 15kDa
  ENST ID: ENST00000504963
  CDS Start-End: 16-219
agaccggaacccaagatggctgcgctgttgctgagacacgttggtcgtcattgcctccgagcccactttagccctcagctctgtatcagaaatgctgttcctttgggaaccacggccaaagaagagatggagcggttctggaataagaatataggttcaaaccgtcctctgtctccccacattactatctacagccctatcagtgatgcagtctggtaaagttggtctcttcccatggcgatgtccatctgccaccgtggcactggtattgctttgagtgcaggggtctctctttttggcatgtcggccctgttactccctgggaactttgagtcttatttggaacttgtgaagtccctgtgtctggggccagcactgatccacacagctaagtttgcacttgtcttccctctcatgtatcatacctggaatgggatccgacacttgatgtgggacctaggaaaaggcctgaagattccccagctataccagtctggagtggttgtcctggttcttactgtgttgtcctctatggggctggcagccatgtgaagaaaggaggctcccagca

SEQ ID NO: 187224 - DNA, 832 bp, Homo sapiens
  Payload ID: 16863
  Gene Symbol: SDHC
  Gene Name: succinate dehydrogenase complex, subunit C, integral membrane protein, 15kDa
  ENST ID: ENST00000470743
  CDS Start-End: 1-97
acacgttggtcgtcattgcctccgagcccactttagccctcagctctgtatcagaaaagtctcgttctgtcgaccaggctggagtgtagtggcgtgatctgggctcactgcaacctccacgtcctgagttcaagtgattatcctgcctcagcctcctaagtagccggaattacagtgctgttcctttgggaaccacggccaaagaagagatggagcggttctggaataagaatataggttcaaaccgtcctctgtctccccacattactatctacagttggtctcttcccatggcgatgtccatctgccaccgtggcactggtattgctttgagtgcaggggtctctctttttggcatgtcggccctgttactccctgggaactttgagtcttatttggaacttgtgaagtccctgtgtctggggccagcactgatccacacagctaagtttgcacttgtcttccctctcatgtatcatacctggaatgggatccgacacttgatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcaaaaactcccc

SEQ ID NO: 187225 - DNA, 1439 bp, Homo sapiens
  Payload ID: 16864
  Gene Symbol: SDHD
  Gene Name: succinate dehydrogenase complex, subunit D, integral membrane protein
  Uniprot ID: O14521
  ENST ID: ENST00000375549
  CDS Start-End: 136-615
gacgggtgtgcaccgcctctcgacttccggttcacccagcatttcctcttccctgttttctttcgtcgtcgtgggtgggaattgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccctgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataatttttttaaataaaatgttatataataaaagtgtcttctatgctttta

SEQ ID NO: 187226 - DNA, 861 bp, Homo sapiens
  Payload ID: 16864
  Gene Symbol: SDHD
  Gene Name: succinate dehydrogenase complex, subunit D, integral membrane protein
  Uniprot ID: O14521
  ENST ID: ENST00000526592
  CDS Start-End: 10-441
aggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggctggagtgcaatggtgcgatcttggctcggcacgatctcggctcagcacgatctcagcttactgcaacctccgcctttcgggttcaagcgattctcctgcctcagcctcccaagtagctggcattacaggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttc

SEQ ID NO: 187227 - DNA, 1071 bp, Homo sapiens
  Payload ID: 16864
  Gene Symbol: SDHD
  Gene Name: succinate dehydrogenase complex, subunit D, integral membrane protein
  ENST ID: ENST00000528021
  CDS Start-End: 36-350
gggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactgagatgggctttcaccatgctgtgtcggccattacccaactcctgggcttaagtgatccacctgcctcagcctcccaaagtgctgggattacaagcctgagccaccgcgcccagctgttaatcgtgacttaatacatgtgcatcttcccctgtttcctgtgtttgctttcataagtccactgctcctgctgtgaagatgggtacattcatctgtcatagcttaatgacaccaccttaaaatttgcagatgggttcatatacatcttattattcactcactcatatattaaaaaatatttaagtatctactatgtaccaggcactgtgctgggtcctggggatacagagatgaaaaagataccaggaggctgggcgtggtggctcacgcctgtaatcccagtactttgggaggccaaggtgagtggatcacttgaggtcaggagttcgcgaccagcctggccaacaggctgatggtgaaactccatctctactaaaaatacaaaaactagccgggcgtagtggtgcatgcctgtagtcccagctacttgggaggctgaggcaggagaatcgcttgaacctgggggagtggaggttgcagtgagccaagatcgtgcttgggcgacagagcaagactctgtctcaaaaaaaaaaaaaaaaaaaaagacaccagaagctcacagacttgatggacaggcacataagccaataaaatgtgttcaaagc

SEQ ID NO: 187228 - DNA, 717 bp, Homo sapiens
  Payload ID: 16864
  Gene Symbol: SDHD
  Gene Name: succinate dehydrogenase complex, subunit D, integral membrane protein
  ENST ID: ENST00000530923
  CDS Start-End: 1-305
tctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactgacctttccaaataaaagattccagttgcatatgaaatattagatcacaagtacagggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtg

SEQ ID NO: 187229 - DNA, 460 bp, Homo sapiens
  Payload ID: 16864
  Gene Symbol: SDHD
  Gene Name: succinate dehydrogenase complex, subunit D, integral membrane protein
  ENST ID: ENST00000534010
  CDS Start-End: 1-167
ctggctccaaggctgcatctctccactggactagcgagagggttgtcagtgttttgctcctgggtctgcttccggctgcttatttgaatccttgctctgcgatggactattccctggctgcagccctcactcttcatggtcactggaagatcaaaaataatgagtaatgtgtcatctaagagagaacactggaatccaacagagaacttacagaaaacaccagtagcaaggaaggagaaggaagcgaggaagtctgctcagctggggtcatctgggaacctatagaggctcccttaatgcggagaaaggagatgggctttcaccatgctgtgtcggccattacccaactcctgggcttaagtgatccacctgcctcagcctcccaaagtgctgggattacaagcctgagccaccgcgcccagctgttaatcgtgacttaatacatgtgcatcttcccctg

SEQ ID NO: 187230 - DNA, 754 bp, Homo sapiens
  Payload ID: 16864
  Gene Symbol: SDHD
  Gene Name: succinate dehydrogenase complex, subunit D, integral membrane protein
  ENST ID: ENST00000528182
  CDS Start-End: 37-432
cgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttctta

SEQ ID NO: 187231 - DNA, 905 bp, Homo sapiens
  Payload ID: 16864
  Gene Symbol: SDHD
  Gene Name: succinate dehydrogenase complex, subunit D, integral membrane protein
  Uniprot ID: O14521
  ENST ID: ENST00000528048
  CDS Start-End: 36-293
gggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattgggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatatta

SEQ ID NO: 187232 - DNA, 790 bp, Homo sapiens
  Payload ID: 16864
  Gene Symbol: SDHD
  Gene Name: succinate dehydrogenase complex, subunit D, integral membrane protein
  Uniprot ID: O14521
  ENST ID: ENST00000525291
  CDS Start-End: 10-372
aggaacgagatggcggttctctggaggctgagtgccgtttgcggtgccctaggaggccgagctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcaga

SEQ ID NO: 187233 - DNA, 516 bp, Homo sapiens
  Payload ID: 16864
  Gene Symbol: SDHD
  Gene Name: succinate dehydrogenase complex, subunit D, integral membrane protein
  Uniprot ID: O14521
  ENST ID: ENST00000614349
  CDS Start-End: 85-516
cctgttttctttcgtcgtcgtgggtgggaattgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggctggagtgcaatggtgcgatcttggctcggcacgatctcggctcagcacgatctcagcttactgcaacctccgcctttcgggttcaagcgattctcctgcctcagcctcccaagtag

SEQ ID NO: 187234 - DNA, 4181 bp, Homo sapiens
  Payload ID: 16865
  Gene Symbol: SUCNR1
  Gene Name: succinate receptor 1
  Uniprot ID: Q9BXA5
  ENST ID: ENST00000362032
  CDS Start-End: 106-1110
gtcagaagctatatccagctgctggcagagttcctgtcaagggatcaagtcttccaacagaatggttatggtttaactcagcagaatttgttgaacaactacgacatgctggggatcatggcatggaatgcaacttgcaaaaactggctggcagcagaggctgccctggaaaagtactacctttccattttttatgggattgagttcgttgtgggagtccttggaaataccattgttgtttacggctacatcttctctctgaagaactggaacagcagtaatatttatctctttaacctctctgtctctgacttagcttttctgtgcaccctccccatgctgataaggagttatgccaatggaaactggatatatggagacgtgctctgcataagcaaccgatatgtgcttcatgccaacctctataccagcattctctttctcacttttatcagcatagatcgatacttgataattaagtatcctttccgagaacaccttctgcaaaagaaagagtttgctattttaatctccttggccatttgggttttagtaaccttagagttactacccatacttccccttataaatcctgttataactgacaatggcaccacctgtaatgattttgcaagttctggagaccccaactacaacctcatttacagcatgtgtctaacactgttggggttccttattcctctttttgtgatgtgtttcttttattacaagattgctctcttcctaaagcagaggaataggcaggttgctactgctctgccccttgaaaagcctctcaacttggtcatcatggcagtggtaatcttctctgtgctttttacaccctatcacgtcatgcggaatgtgaggatcgcttcacgcctggggagttggaagcagtatcagtgcactcaggtcgtcatcaactccttttacattgtgacacggcctttggcctttctgaacagtgtcatcaaccctgtcttctattttcttttgggagatcacttcagggacatgctgatgaatcaactgagacacaacttcaaatcccttacatcctttagcagatgggctcatgaactcctactttcattcagagaaaagtgaggggcttgtgaaacagattgttctacagatgaatctgtaagccagttacagtttgccttaactcatagacatcaatcagagagtgtcacagatttaaccttgatctaaagacaagttgtacccagagtatgtgaaaagaatgggacgacaagaatgtactggtttcttcctctaagaattgaaaggagttgaactgccttatgtttgggcatgtaactccaaaatactaggtagtataaggctttctcaatcagtgcaaaaatggaagatatataaagcaacaagttgtctgcatttgatcactggtcagattgtaaaaaaaaaaaaaattgttttggcaacattctctatgttattcttattcacatgatcctagaactttatgtgagaactgaatagcagaagatatattattaaatagtttttggaagttgtgctgttaagcaaatgtaaagtcaacagtaacaatgattaagaaaggaatataatgagttcaaagatatctatctgatatattttttatattcatcatgaatcggggtagtcttgtaatttatctaacctttttgttgtatgggtttatagtggaaagaatcttaatttaaataaaaagaacctgaagagataattcaacaaaagtagagaatatgtttgagcttgtcagagaatttaagtatcaaaatactagagagatacaccaaggatatttgaataaaaaaaaaatttgtagaacacaaaatgcctatcaggaaacccaaagcaaaacagaacaaaaagtgaatacatcgttttaaatgatgattttgccatctggtattttattatcataatttgaccaccagtgcatgaaaatatattaaagttcattagccttctgctcttgatttaatagtgaactttaaaatatattaatatcataaaccagcaaataaggagaaataaactgataatactagattcattgggatagttttcccttttggagggaaagtcacaatttttctccatgatcccccattttttgtaaacactggaataatttacaaggataactttattgtagcgagagcaaatcacatctggagtgagccttgttttcatgcaacattaccataagaccattggagtaaatgtttcaaacaaaatgtacttcatgaaattatagaacataaaaatatttatgtgcatattaacctgtattatcccaggagggttaatgaggccccatttcctgcacaaaacaaatgtaggggaaaaaatgggtgctgcattagctttttaaagtcaaacaactatcacataataattccttgatatgcaacataaagtacctatggccacatatctaagttcctttccttgatgtcattagctataaggagtgagtaatgtgaaggacaaaataagcattatgaatacagagacataaaattccactgtcccttccttttctgaaatactctgggaggtattctgatatttttaaatcccccaattttcccagttgatatctctagacttcaagcaactgaaatattataaaaatgcattagtcacaaaagatttattttcttacatcacaccaggctttaagatattttctgccatgccttgcctttagtatcaatattttaaaaatttcactgtaattttataactgcctaataacaaactgaaaacagaacttctgagtttccttatcagaaagggccacagaaaaggccttaagaaagaaagattcacttacttctgcaaacttggcaatccgtaatttaactttaatttgtattttatgcatgaattttacttgtaaagacaaaattaaatttgcttcccctacatcccaactccaagaagtcacaggaatagactctttctaatagtgcagtgaaatattttttcaaaccataaactcacatatatatatatatatatatatatatatatatatatatatgtaccttgtaaacaagaggttaagaaattttatagcacattttaaaattattttcttcctcaaatctatcatgtggtaacttaatctttaacagactttagggccctaaactaaaattataagagctatttcatttgcttgttgtactgggtaattgtaagaatcacaaacaataaatcatgaaaatcctttctgggtttgtggtttctaaaggaaataatattgagcttttgtattttgtcttttaattggctccctggtatcttcagaatgatgtctagattcttcagtctggacccacctactcttctcacattatctcccatcactgttgtcacaaaccataccctatagctaaagattgctactttagtttattacattcagaactttcttcactttgttcacctgttgcccatctttgttctatcatacctgaatggtataataattctaaacaactttcaaggttcatctcatctgtcattctttgttgaagcttgcccttatatcctctcttccccaaacctaaaagtaaaactttctaccactggggcttcagatacttttaatactacttatttgaatttcattatttttattatagtttattattgtcttcatagctgagtactcttaaaattactgtttattataagtgaatgtcttacagaacaaactcaaagtcaatgcttcttttgcatgtgaataatcaagctatttttttgtcatcattactttagtaagtaacattattttatatgaagaatagagtgtatatacataaacccatgtgccagctgccattgcactgcctcacattttcctttagatgtttgagcatagttttaatgactgtttgaaatctctgtctcctagttccaaatatgggtcatcttggagttggtcttcattggtgccttttctcttcagtatgagtcataattttcctgtttctctatatgcctagtaaattagaattttattctagatgatgaataatgtgtggcagagattctggattctgttacattccatcaaagagtattgatattttgtatatacatttacaaatgtacatgtacacaataataaaaataatttttttctcaga

SEQ ID NO: 187235 - DNA, 2192 bp, Homo sapiens
  Payload ID: 16866
  Gene Symbol: SUCLA2
  Gene Name: succinate-CoA ligase, ADP-forming, beta subunit
  Uniprot ID: Q9P2R7
  ENST ID: ENST00000378654
  CDS Start-End: 86-1477
gagcgctgcagagaggctgcgccttgggccgcctgtcgcctgtgcgcctgcgcgcggcgccgaggggacggggtccgactcagaaatggcggcctccatgttctacggcaggctagtggccgtggccacccttcggaaccaccggcctcggacggcccagcgggctgctgctcaggttctgggaagttctggattgtttaataaccatggactccaagtacagcagcaacagcaaaggaatctctcactacatgaatacatgagtatggaattattgcaagaagctggtgtctccgttcccaaaggatatgtggcaaagtcaccagatgaagcttatgcaattgccaaaaaattaggttcaaaagatgtcgtgataaaggcacaggttttagctggtggtagaggaaaaggaacatttgaaagtggcctcaaaggaggagtgaagatagttttctctccagaagaagcaaaagctgtttcttcacaaatgattgggaaaaaattgtttaccaagcaaacgggagaaaagggcagaatatgcaatcaagtattggtctgtgagcgaaaatatcccaggagagaatactactttgcaataacaatggaaaggtcatttcaaggtcctgtattaataggaagttcacatggtggtgtcaacattgaagatgttgctgctgagtctcctgaagcaataattaaagaacctattgatattgaagaaggcatcaaaaaggaacaagctctccagcttgcacagaagatgggatttccacctaatattgtggaatcagcagcagaaaacatggtcaagctttacagcctttttctgaaatacgatgcaaccatgatagaaataaatccaatggtggaagattcagatggagctgtattgtgtatggatgcaaagatcaattttgactctaattcagcctatcgccaaaagaaaatctttgatctacaggactggacccaggaagatgaaagggacaaagatgctgctaaggcaaatctcaactacattggcctcgatggaaatataggctgcctagtaaatggtgctggtttggctatggccacaatggatataataaaacttcatggagggactccagccaacttccttgatgttggtggtggtgctacagtccatcaagtaacagaagcatttaagcttatcacttcagataaaaaggtactggctattctggtcaacatttttggaggaatcatgcgctgtgatgttattgcacagggtatagtcatggcagtaaaagacttggaaattaaaatacctgttgtggtacggttacaaggtacacgagtcgatgatgctaaggcactgatagcggacagtggacttaaaatacttgcttgtgatgacttggatgaagctgctagaatggttgtaaagctctctgaaatagtgaccttagcgaagcaagcacatgtggatgtgaaatttcagttgccaatatgatctgaaaacccagtggatggctgaaggtgttaaatgtgctataatcattaagaatactgtgttctgtgttattgttctttttctttttagtgtgtggagattgtaattgccatctaggcacacaaacatttaaaaggatttggactgcatttaattgtaccattcagaatggactgtttgtacgaagcatgtataatgcagttatcttctttcttttgtcgcagccagtcttttttgcttctcctacaaaacgtaacttgcaatttgccagtttattattgttggatacaaagttcttcattgataagagtcctataaataagataaatacgaagataaagctttattctttagtgttaaaatacagtatatctaataactagcctcattagtagagcagtatattaaaacaatgttttatgtaaaaagtgtttatcttcagcaccaaatacatgataaatgtatcaatcactatttataaacagagctttcaaacactcctcagaatattcttctaagtattttgatgaagtaactttgtaattatttgaacattgttttaatcattaggaaacactgattaactgcaagtcttcatgattctgtcatattaagaaacacctgtaggtttgcttcaaataaaggcatatataccaaggacttacagacaaaattaagaatgtcaatttaagttaataaaaatctcccaatatga

SEQ ID NO: 187236 - DNA, 894 bp, Homo sapiens
  Payload ID: 16866
  Gene Symbol: SUCLA2
  Gene Name: succinate-CoA ligase, ADP-forming, beta subunit
  ENST ID: ENST00000434484
  CDS Start-End: 1-894
agtggccgtggccacccttcggaaccaccggcctcggacggcccagcgggctgctgctcaggttcaaaagatgtcgtgataaaggcacaggttttagctggtggtagaggaaaaggaacatttgaaagtggcctcaaaggaggagtgaagatagttttctctccagaagaagcaaaagctgtttcttcacaaatgattgggaaaaaattgtttaccaagcaaacgggagaaaagggcagaatatgcaatcaagtattggtctgtgagcgaaaatatcccaggagagaatactactttgcaataacaatggaaaggtcatttcaaggtcctgtattaataggaagttcacatggtggtgtcaacattgaagatgttgctgctgagtctcctgaagcaataattaaagaacctattgatattgaagaaggcatcaaaaaggaacaagctctccagcttgcacagaagatgggatttccacctaatattgtggaatcagcagcagaaaacatggtcaagctttacagcctttttctgaaatacgatgcaaccatgatagaaataaatccaatggtggaagattcagatggagctgtattgtgtatggatgcaaagatcaattttgactctaattcagcctatcgccaaaagaaaatctttgatctacaggactggacccaggaagatgaaagggacaaagatgctgctaaggcaaatctcaactacattggcctcgatggaaatataggctgcctagtaaatggtgctggtttggctatggccacaatggatataataaaacttcatggagggactccagccaacttccttgatgttggtggtggtgctacagtccatcaagtaacagaagcatttaagcttatcacttcagataaa

SEQ ID NO: 187237 - DNA, 467 bp, Homo sapiens
  Payload ID: 16866
  Gene Symbol: SUCLA2
  Gene Name: succinate-CoA ligase, ADP-forming, beta subunit
  ENST ID: ENST00000433022
  CDS Start-End: 5-467
agaaatggcggcctccatgttctacggcaggctagtggccgtggccacccttcggaaccaccggcctcggacggcccagcgggctgctgctcagggtcctgtattaataggaagttcacatggtggtgtcaacattgaagatgttgctgctgagtctcctgaagcaataattaaagaacctattgatattgaagaaggcatcaaaaaggaacaagctctccagcttgcacagaagatgggatttccacctaatattgtggaatcagcagcagaaaacatggtcaagctttacagcctttttctgaaatacgatgcaaccatgatagaaataaatccaatggtggaagattcagatggagctgtattgtgtatggatgcaaagatcaattttgactctaattcagcctatcgccaaaagaaaatctttgatctacaggactggacccaggaagatgaaagggacaaag

SEQ ID NO: 187238 - DNA, 1445 bp, Homo sapiens
  Payload ID: 16866
  Gene Symbol: SUCLA2
  Gene Name: succinate-CoA ligase, ADP-forming, beta subunit
  ENST ID: ENST00000470760
  CDS Start-End: 5-580
agaaatggcggcctccatgttctacggcaggctagtggccgtggccacccttcggaaccaccggcctcggacggcccagcgggctgctgctcaggttctgggaagttctggattgtttaataaccatggactccaagtacagcagcaacagcaaaggaatctctcactacatgaatacatgagtatggaattattgcaagaagctggtgtctccgttcccaaaggatatgtggcaaagtcaccagatgaagcttatgcaattgccaaaaaattaggttcaaaagatgtcgtgataaaggcacaggttttagctggtggtagaggaaaaggaacatttgaaagtggcctcaaaggaggagtgaagatagttttctctccagaagaagcaaaagctgtttcttcacaaatgattgggaaaaaattgtttaccaagcaaacgggagaaaagggcagaatatgcaatcaagtattggtctgtgagcgaaaatatcccaggagagaatactactttgcaataacaatggaaaggtcatttcaagtgagtaattgtagacatgatacatacgggataaatttatgacattcaatttcaaaagtccattattgtttctatttatgtgggaaagattttaaaagtacaaattataatctgtttgtatgtcatgagcatgatatttatgtcatttaaaaaacagcttctttaatgccgtaaaatttgatatataatatcatgatcttaaaattataggaaaaattctgctgtaataaatttcatgggattctcaaattgttaattcactaaaagcagcttaaatcatctctggatcatctccagattgagaaaattatatctagcatagtaaaatattctaatgaaagagaaagttgctgaacccactagaagaatgtgtatccattgcctcatcttctgttttctcaacttcttgggtttgtttttttttttttaatagtttcgggtttgtttcactatatgattcaatatttggtaaattgagggatgacattaagtagcaaacaatatggttttaaggagtattacattagcacagctctcctctctttatggaacctaaaatgttgaacataaagcttctggtgaagagaaaatccctttatagacctggtgtttggaagagagcattgataatcattttatactagaattatctgtttttcgagggtattaggttttacaagctgaatctgtgtgttaactagcttgttttttgaagcaactgggtatatatttgaaagccccagtacggatttcatgtagaacattaattgtgtagaatttagagtaacaaaaattttaagagtcatgaaaataattttcttatgtagaacaacttttttaaaaataacaactttctgtattgtgatttttcttatttacaattaaatctattaatgtttgaatgata

SEQ ID NO: 187239 - DNA, 552 bp, Homo sapiens
  Payload ID: 16866
  Gene Symbol: SUCLA2
  Gene Name: succinate-CoA ligase, ADP-forming, beta subunit
  ENST ID: ENST00000493152
  CDS Start-End: 1-243
tgtgatgttattgcacagggtatagtcatggcagtaaaagacttggaaattaaaatacctgttgtggtacggttacaaggtacacgagtcgatgatgctaaggcactgatagcggacagtggacttaaaatacttgcttgtgatgacttggatgaagctgctagaatggttgtaaagctctctgaaatagtgaccttagcgaagcaagcacatgtggatgtgaaatttcagttgccaatatgatctgaaaacccagtggatggctgaaggagttgattgaccaccagttgagagcctgcagttcatcagttgagagtgacaattccagagtgaccagctgagcatgtaatatgaaggaaactggagaaaagcctcaactactttatgattattcctatgatttgttcttaaagcagagaagcatctttttatttgtttttgatatccttgtttgatgaaaccagcatcgttttagaaaaaatatctttgttttagtaaaaatgacacatactcattgaaaaaataaaccccttcaaaactggaatgatacaa

SEQ ID NO: 187240 - DNA, 902 bp, Homo sapiens
  Payload ID: 16866
  Gene Symbol: SUCLA2
  Gene Name: succinate-CoA ligase, ADP-forming, beta subunit
  ENST ID: ENST00000497202
  CDS Start-End: 1-411
gcggcctccatgttctacggcaggctagtggccgtggccacccttcggaaccaccggcctcggacggcccagcgggctgctgctcaggttctgggaagttctggattgtttaataaccatggactccaagtacagcagcaacagcaaaggaatctctcactacatgaatacatgagtatggaattattgcaagaagctggtgtctccgttcccaaaggatatgtggcaaagtcaccagatgaagcttatgcaattgccaaaaaattaggtacagaagaaagaaataatatgtgcaggataaactgtaactatgagtatttctggcaagttctctgggaccagaactcacaagtaataagaagcaggttcaaaagatgtcgtgataaaggcacaggttttagctggtggtagaggaaaaggaacatttgaaagtggcctcaaaggaggagtgaagatagttttctctccagaagaagcaaaagctgtttcttcacaaatgattgggaaaaaattgtttaccaagcaaacgggagaaaagggcagaatatgcaatcaagtattggtctgtgagcgaaaatatcccaggagagaatactactttgcaataacaatggaaaggtcatttcaaggtcctgtattaataggaagttcacatggtggtgtcaacattgaagatgttgctgctgagtctcctgaagcaataattaaagaacctattgatattgaagaaggcatcaaaaaggaacaagctctccagcttgcacagaagatgggatttccacctaatattgtggaatcagcagcagaaaacatggtcaagctttacagcctttttctgaaatacgatgcaaccatgatagaaataaatccaatggtggaagattcagatggagctgatgaag

SEQ ID NO: 187241 - DNA, 832 bp, Homo sapiens
  Payload ID: 16866
  Gene Symbol: SUCLA2
  Gene Name: succinate-CoA ligase, ADP-forming, beta subunit
  ENST ID: ENST00000634878
  CDS Start-End: 1-314
catttcaaggtcctgtattaataggaagttcacatggtggtgtcaacattgaagatgttgctgctgagtctcctgaagcaataattaaagaacctattgatattgaagaaggcatcaaaaaggaacaagctctccagcttgcacagaagatgggatttccacctaatattgtggaatcagcagcagaaaacatggtcaagctttacagcctttttctgaaatacgatgcaaccatgatagaaataaatccaatggtggaagattcagatggagctgatgaagatttaccaacattggcactattgacattttaggtattgtgtatggatgcaaagatcaattttgactctaattcagcctatcgccaaaagaaaatctttgatctacaggactggacccaggaagatgaaagggacaaagatgctgctaaggcaaatctcaactacattggcctcgatggaaatataggctgcctagtaaatggtgctggtttggctatggccacaatggatataataaaacttcatggagggactccagccaacttccttgatgttggtggtggtgctacagtccatcaagtaacagaagcatttaagcttatcacttcagataaaaaggtactggctattctggtcaacatttttggaggaatcatgcgctgtgatgttattgcacagggtatagtcatggcagtaaaagacttggaaattaaaatacctgttgtggtacggttacaaggtacacgagtcgatgatgctaaggcactgatagcggacagtggacttaaaatacttgcttgtgatgacttggatgaagctgctagaatggt

SEQ ID NO: 187242 - DNA, 1475 bp, Homo sapiens
  Payload ID: 16867
  Gene Symbol: SUCLG1
  Gene Name: succinate-CoA ligase, alpha subunit
  Uniprot ID: P53597
  ENST ID: ENST00000393868
  CDS Start-End: 212-1252
atgttaatcaaacccacatttctaggaaggagccgagttattatctgcctctccgataggatgcctctttgtcttcacctgccattcccgctgtttcgtgaagaatcctctgtaaagggaaatttgttcaggcgactgctgtggccaccctctgcctcctccggcctctgcccctgggaggtccccgggggcctgggagtgtcattggcgtatgaccgcaacccttgccgctgccgctgacatcgctaccatggtctccggcagcagcggcctcgccgccgcccgtctcctgtcgcgcagcttcctcctgccgcagaatggaattcggcattgttcctacacagcttctcggcaacatctctatgttgataaaaatacaaagattatttgccagggtttcactggcaaacagggcacctttcacagccagcaggcattggaatatggcaccaaactcgttggaggaaccactccagggaaaggaggccagacacatctgggcttacctgtctttaatactgtgaaggaggccaaagaacagacaggagcaacggcttctgtcatttatgttcctccgccttttgctgctgctgccattaatgaagctattgaggcagaaattcccttggttgtgtgtatcactgaaggaattccccagcaggacatggtacgagtcaagcacaaactgctgcgccaggaaaagacaaggctaattgggcccaactgccctggagtcatcaatcctggagaatgtaaaattggcatcatgcctggccatattcacaaaaaaggaaggattggcattgtgtccagatctggcaccctgacttatgaagcagttcaccaaacaacgcaagttggattggggcagtctttgtgcgttggcattggaggtgatccttttaatggaacagattttattgactgcctcgaaatctttttgaacgattctgccacagaaggcatcatattgattggtgaaattggtggtaatgcagaagagaatgctgcagaatttttgaagcaacataattcaggtccaaattccaagcctgtagtgtccttcattgctggtttaactgctcctcctgggagaagaatgggtcatgccggggcaattattgctggaggaaaaggtggagctaaagagaagatctctgcccttcagagtgcaggagttgtggtcagtatgtctcctgcacagctgggaaccacgatctacaaggaatttgaaaagaggaagatgctatgaaagaaaaaaaaaattcctaaaactgtggaatggatcacgtagacatgtaacccagcagcagtttgcttctgttgtccactgattaatcagcctatgtgcctgacactggtcttgcagtacaactggaagccaaaacaaggtggaagatgtcctgaattaagatgttttcaccacattgtattacagagacagccaataaatctactatttgatttcaatatgg

SEQ ID NO: 187243 - DNA, 568 bp, Homo sapiens
  Payload ID: 16867
  Gene Symbol: SUCLG1
  Gene Name: succinate-CoA ligase, alpha subunit
  ENST ID: ENST00000442240
  CDS Start-End: 1-316
aacccttgccgctgccgctgacatcgctaccatggtctccggcagcagcggcctcgccgccgcccgtctcctgtcgcgcagcttcctcctgccgcagaatggaattcggcattgttcctacacagcttctcggcaacatctctatgttgataaaaatacaaagattatttgccagggtttcactggcaaacaggaactccttctgttaacaaggcacctttcacagccagcaggcattggaatatggcaccaaactcgttggaggaaccactccagggaaaggaggccagacacatctgggcttacctgtctttaatactgtgaaggaggccaaagaacagacaggagcaacggcttctgtcatttatgttcctccgccttttgctgctgctgccattaatgaagctattgaggcagaaattcccttggttgtgtgtatcactgaaggaattccccagcaggacatggtacgagtcaagcacaaactgctgcgccaggaaaagacaaggctaattgggcccaactgccctggagtcatcaatcctggagaatgtaaaattggcatcat

SEQ ID NO: 187244 - DNA, 2352 bp, Homo sapiens
  Payload ID: 16868
  Gene Symbol: SUCLG2
  Gene Name: succinate-CoA ligase, GDP-forming, beta subunit
  Uniprot ID: Q96I99
  ENST ID: ENST00000307227
  CDS Start-End: 29-1327
ctgccccgtgccgagtttcctgtttaagatggcgtcccccgtagcagcgcaggccgggaagcttctgcgagccctagcgctgcggccccgcttcctggcggccgggtcccaggcagttcaattaacctccagaagatggctgaacctgcaggaataccagagcaagaaactgatgtctgacaacggagtgagagttcaaagattctttgtagcagacactgcaaatgaagctctcgaggctgctaagagactaaatgcaaaagaaattgttttaaaagcccagatcttagctggaggaagaggaaaaggtgtcttcaatagtggtttgaaaggaggtgttcatttaacaaaagaccctaatgttgtgggacagctggctaaacagatgattgggtacaatctagcgacaaaacaaactccaaaagaaggtgtgaaagttaacaaggtgatggttgctgaagccttggatatttccagagaaacctacctggcaattctgatggaccggtcctgcaatggccccgtgctggtgggcagcccccaggggggcgtcgacattgaagaggtggctgcttcaaacccggagctcatttttaaggagcaaattgacatttttgaaggaataaaggacagccaagctcagcggatggccgaaaatctaggcttcgttgggcctttgaaaagccaggctgcagatcaaattacgaagctgtataatctcttcctgaaaattgatgctactcaggtggaagtgaatccctttggtgaaactccagaaggacaagttgtctgttttgatgccaagataaactttgatgacaacgcagaattccgacaaaaagacatatttgctatggacgacaaatcagagaatgagcccattgaaaatgaagctgccaaatatgatctaaaatacataggactagatgggaacattgcctgctttgtgaatggtgctgggctcgccatggctacttgtgatatcattttccttaatggtgggaagccagccaacttcttggatcttggaggtggtgtaaaggaagctcaagtatatcaagcattcaaattgctcacagctgatcctaaggttgaagccatccttgtcaatatatttggtggtatcgtcaactgtgccatcattgccaatgggatcaccaaagcctgccgggagctagaactcaaggtgcccctggtggtccggcttgaaggaaccaacgtccaagaggcccagaagatactcaacaacagcggactccccattacttcagccattgacctggaggatgcagccaagaaggctgtggccagtgtggccaagaagtgatgtctttgtcctgatccaatggagaaagaaagccatttttccgtaaaaagggatggttcatcattgtgaaagaaatggttatctcattggggaagaaaaggggagggggaaggcaagaatcactgaaaaatcttaaatctgtgttttctggaataagatatctagacagcctaaatctgattttggtctttataaaaataatatcttgtgttctcatacttttctgtcactgtaagcctgcccagtaggcagtgttttgcagactttggggagtggtctatgtggccaaatattgtgtgtatagacagaatttgaaatcaagtcctgcttcatttacaagaattttggtgggcatctaatcctacataatgaaaaagaaaaacagaccatttaaaaactcagacaagattatatttaatatattaattactaaaaaggcataagattacactgaacatattagctactaaaaaggcactgctaagacattcaagcaaatagctattacacactactgcagattttacaggtttctaattctaacatatgtttgaaaaatccgtgagtattccaaaatatatttaataatggaatatctgcattaatataccatccatgtgtttttaccatttgccttaatattgaatatactgtttacctcacactaaaaagaaaaccagaagccttatttgtgattttgggagtggaagcttccatttttgtgtcaaaaatgaatcctgattcttatggaaatctctgttattaagatatttcaagatgagacaacactgaagatcaaattgtgtttagtatcactatcttctctcctcgtttctctcttactcctcatcctcccagaatctaccagtttatggtagaaagatgggaaccttatttgaatgtgttttttttttccatgatgtccaattttgttgtgggaaaggatttggataaaatttttgtttaaattttggtagatttttatctatacaaatttaaataaaattatgttttgtaagctgtaa

SEQ ID NO: 187245 - DNA, 1596 bp, Homo sapiens
  Payload ID: 16868
  Gene Symbol: SUCLG2
  Gene Name: succinate-CoA ligase, GDP-forming, beta subunit
  ENST ID: ENST00000460567
  CDS Start-End: 1-571
ccctaatgttgtgggacagctggctaaacagatgattgggtacaatctagcgacaaaacaaactccaaaagaaggtgtgaaagttaacaaggtgatggttgctgaagccttggatatttccagagaaacctacctggcaattctgatggaccggtcctgcaatggccccgtgctggtgggcagcccccaggggggcgtcgacattgaagaggtggctgcttcaaacccggagctcatttttaaggagcaaattgacatttttgaaggaataaaggacagccaagctcagcggatggccgaaaatctaggcttcgttgggcctttgaaaagccaggttgaagccatccttgtcaatatatttggtggtatcgtcaactgtgccatcattgccaatgggatcaccaaagcctgccgggagctagaactcaaggtgcccctggtggtccggcttgaaggaaccaacgtccaagaggcccagaagatactcaacaacagcggactccccattacttcagccattgacctggaggatgcagccaagaaggctgtggccagtgtggccaagaagtgatgtctttgtcctgatccaatggagaaagaaagccatttttccgtaaaaagggatggttcatcattgtgaaagaaatggttatctcattggggaagaaaaggggagggggaaggcaagaatcactgaaaaatcttaaatctgtgttttctggaataagatatctagacagcctaaatctgattttggtctttataaaaataatatcttgtgttctcatacttttctgtcactgtaagcctgcccagtaggcagtgttttgcagactttggggagtggtctatgtggccaaatattgtgtgtatagacagaatttgaaatcaagtcctgcttcatttacaagaattttggtgggcatctaatcctacataatgaaaaagaaaaacagaccatttaaaaactcagacaagattatatttaatatattaattactaaaaaggcataagattacactgaacatattagctactaaaaaggcactgctaagacattcaagcaaatagctattacacactactgcagattttacaggtttctaattctaacatatgtttgaaaaatccgtgagtattccaaaatatatttaataatggaatatctgcattaatataccatccatgtgtttttaccatttgccttaatattgaatatactgtttacctcacactaaaaagaaaaccagaagccttatttgtgattttgggagtggaagcttccatttttgtgtcaaaaatgaatcctgattcttatggaaatctctgttattaagatatttcaagatgagacaacactgaagatcaaattgtgtttagtatcactatcttctctcctcgtttctctcttactcctcatcctcccagaatctaccagtttatggtagaaagatgggaaccttatttgaatgtgttttttttttccatgatgtccaattttgttgtgggaaaggatttggataaaatttttgtttaaattttggtagatttttatctatacaaatttaaataaaattatgttttgtaagctgtaa

SEQ ID NO: 187246 - DNA, 1512 bp, Homo sapiens
  Payload ID: 16868
  Gene Symbol: SUCLG2
  Gene Name: succinate-CoA ligase, GDP-forming, beta subunit
  ENST ID: ENST00000492795
  CDS Start-End: 22-1161
gtgccgagtttcctgtttaagatggcgtcccccgtagcagcgcaggccgggaagcttctgcgagccctagcgctgcggccccgcttcctggcggccgggtcccaggcagttcaattaacctccagaagatggctgaacctgcaggaataccagagcaagaaactgatgtctgacaacggagtgagagttcaaagattctttgtagcagacactgcaaatgaagctctcgaggctgctaagagactaaatgcaaaagaaattgttttaaaagcccagatcttagctggaggaagaggaaaaggtgtcttcaatagtggtttgaaaggaggtgttcatttaacaaaagaccctaatgttgtgggacagctggctaaacagatgattgggtacaatctagcgacaaaacaaactccaaaagaaggtgtgaaagttaacaaggtgatggttgctgaagccttggatatttccagagaaacctacctggcaattctgatggaccggtcctgcaatggccccgtgctggtgggcagcccccaggggggcgtcgacattgaagaggtggctgcttcaaacccggagctcatttttaaggagcaaattgacatttttgaaggaataaaggacagccaagctcagcggatggccgaaaatctaggcttcgttgggcctttgaaaagccaggctgcagatcaaattacgaagctgtataatctcttcctgaaaattgatgctactcaggtggaagtgaatccctttggtgaaactccagaaggacaagttgtctgttttgatgccaagataaactttgatgacaacgcagaattccgacaaaaagacatatttgctatggacgacaaatcagagaatgagcccattgaaaatgaagctgccaaatatgatctaaaatacataggactagatgggaacattgcctgctttgtgaatggtgctgggctcgccatggctacttgtgatatcattttccttaatggtgggaagccagccaacttcttggatcttggaggtggtgtaaaggaagctcaagtatatcaagcattcaaattgctcacagctgatcctaagcagcaaaatttgaaagcaagaaatacttgggcaccagaatacaggactcagaagcacgttcttgaagcttggaaataggaccaatatggagctggaactcctgactcatcttgggagtctctgattatagagagactgccagagggagtggaacgaacatggactttacagtaagaccgccttaatttaaatcttgacaccattgcctactgctgtgtgatgtttaagctcattgagtttatttaccagggaaagttataatacataattttagcacctaggaaaattaacactcaataaaccttaatcctccatacagttttgcttattctaccaaggagtaaattatagaatataagtaaagtgaagaatttaggaagaagagaatagacagaataaggacagattggagtctaattagacccattt

SEQ ID NO: 187247 - DNA, 1516 bp, Homo sapiens
  Payload ID: 16868
  Gene Symbol: SUCLG2
  Gene Name: succinate-CoA ligase, GDP-forming, beta subunit
  Uniprot ID: Q96I99
  ENST ID: ENST00000493112
  CDS Start-End: 25-1347
cccgtgccgagtttcctgtttaagatggcgtcccccgtagcagcgcaggccgggaagcttctgcgagccctagcgctgcggccccgcttcctggcggccgggtcccaggcagttcaattaacctccagaagatggctgaacctgcaggaataccagagcaagaaactgatgtctgacaacggagtgagagttcaaagattctttgtagcagacactgcaaatgaagctctcgaggctgctaagagactaaatgcaaaagaaattgttttaaaagcccagatcttagctggaggaagaggaaaaggtgtcttcaatagtggtttgaaaggaggtgttcatttaacaaaagaccctaatgttgtgggacagctggctaaacagatgattgggtacaatctagcgacaaaacaaactccaaaagaaggtgtgaaagttaacaaggtgatggttgctgaagccttggatatttccagagaaacctacctggcaattctgatggaccggtcctgcaatggccccgtgctggtgggcagcccccaggggggcgtcgacattgaagaggtggctgcttcaaacccggagctcatttttaaggagcaaattgacatttttgaaggaataaaggacagccaagctcagcggatggccgaaaatctaggcttcgttgggcctttgaaaagccaggctgcagatcaaattacgaagctgtataatctcttcctgaaaattgatgctactcaggtggaagtgaatccctttggtgaaactccagaaggacaagttgtctgttttgatgccaagataaactttgatgacaacgcagaattccgacaaaaagacatatttgctatggacgacaaatcagagaatgagcccattgaaaatgaagctgccaaatatgatctaaaatacataggactagatgggaacattgcctgctttgtgaatggtgctgggctcgccatggctacttgtgatatcattttccttaatggtgggaagccagccaacttcttggatcttggaggtggtgtaaaggaagctcaagtatatcaagcattcaaattgctcacagctgatcctaaggttgaagccatccttgtcaatatatttggtggtatcgtcaactgtgccatcattgccaatgggatcaccaaagcctgccgggagctagaactcaaggtgcccctggtggtccggcttgaaggtacttttatggaaaaaaaaggaagttatatgcacataaaacaagaaacaggaaattcaaatgagaatataactggtatccaagagaacgtcgcccaccaaaatctgagtaagtgtgccatcagcatttttttatgttaaagatttactttgctaagatacttgctgagattacttttccaaattaatgaatatcatcacaaaattatttttttacatttgggttcagctgcatgctaatggaaatggaaaatggaagggcatggcttatagctgttcattcaccaaaaatattttagaattgtgtcca

SEQ ID NO: 187248 - DNA, 1645 bp, Homo sapiens
  Payload ID: 16869
  Gene Symbol: SUGCT
  Gene Name: succinyl-CoA:glutarate-CoA transferase
  Uniprot ID: Q9HAC7
  ENST ID: ENST00000335693
  CDS Start-End: 24-1361
gttcgccgcttgcaccgggaccgatgccatctgagacgcacgcgatgctggcgacgctggcgagggtggcagctctgcgcagaacctgcctcttctccggccggggcggcgggagggggctgtggactggccgcccgcagtcagatatgaacaatataaagccattggaaggggtaaaaattctggatctaacaagagtcctggcgggaccttttgctactatgaatttaggagatcttggagcagaagttataaaagtggagagaccaggagctggtgatgatacacgaacttgggggccaccttttgttgggacagaaagtacatattatctcagtgttaaccgaaataaaaaaagtattgctgttaatatcaaggatccaaaaggggtgaaaatcatcaaagagcttgcagctgtttgtgatgtgtttgtggaaaactatgtccctggcaaactgtctgcaatgggcctgggatatgaagatatagacgagattgctcctcacatcatctattgttccatcacagggtatggtcagacaggtccaatttctcagcgagctggttatgatgctgttgcctcggctgtttctggtctgatgcacatcacagggcctgagaatggagatccagttcgcccaggagtagctatgactgatcttgccactggcctgtatgcatatggagctattatggctggattgatacaaaaatacaaaactgggaaaggactgttcattgattgtaacctactgtcatcccaggtggcgtgtttgtctcacatagctgcaaattatcttattggtcaaaaggaagcaaaacgttggggtacagctcatggcagtatcgttccttaccaggcttttaaaaccaaggatggctatattgtagttggagcaggaaataaccagcagtttgccaccgtctgcaagatcttggatttgcctgagttgattgataattccaagtataaaactaaccaccttcgggtacacaatagaaaagagcttattaaaatattatctgaacggtttgaagaagaactgaccagcaagtggttatatctttttgaaggcagtggagtcccgtatggcccaatcaacaacatgaagaatgtatttgcagaacctcaggtattacacaatggcctcgttatggagatggagcatccaactgtggggaagatttccgtcccaggcccagctgtgagatacagtaagttcaagatgtcagaggccaggccgcccccgctgctcgggcagcacacaacgcacatcctgaaggaggtcctgagatacgatgacagggccatcggggagctgctcagcgctggagtggtggaccaacatgaaactcactgacaaaggaaaagggctcttcctcataacctcgatccgaatacactggcaaaggcaacactttgcttggacccttctccccagttctgataccactaaaaagaagatttagagtaactccagatttcttacatggcatctccagaatggctctggtattaatgaatctagtgccttttaaatgtatcccacgttttgttccctaccatcttttttttcagatgatgatttcattatggatttgtgggatttttaaaaataaagttttaatttttttcctggaaaaa

SEQ ID NO: 187249 - DNA, 1369 bp, Homo sapiens
  Payload ID: 16869
  Gene Symbol: SUGCT
  Gene Name: succinyl-CoA:glutarate-CoA transferase
  Uniprot ID: Q9HAC7
  ENST ID: ENST00000401647
  CDS Start-End: 24-1217
gttcgccgcttgcaccgggaccgatgccatctgagacgcacgcgatgctggcgacgctggcgagggtggcagctctgcgcagaacctgcctcttctccggccggggcggcgggagggggctgtggactggccgcccgcagtcagatatgaacaatataaagccattggaaggggtaaaaattctggatctaacaagagtcctggcgggaccttttgctactatgaatttaggagatcttggagcagaagttataaaagtggagagaccaggagctggtgatgatacacgaacttgggggccaccttttgttgggacagaaagtacatattatctcagtgttaaccgaaataaaaaaagtattgctgttaatatcaaggatccaaaaggggtgaaaatcatcaaagagcttgcagctgtttgtgatgtgtttgtggaaaactatgtccctggcaaactgtctgcaatgggcctgggatatgaagatatagacgagattgctcctcacatcatctattgttccatcacagggtatggtcagacaggtccaatttctcagcgagctggttatgatgctgttgcctcggctgtttctggtctgatgcacatcacagggcctgaggtggcgtgtttgtctcacatagctgcaaattatcttattggtcaaaaggaagcaaaacgttggggtacagctcatggcagtatcgttccttaccaggcttttaaaaccaaggatggctatattgtagttggagcaggaaataaccagcagtttgccaccgtctgcaagatcttggatttgcctgagttgattgataattccaagtataaaactaaccaccttcgggtacacaatagaaaagagcttattaaaatattatctgaacggtttgaagaagaactgaccagcaagtggttatatctttttgaaggcagtggagtcccgtatggcccaatcaacaacatgaagaatgtatttgcagaacctcaggtattacacaatggcctcgttatggagatggagcatccaactgtggggaagatttccgtcccaggcccagctgtgagatacagtaagttcaagatgtcagaggccaggccgcccccgctgctcgggcagcacacaacgcacatcctgaaggaggtcctgagatacgatgacagggccatcggggagctgctcagcgctggagtggtggaccaacatgaaactcactgacaaaggaaaagggctcttcctcataacctcgatccgaatacactggcaaaggcaacactttgcttggacccttctccccagttctgataccactaaaaagaagatttagagtaactccagatttcttacatggcatctccagaatggctctg

SEQ ID NO: 187250 - DNA, 1593 bp, Homo sapiens
  Payload ID: 16869
  Gene Symbol: SUGCT
  Gene Name: succinyl-CoA:glutarate-CoA transferase
  ENST ID: ENST00000416370
  CDS Start-End: 1-1265
acgcgatgctggcgacgctggcgagggtggcagctctgcgcagaacctgcctcttctccggccggggcggcgggagggggctgtggactggccgcccgcagtcagatatgaacaatataaagccattggaaggggtaaaaattctggatctaacaagagtcctggcgggaccttttgctactatgaatttaggagatcttggagcagaagttataaaagtggagagaccaggagctggtgatgatacacgaacttgggggccaccttttgttgggacagaaagtacatattatctcagtgttaaccgaaataaaaaaagtattgctgttaatatcaaggatccaaaaggggtgaaaatcatcaaagagcttgcagctgtttgtgatgtgtttgtggaaaactatgtccctggcaaactgtctgcaatgggcctgggatatgaagatatagacgagattgctcctcacatcatctattgttccatcacagggtatggtcagacaggtccaatttctcagcgagctggttatgatgctgttgcctcggctgtttctggtctgatgcacatcacagggcctgagaatggagatccagttcgcccaggagtagctatgactgatcttgccactggcctgtatgcatatggagctattatggctggattgatacaaaaatacaaaactgggaaaggactgttcattgattgtaacctactgtcatcccaggtggcgtgtttgtctcacatagctgcaaattatcttattggtcaaaaggaagcaaaacgttggggtacagctcatggcagtatcgttccttaccaggcttttaaaaccaaggatggctatattgtagttggagcaggaaataaccagcagtttgccaccgtctgcaagatcttggatttgcctgagttgattgataattccaagtataaaactaaccaccttcgggtacacaatagaaaagagcttattaaaatattatctgaacggtttgaagaagaactgaccagcaagtggttatatctttttgaaggcagtggagtcccgtatggcccaatcaacaacatgaagaatgtatttgcagaacctcaggtatcctcccttgttttgcctctgatgagctgcagagtttcttggcgcttggtgcatggaaacggccacttctgttcagatgtgggaacgcaccactggcgcgtgtggcccactctccatgtgcgctgtgccagcacagctgctagttcaactggaaattgctttgggtgaagtacaaggcctggaacatggcgtaggaatggagactttgataaagtgaaaaggggtatgtctaacaacaacaacaaaagccaggattgggagactcagtaacggcagaaaaatttgagtgcctacttctcaagtagaccatttacagcatttcatttgtggtttgaacttggagacaacaaaaatttacttgatggtagaaactatttctagcctaacaatttcatcatagtctcatggattgaggtaacttgatttttcgattcaatcaaaacaacagatgatatttttttttcatggataaatgagagattgtctaccttttatc

SEQ ID NO: 187251 - DNA, 539 bp, Homo sapiens
  Payload ID: 16869
  Gene Symbol: SUGCT
  Gene Name: succinyl-CoA:glutarate-CoA transferase
  ENST ID: ENST00000413931
  CDS Start-End: 1-539
acgcgatgctggcgacgctggcgagggtggcagctctgcgcagaacctgcctcttctccggccggggcggcgggagggggctgtggactggccgcccgcagtcagcaaggcaatgtacttctatagaagaatgcgcccttacagatggaacaatgatatgaacaatataaagccattggaaggggtaaaaattctggatctaacaagagtcctggcgggaccttttgctactatgaatttaggagatcttggagcagaagttataaaagtggagagaccaggagctggtgatgatacacgaacttgggggccaccttttgttgggacagaaagtacatattatctcagtgttaaccgaaataaaaaaagtattgctgttaatatcaaggatccaaaaggggtgaaaatcatcaaagagcttgcagctgtttgtgatgtgtttgtggaaaactatgtccctggcaaactgtctgcaatgggcctgggatatgaagatatagacgagattgctcctcacatcatctattgttccatcacag

SEQ ID NO: 187252 - DNA, 367 bp, Homo sapiens
  Payload ID: 16869
  Gene Symbol: SUGCT
  Gene Name: succinyl-CoA:glutarate-CoA transferase
  ENST ID: ENST00000444074
  CDS Start-End: 1-149
tgccatctgagacgcacgcgatgctggcgacgctggcgagggtggcagctctgcgcagaacctgcctcttctccggccggggcggcgggagggggctgtggactggccgcccgcagtcagagtcctggcgggaccttttgctactatgaatttaggagatcttggagcagaagttataaaagtggagagaccaggagctggtgatgatacacgaacttgggggccaccttttgttgggacagaaagtacatattatctcagtgttaaccgaaataaaaaaagtattgctgttaatatcaaggatccaaaaggggtgaaaatcatcaaagagcttgcagctgtttgtgatgtgtttgtggaaaactat

SEQ ID NO: 187253 - DNA, 1591 bp, Homo sapiens
  Payload ID: 16869
  Gene Symbol: SUGCT
  Gene Name: succinyl-CoA:glutarate-CoA transferase
  Uniprot ID: Q9HAC7
  ENST ID: ENST00000628514
  CDS Start-End: 24-1439
gttcgccgcttgcaccgggaccgatgccatctgagacgcacgcgatgctggcgacgctggcgagggtggcagctctgcgcagaacctgcctcttctccggccggggcggcgggagggggctgtggactggccgcccgcagtcagatatgaacaatataaagccattggaaggggtaaaaattctggatctaacaagagtcctggcgggaccttttgctactatgaatttaggagatcttggagcagaagttataaaagtggagagaccaggagctggtgatgatacacgaacttgggggccaccttttgttgggacagaaagtacatattatctcagtgttaaccgaaataaaaaaagtattgctgttaatatcaaggatccaaaaggggtgaaaatcatcaaagagcttgcagctgtttgtgatgtgtttgtggaaaactatgtccctggcaaactgtctgcaatgggcctgggatatgaagatatagacgagattgctcctcacatcatctattgttccatcacagggtatggtcagacaggtccaatttctcagcgagctggttatgatgctgttgcctcggctgtttctggtctgatgcacatcacagggcctgagaatggagatccagttcgcccaggagtagctatgactgatcttgccactggcctgtatgcatatggagctattatggctggattgatacaaaaatacaaaactgggaaaggactgttcattgattgtaacctactgtcatcccaggtggcgtgtttgtctcacatagctgcaaattatcttattggtcaaaaggaagcaaaacgttggggtacagctcatggcagtatcgttccttaccaggcttttaaaaccaaggatggctatattgtagttggagcaggaaataaccagcagtttgccaccgtctgcaagatcttggatttgcctgagttgattgataattccaagtataaaactaaccaccttcgggtacacaatagaaaagagcttattaaaatattatctgaacggtttgaagaagaactgaccagcaagtggttatatctttttgaaggcagtggagtcccgtatggcccaatcaacaacatgaagaatgtatttgcagaacctcagaacgctgtctctggcttccaaagcctgctgcattccttggcccatggccccttccttcatcttcaaggatcagcaagggtattacacaatggcctcgttatggagatggagcatccaactgtggggaagatttccgtcccaggcccagctgtgagatacagtaagttcaagatgtcagaggccaggccgcccccgctgctcgggcagcacacaacgcacatcctgaaggaggtcctgagatacgatgacagggccatcggggagctgctcagcgctggagtggtggaccaacatgaaactcactgacaaaggaaaagggctcttcctcataacctcgatccgaatacactggcaaaggcaacactttgcttggacccttctccccagttctgataccactaaaaagaagatttagagtaactccagatttcttacatggcatctccagaatggctctg

SEQ ID NO: 187254 - DNA, 6011 bp, Homo sapiens
  Payload ID: 16870
  Gene Symbol: SI
  Gene Name: sucrase-isomaltase (alpha-glucosidase)
  Uniprot ID: P14410
  ENST ID: ENST00000264382
  CDS Start-End: 64-5547
ttattttggcagccttatccaagtctggtacaacatagcaaagagaacaggctatgaaataagatggcaagaaagaaatttagtggattggaaatctctctgattgtcctttttgtcatagttactataatagctattgccttaattgttgttttagcaactaagacacctgctgttgatgaaattagtgattctacttcaactccagctactactcgtgtgactacaaatccttctgattcaggaaaatgtccaaatgtgttaaatgatcctgtcaatgtgagaataaactgcattccagaacaattcccaacagagggaatttgtgcacagagaggctgctgctggaggccgtggaatgactctcttattccttggtgcttcttcgttgataatcatggttataacgttcaagacatgacaacaacaagtattggagttgaagccaaattaaacaggataccttcacctacactatttggaaatgacatcaacagtgttctcttcacaactcaaaatcagacacccaatcgtttccggttcaagattactgatccaaataatagaagatatgaagttcctcatcagtatgtaaaagagtttactggacccacagtttctgatacgttgtatgatgtgaaggttgcccaaaacccatttagcatccaagttattaggaaaagcaacggtaaaactttgtttgacaccagcattggtcccttagtgtactctgaccagtacttacagatctcaacccgtcttccaagtgattatatttatggtattggagaacaagttcataagagatttcgtcatgatttatcctggaaaacatggccaatttttactcgagaccaacttcctggtgataataataataatttatacggccatcaaacattctttatgtgtattgaagatacatctggaaagtcattcggtgtttttttaatgaatagcaatgcaatggagatttttatccagcctactccaatagtaacatatagagttaccggtggcattctggatttttacatccttctaggagatacaccagaacaagtagttcaacagtatcaacagcttgttggactaccagcaatgccagcatattggaatcttggattccaactaagtcgctggaattataagtcactagatgtagtgaaagaagtggtaaggagaaaccgggaagctggcataccatttgatacacaggtcactgatattgactacatggaagacaagaaagactttacttatgatcaagttgcgtttaacggactccctcaatttgtgcaagatttgcatgaccatggacagaaatatgtcatcatcttggaccctgcaatttccataggtcgacgtgccaatggaacaacatatgcaacctatgagaggggaaacacacaacatgtgtggataaatgagtcagatggaagtacaccaattattggagaggtatggccaggattaacagtataccctgatttcactaacccaaactgcattgattggtgggcaaatgaatgcagtattttccatcaagaagtgcaatatgatggactttggattgacatgaatgaagtttccagctttattcaaggttcaacaaaaggatgtaatgtaaacaaattgaattatccaccgtttactcctgatattcttgacaaactcatgtattccaaaacaatttgcatggatgctgtgcagaactggggtaaacagtatgatgttcatagcctctatggatacagcatggctatagccacagagcaagctgtacaaaaagtttttcctaataagagaagcttcattcttacccgctcaacatttgctggatctggaagacatgctgcgcattggttaggagacaatactgcttcatgggaacaaatggaatggtctataactggaatgctggagttcagtttgtttggaatacctttggttggagcagacatctgtggatttgtggctgaaaccacagaagaactttgcagaagatggatgcaacttggggcattttatccattttccagaaaccataattctgacggatatgaacatcaggatcctgcattttttgggcagaattcacttttggttaaatcatcaaggcagtatttaactattcgctacaccttattacccttcctctacactctgttttataaagcccatgtgtttggagaaacagtagcaagaccagttcttcatgagttttatgaggatacgaacagctggattgaggacactgagtttttgtggggccctgcattacttattactcctgttctaaaacagggagcagatactgtgagtgcctacatccctgatgctatttggtatgattatgaatctggtgcaaaaaggccatggaggaaacaacgggttgatatgtatcttccagcagacaaaataggattacatcttagaggaggttatatcatccccattcaagaaccagatgtaacaacaacagcaagccgtaagaatcctctaggacttatagtcgcattaggtgaaaacaacacagccaaaggagactttttctgggatgatggagaaactaaagatacaatacaaaatggcaactacatattatatacattttcagtttctaataacacattagatattgtgtgcacacattcatcatatcaggaaggaactaccttagcatttcagactgtaaaaatccttgggttgacagacagtgttacagaagttagagtggcggaaaataatcaaccaatgaacgctcattccaatttcacttatgatgcttctaaccaggttctcctaattgcagatctcaaacttaatcttggaagaaactttagtgttcaatggaatcaaattttctcagaaaatgaaagatttaattgttatccagatgcagatttggcaactgaacaaaagtgcacacaacgtggctgtgtatggagaacgggttcttctctatccaaagcacctgagtgttactttcccagacaagataactcttattcagtcaactcagctcgctattcatccatgggtataacagctgacctccaactaaatactgcaaatgccagaataaagttaccttctgaccccatctcaactcttcgtgtggaggtgaaatatcacaaaaatgatatgttgcagtttaagatttatgatccccaaaagaagagatatgaagtaccagtaccgttaaacattccaaccaccccaataagtacttatgaagacagactttatgatgtggaaatcaaggaaaatccttttggcatccagattcgacggagaagcagtggaagagtcatttgggattcttggctgcctggatttgcttttaatgaccagttcattcaaatatcgactcgcctgccatcagaatatatatatggttttggggaagtggaacatacagcatttaagcgagatctgaactggaatacttggggaatgttcacaagagaccaaccccctggttacaaacttaattcctatggatttcatccctattacatggctctggaagaggagggcaatgctcatggtgttttcttactcaacagcaatgcaatggatgttacattccagccaactcctgctctaacttaccgtacagttggagggatcttggatttttatatgtttttgggcccaactccagaagttgcaacaaagcaataccatgaagtaattggccatccagtcatgccagcttattgggctttgggattccaattatgtcgttatggatatgcaaatacttcagaggttcgggaattatatgacgctatggtggctgctaacatcccctatgatgttcagtacacagacattgactacatggaaaggcagctagactttacaattggtgaagcattccaggaccttcctcagtttgttgacaaaataagaggagaaggaatgagatacattattatcctggatccagcaatttcaggaaatgaaacaaagacttaccctgcatttgaaagaggacagcagaatgatgtctttgtcaaatggccaaacaccaatgacatttgttgggcaaaggtttggccagatttgcccaacataacaatagataaaactctaacggaagatgaagctgttaatgcttccagagctcatgtagctttcccagatttcttcaggacttccacagcagagtggtgggccagagaaattgtggacttttacaatgaaaagatgaagtttgatggtttgtggattgatatgaatgagccatcaagttttgtaaatggaacaactactaatcaatgcagaaatgacgaactaaattatccaccttatttcccagaactcacaaaaagaactgatggattacatttcagaacaatttgcatggaagctgagcagattcttagtgatggaacatcagttttgcattacgatgttcacaatctctatggatggtcacagatgaaacctactcatgatgcattgcagaagacaactggaaaaagagggattgtaatttctcgttccacgtatcctactagtggacgatggggaggacactggcttggagacaactatgcacgatgggacaacatggacaaatcaatcattggtatgatggaatttagtctgtttggaatgtcatatactggagcagacatctgtggttttttcaacaactcagaatatcatctctgtacccgctggatgcaacttggagcattttatccatactcaaggaatcacaacattgcaaatactagaagacaagatcccgcttcctggaatgaaacttttgctgaaatgtcaaggaatattctaaatattagatacaccttattgccctatttttacacacaaatgcatgaaattcatgctaatggtggcactgttatccgaccccttttgcatgagttctttgatgaaaaaccaacctgggatatattcaagcagttcttatggggtccagcatttatggttaccccagtactggaaccttatgttcaaactgtaaatgcctacgtccccaatgctcggtggtttgactaccatacaggcaaagatattggcgtcagaggacaatttcaaacatttaatgcttcttatgacacaataaacctacatgtccgtggtggtcacatcctaccatgtcaagagccagctcaaaacacattttacagtcgacaaaaacacatgaagctcattgttgctgcagatgataatcagatggcacagggttctctgttttgggatgatggagagagtatagacacctatgaaagagacctatatttatctgtacaatttaatttaaaccagaccaccttaacaagcactatattgaagagaggttacataaataaaagtgaaacgaggcttggatcccttcatgtatgggggaaaggaactactcctgtcaatgcagttactctaacgtataacggaaataaaaattcgcttccttttaatgaagacactaccaacatgatattacgtattgatctgaccacacacaatgttactctagaagaaccaatagaaatcaactggtcatgaagatcaccatcaattttagttgtcaatgggaaaaaacaccaggatttaagtttcacagcacttacaattttccctcttcacttggttcttgtactctacaaaatatagctttcataacatcgaaaagttattttgtagcgtacatcaatgataatgctaattttattatagtaatgtgacttggattcaattttaaggcatatttaacaaaatttgaatagccctatttatccttgttaagtatcagctacaattgtaaactagttactaaacatgtatgtaaatagctaagatataatttaaacgtgatttttaaattaaataaaatttttatgtaattatatatactatatttttctcaatgtttagcagatttaagatatgtaacaacaattatttgaagatttaattacttcttagtatgtgcatttaattagaaaaagagaataaaaaatgtaagtgta

SEQ ID NO: 187255 - DNA, 565 bp, Homo sapiens
  Payload ID: 16870
  Gene Symbol: SI
  Gene Name: sucrase-isomaltase (alpha-glucosidase)
  ENST ID: ENST00000476593
  CDS Start-End: 64-204
ttattttggcagccttatccaagtctggtacaacatagcaaagagaacaggctatgaaataagatggcaagaaagaaatttagtggattggaaatctctctgattgtcctttttgtcatagttactataatagctattgccttaattgttgttttagcaactaagacacctgctgttgatgttttttcctcccccagaaattagtgattctacttcaactccagctactactcgtgtgactacaaatccttctgattcaggaaaatgtccaaatgtgttaaatgatcctgtcaatgtgagaataaactgcattccagaacaattcccaacagagggaatttgtgcacagagaggctgctgctggaggccgtggaatgactctcttattccttggtgcttcttcgttgataatcatggttataacgttcaagacatgacaacaacaagtattggagttgaagccaaattaaacaggataccttcacctacactatttggaaatgacatcaacagtgttctcttcacaactcaaaatcagacacccaatcgtttccggttcaaggtt

SEQ ID NO: 187256 - DNA, 5710 bp, Homo sapiens
  Payload ID: 16871
  Gene Symbol: SULF1
  Gene Name: sulfatase 1
  Uniprot ID: Q8IWU6
  ENST ID: ENST00000260128
  CDS Start-End: 718-3333
aggttacttgactgggagttctcagacctccagtttcagccctgccctcagcctccaatccgtaagagacacccagccccagcaattggattgggcagcccgtcttgacacaccactgtgctgagtgcttgaggacgtgtttcaacagatggttggggttagtgtgtgtcatcacattcgagtggggattaagagaaggaaggctgccttgctggagctgtgtggtcttctccaagtgagagtcgcaggcaatagaactactttgcttttggaggaaaaggaggaattcattttcagcagacacaagaaaagcagtttttttttcagggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatgaagattgcctgctctctctgtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaaggtgtttaaacttt

SEQ ID NO: 187257 - DNA, 4891 bp, Homo sapiens
  Payload ID: 16871
  Gene Symbol: SULF1
  Gene Name: sulfatase 1
  Uniprot ID: Q8IWU6
  ENST ID: ENST00000402687
  CDS Start-End: 756-3371
tttgtctggcagcgttggttctatgggggtgtgtgatgataataatacgcgggcttatataaccgtcttcatcttgcgagcacttcgcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggcttttggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaa

SEQ ID NO: 187258 - DNA, 4697 bp, Homo sapiens
  Payload ID: 16871
  Gene Symbol: SULF1
  Gene Name: sulfatase 1
  Uniprot ID: Q8IWU6
  ENST ID: ENST00000419716
  CDS Start-End: 562-3177
gtgatgataataatacgcgggcttatataaccgtcttcatcttgcgagcacttcgcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggcttttgtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaa

SEQ ID NO: 187259 - DNA, 5551 bp, Homo sapiens
  Payload ID: 16871
  Gene Symbol: SULF1
  Gene Name: sulfatase 1
  Uniprot ID: Q8IWU6
  ENST ID: ENST00000458141
  CDS Start-End: 556-3171
aggttacttgactgggagttctcagacctccagtttcagccctgccctcagcctccaatccgtaagagacacccagccccagcaattggattgggcagcccgtcttgacacaccactgtgctgagtgcttgaggacgtgtttcaacagatggttggggttagtgtgtgtcatcacattcgagtggggattaagagaaggaaggctgccttgctggagctgtgtggtcttctccaagtgagagtcgcaggcaatagaactactttgcttttggaggaaaaggaggaattcattttcagcagacacaagaaaagcagtttttttttcaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatgaagattgcctgctctctctgtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaaggtgtttaaactttttt

SEQ ID NO: 187260 - DNA, 593 bp, Homo sapiens
  Payload ID: 16871
  Gene Symbol: SULF1
  Gene Name: sulfatase 1
  ENST ID: ENST00000534179
  CDS Start-End: 425-593
cctgtgctatctgtgccttaccagtctcaccaacaataagcctggtgactgacaatcgagagggggctctgtccacgtaggtgccggcacaagctgaggacatgagtgggacagaggaaccagccttgcacggaggaagcaccttttccttctggtgattgattgatgggggacagtgaggaggttttcagagactggaaaaaattgtcccagtcacttactatgaagtctttgtcagcagaaaagactctccggggtagagaatgatataatgcagatgacaaatgacaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagc

SEQ ID NO: 187261 - DNA, 630 bp, Homo sapiens
  Payload ID: 16871
  Gene Symbol: SULF1
  Gene Name: sulfatase 1
  ENST ID: ENST00000525999
  CDS Start-End: 115-630
ggagtttggatttcattttagtctcaccgtctccgtttttctctgactgcccagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacact

SEQ ID NO: 187262 - DNA, 585 bp, Homo sapiens
  Payload ID: 16871
  Gene Symbol: SULF1
  Gene Name: sulfatase 1
  ENST ID: ENST00000529134
  CDS Start-End: 332-585
tctcttttagcatagttttgaatggaatgctagcacggcacacttgtcaaagccagttgttgctgtcctatcaatgctgctattgtacggctgacagatgacggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacc

SEQ ID NO: 187263 - DNA, 2010 bp, Homo sapiens
  Payload ID: 16871
  Gene Symbol: SULF1
  Gene Name: sulfatase 1
  ENST ID: ENST00000531512
  CDS Start-End: 1-394
aagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaaccctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaac

SEQ ID NO: 187264 - DNA, 806 bp, Homo sapiens
  Payload ID: 16871
  Gene Symbol: SULF1
  Gene Name: sulfatase 1
  ENST ID: ENST00000525061
  CDS Start-End: 718-806
aggttacttgactgggagttctcagacctccagtttcagccctgccctcagcctccaatccgtaagagacacccagccccagcaattggattgggcagcccgtcttgacacaccactgtgctgagtgcttgaggacgtgtttcaacagatggttggggttagtgtgtgtcatcacattcgagtggggattaagagaaggaaggctgccttgctggagctgtgtggtcttctccaagtgagagtcgcaggcaatagaactactttgcttttggaggaaaaggaggaattcattttcagcagacacaagaaaagcagtttttttttcagggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggtt

SEQ ID NO: 187265 - DNA, 460 bp, Homo sapiens
  Payload ID: 16871
  Gene Symbol: SULF1
  Gene Name: sulfatase 1
  ENST ID: ENST00000528783
  CDS Start-End: 231-460
atataatatgctgttgcaagagactacttcagatcgaaaatctgtttttaaaatcattgactgatatttcctttgtatttttttctcccccttccaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccacctt

SEQ ID NO: 187266 - DNA, 3381 bp, Homo sapiens
  Payload ID: 16871
  Gene Symbol: SULF1
  Gene Name: sulfatase 1
  ENST ID: ENST00000616868
  CDS Start-End: 1372-3381
gtgatgataataatacgcgggcttatataaccgtcttcatcttgcgagcacttcgcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggcttttggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaatgttgctgttcctggtaccctgttcggcccctctaacctccagagctatggtctcagatgcttccttttag

SEQ ID NO: 187267 - DNA, 4915 bp, Homo sapiens
  Payload ID: 16872
  Gene Symbol: SULF2
  Gene Name: sulfatase 2
  Uniprot ID: Q8IWU5
  ENST ID: ENST00000359930
  CDS Start-End: 853-3465
cacttgagccgaagttaatttctcggggagttctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgagtgagtgtgcgtctgtgtgtcccggcgagggtgcgcgctcggcgccgggagcgcggccagccgagtccggaggcatcgggaggtcgagagccgccgggaccccagctctgcgttcactgccccgtccggagctggacttcggggccggggccggggccgtgcgccggggacaggcagggccgggtcgcgggccgcgcgtcccccaggccggagatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtggtattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaatccctcgcagttgtggacatttctgttcctgtccagataccatttctcctagtatttctttgttatgtcccagaactgatgttttttttttaaggtactgaaaagaaatgaagttgatgtatgtcccaagttttgatgaaactgtatttgtaaaaaaaattttgtagtttaagtattgtcatacagtgttcaaaaccccagccaatgaccagcagttggtatgaagaacctttgacattttgtaaaaggccatttcttgggagttttttggtgtgtctgtttttttaaagtattcaagatactaccagtcaacatctttttggaagaaaatgccttgggtttagaagattttcttaaaaggggagtagatggttgtagattgactaaaaagtctaccatacttcaagggactacaggtaagtctcatagtataccagctttggtacttcattttttaaaaaagtattaatcaattgcaaagaaattcgccttggccaacccttctttgtgtatcaggtagtctaacctgatacaagtagttgacagatttcaactatcaatcaccagtccaacccatttctcatttaacagatgacggagataatccctaaaagcacccacatttgtttcaatgccccaaacaggccaaggctccctagcaactccctagtggcgttttttaacttctcagaaactgttaccattatttgaaataggcttccttaacctcctttacccttaacccaacagggattt

SEQ ID NO: 187268 - DNA, 814 bp, Homo sapiens
  Payload ID: 16872
  Gene Symbol: SULF2
  Gene Name: sulfatase 2
  ENST ID: ENST00000437955
  CDS Start-End: 248-814
ggggatgcagcagcggcagcggcggcggcggcggcggcagcggcagcggcggcgcggagtcccctgcgcccagcggcccggccgggctgcggcagaggcggcggcggcgccccgctccgggtgaggttgccggggccgtgcgcgctgatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaag

SEQ ID NO: 187269 - DNA, 1550 bp, Homo sapiens
  Payload ID: 16872
  Gene Symbol: SULF2
  Gene Name: sulfatase 2
  ENST ID: ENST00000495544
  CDS Start-End: 1-623
gggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggggacaactgtgggaaggctgggaaggttaagaaacaacagaggtggacctccaaaaacatagaggcatcacctgactgcacaggcaatgaaaaaccatgtgggtgatttccagcagacctgtggtattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaatccctcgcagttgtggacatttctgttcctgtccagataccatttctcctagtatttctttgttatgtcccagaactgatgttttttttttaaggtactgaaaagaaatgaagttgatgtatgtcccaagttttgatgaaactgtatttgtaaaaaaaattttgtagtttaagtattgtcatacagtgttcaaaaccccagccaatgaccagcagttggtatgaagaaccttt

SEQ ID NO: 187270 - DNA, 4238 bp, Homo sapiens
  Payload ID: 16872
  Gene Symbol: SULF2
  Gene Name: sulfatase 2
  Uniprot ID: Q8IWU5
  ENST ID: ENST00000484875
  CDS Start-End: 670-3282
gggccatttctggacaacagctgctattttcacttgagccgaagttaatttctcggggagttctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgaatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtggtattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaatccctcgcagttgtggacatttctgttcctgtccagataccatttctcctagtatttctttgttatgtcccagaactgatgttttttttttaaggtactgaaaagaaatgaagttgatgtatgtcccaagttttgatgaaactgtatttgtaaaaaaaattttgtagtttaagtattgtcatacagtgttcaaaaccccagccaatgaccagcagttggtatgaagaacctttgacattttgtaaaaggccatttcttggga

SEQ ID NO: 187271 - DNA, 3905 bp, Homo sapiens
  Payload ID: 16872
  Gene Symbol: SULF2
  Gene Name: sulfatase 2
  Uniprot ID: Q8IWU5
  ENST ID: ENST00000467815
  CDS Start-End: 608-3211
ctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgaatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctggatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtggtattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaa

SEQ ID NO: 187272 - DNA, 2159 bp, Homo sapiens
  Payload ID: 16873
  Gene Symbol: SUMF1
  Gene Name: sulfatase modifying factor 1
  Uniprot ID: Q8NBK3
  ENST ID: ENST00000272902
  CDS Start-End: 37-1161
acgtgaccaaccgggtcacatggcccgcgggacaacatggctgcgcccgcactagggctggtgtgtggacgttgccctgagctgggtctcgtcctcttgctgctgctgctctcgctgctgtgtggagcggcagggagccaggaggccgggaccggtgcgggcgcggggtcccttgcgggttcttgcggctgcggcacgccccagcggcctggcgcccatggcagttcggcagccgctcaccgatactcgcgggaggctaacgctccgggccccgtacccggagagcggcaactcgcgcactcaaagatggtccccatccctgctggagtatttacaatgggcacagatgatcctcagataaagcaggatggggaagcacctgcgaggagagttactattgatgccttttacatggatgcctatgaagtcagtaatactgaatttgagaagtttgtgaactcaactggctatttgacagaggctgagaagtttggcgactcctttgtctttgaaggcatgttgagtgagcaagtgaagaccaatattcaacaggcagttgcagctgctccctggtggttacctgtgaaaggcgctaactggagacacccagaagggcctgactctactattctgcacaggccggatcatccagttctccatgtgtcctggaatgatgcggttgcctactgcacttgggcagggaagcggctgcccacggaagctgagtgggaatacagctgtcgaggaggcctgcataatagacttttcccctggggcaacaaactgcagcccaaaggccagcattatgccaacatttggcagggcgagtttccggtgaccaacactggtgaggatggcttccaaggaactgcgcctgttgatgccttccctcccaatggttatggcttatacaacatagtggggaacgcatgggaatggacttcagactggtggactgttcatcattctgttgaagaaacgcttaacccaaaaggtcccccttctgggaaagaccgagtgaagaaaggtggatcctacatgtgccataggtcttattgttacaggtatcgctgtgctgctcggagccagaacacacctgatagctctgcttcgaatctgggattccgctgtgcagccgaccgcctgcccactatggactgacaaccaaggaaagtcttccccagtccaaggagcagtcgtgtctgacctacattgggcttttctcagaactttgaacgatcccatgcaaagaattcccaccctgaggtgggttacatacctgcccaatggccaaaggaaccgccttgtgagaccaaattgctgacctgggtcagtgcatgtgctttatggtgtggtgcatctttggagatcatcaccatattttacttttgagagtctttaaagaggaaggggagtggagggaaccctgagctaggcttcaggaggcccgcgtcctacgcaggctctgccacaggggttagaccccaggtccgacgcttgaccttcctgggcctcaagtgccctcccctatcaaatgaagggatggacagcatgacctctgggtgtctctccaactcaccagttctaaaaagggtatcagattctattgtgacttcatagtgagaatttattatagattattttttagctattttttccatgtgtgaaccttgagtgatactaatcatgtaaagtaagagttctcttatgtattattttcggaagaggggtgtggtgactcctttatattcgtactgcactttgtttttccaaggaaatcagtgtcttttacgttgttatgatgaatcccacatggggccggtgatggtatgctgaagttcagccgttgaacacataggaatgtctgtggggtgactctactgtgctttatcttttaacattaagtgcctttggttcagaggggcagtcataagctctgtttccccctctccccaaagccttcagcgaacgtgaaatgtgcgctaaacggggaaacctgtttaattctagatatagggaaaaaggaacgaggaccttgaatgagctatattcagggtatccggtattttgtaatagggaataggaaaccttgttggctgtggaatatccgatgctttgaatcatgcactgtgttgaataaacgtatctgctaaatcagg

SEQ ID NO: 187273 - DNA, 1447 bp, Homo sapiens
  Payload ID: 16873
  Gene Symbol: SUMF1
  Gene Name: sulfatase modifying factor 1
  Uniprot ID: Q8NBK3
  ENST ID: ENST00000383843
  CDS Start-End: 20-1069
acatggcccgcgggacaacatggctgcgcccgcactagggctggtgtgtggacgttgccctgagctgggtctcgtcctcttgctgctgctgctctcgctgctgtgtggagcggcagggagccaggaggccgggaccggtgcgggcgcggggtcccttgcgggttcttgcggctgcggcacgccccagcggcctggcgcccatggcagttcggcagccgctcaccgatactcgcgggaggctaacgctccgggccccgtacccggagagcggcaactcgcgcactcaaagatggtccccatccctgctggagtatttacaatgggcacagatgatcctcagataaagcaggatggggaagcacctgcgaggagagttactattgatgccttttacatggatgcctatgaagtcagtaatactgaatttgagaagtttgtgaactcaactggctatttgacagaggttgcagctgctccctggtggttacctgtgaaaggcgctaactggagacacccagaagggcctgactctactattctgcacaggccggatcatccagttctccatgtgtcctggaatgatgcggttgcctactgcacttgggcagggaagcggctgcccacggaagctgagtgggaatacagctgtcgaggaggcctgcataatagacttttcccctggggcaacaaactgcagcccaaaggccagcattatgccaacatttggcagggcgagtttccggtgaccaacactggtgaggatggcttccaaggaactgcgcctgttgatgccttccctcccaatggttatggcttatacaacatagtggggaacgcatgggaatggacttcagactggtggactgttcatcattctgttgaagaaacgcttaacccaaaaggtcccccttctgggaaagaccgagtgaagaaaggtggatcctacatgtgccataggtcttattgttacaggtatcgctgtgctgctcggagccagaacacacctgatagctctgcttcgaatctgggattccgctgtgcagccgaccgcctgcccactatggactgacaaccaaggaaagtcttccccagtccaaggagcagtcgtgtctgacctacattgggcttttctcagaactttgaacgatcccatgcaaagaattcccaccctgaggtgggttacatacctgcccaatggccaaaggaaccgccttgtgagaccaaattgctgacctgggtcagtgcatgtgctttatggtgtggtgcatctttggagatcatcaccatattttacttttgagagtctttaaagaggaaggggagtggagggaaccctgagctaggcttcaggaggcccgcgtcctacgcaggctctgccacaggggttagaccccaggtccgacgcttgaccttcctgggcctcaagtgccctcccctatcaaatgaa

SEQ ID NO: 187274 - DNA, 1128 bp, Homo sapiens
  Payload ID: 16873
  Gene Symbol: SUMF1
  Gene Name: sulfatase modifying factor 1
  Uniprot ID: Q8NBK3
  ENST ID: ENST00000405420
  CDS Start-End: 29-1093
aaccgggtcacatggcccgcgggacaacatggctgcgcccgcactagggctggtgtgtggacgttgccctgagctgggtctcgtcctcttgctgctgctgctctcgctgctgtgtggagcggcagggagccaggaggccgggaccggtgcgggcgcggggtcccttgcgggttcttgcggctgcggcacgccccagcggcctggcgcccatggcagttcggcagccgctcaccgatactcgcgggaggctaacgctccgggccccgtacccggagagcggcaactcgcgcactcaaagatggtccccatccctgctggagtatttacaatgggcacagatgatcctcagataaagcaggatggggaagcacctgcgaggagagttactattgatgccttttacatggatgcctatgaagtcagtaatactgaatttgagaagtttgtgaactcaactggctatttgacagaggctgagaagtttggcgactcctttgtctttgaaggcatgttgagtgagcaagtgaagaccaatattcaacaggcagttgcagctgctccctggtggttacctgtgaaaggcgctaactggagacacccagaagggcctgactctactattctgcacaggccggatcatccagttctccatgtgtcctggaatgatgcggttgcctactgcacttgggcagggaagcggctgcccacggaagctgagtgggaatacagctgtcgaggaggcctgcataatagacttttcccctggggcaacaaactgcagcccaaaggccagcattatgccaacatttggcagggcgagtttccggtgaccaacactggtgaggatggcttccaaggaactgcgcctgttgatgccttccctcccaatggttatggcttatacaacatagtggggaacgcatgggaatggacttcagactggtggactgttcatcattctgttgaagaaacgcttaacccatcttattgttacaggtatcgctgtgctgctcggagccagaacacacctgatagctctgcttcgaatctgggattccgctgtgcagccgaccgcctgcccactatggactgacaaccaaggaaagtcttccccagtccaaggagcag

SEQ ID NO: 187275 - DNA, 3150 bp, Homo sapiens
  Payload ID: 16873
  Gene Symbol: SUMF1
  Gene Name: sulfatase modifying factor 1
  ENST ID: ENST00000448413
  CDS Start-End: 17-1297
tggcccgcgggacaacatggctgcgcccgcactagggctggtgtgtggacgttgccctgagctgggtctcgtcctcttgctgctgctgctctcgctgctgtgtggagcggcagggagccaggaggccgggaccggtgcgggcgcggggtcccttgcgggttcttgcggctgcggcacgccccagcggcctggcgcccatggcagttcggcagccgctcaccgatactcgcgggaggctaacgctccgggccccgtacccggagagcggcaactcgcgcactcaaagatggtccccatccctgctggagtatttacaatgggcacagatgatcctcagataaagcaggatggggaagcacctgcgaggagagttactattgatgccttttacatggatgcctatgaagtcagtaatactgaatttgagaagtttgtgaactcaactggctatttgacagaggctgagaagtttggcgactcctttgtctttgaaggcatgttgagtgagcaagtgaagaccaatattcaacaggcagttgcagctgctccctggtggttacctgtgaaaggcgctaactggagacacccagaagggcctgactctactattctgcacaggccggatcatccagttctccatgtgtcctggaatgatgcggttgcctactgcacttgggcagggaagcggctgcccacggaagctgagtgggaatacagctgtcgaggaggcctgcataatagacttttcccctggggcaacaaactgcagcccaaaggccagcattatgccaacatttggcagggcgagtttccggtgaccaacactggtgaggatggcttccaaggaactgcgcctgttgatgccttccctcccaatggttatggcttatacaacatagtggggaacgcatgggaatggacttcagactggtggactgttcatcattctgttgaagaaacgcttaacccaaaaggtcccccttctgggaaagaccgagtgaagaaaggtggatcctacatgtgccataggtcccaagagtactatgatccctattttcaagatgtggcatctgagatgttgagaagacacacagccagcaggtggaaggccttctcatctctagaaccatgctgctcaatacgtaggcatcagcaatatgcagctattgaacgtttgacatgtggcaagtttgaattgagatgtgctagtttaagaaaaatagattgcctcaacaccaacattgcctgtagctactccatgaggcaagatggacccagactccactgtgtggactgacctcccagaaggatcctcctgtccctgaaggccactctgccttcagctacaggccccagtgctgattgtgatacttaacaagggctttcagatgtctgaaacaagagtatagcataaagttaagaatgcggcttctggagagacagacttggtttcaaattcagctctgtgaccttgggtgcacagcaaagtcttcttctccccccgatgaaagaatgggaaggactcaggaaggctcaacttgcaaactccccagtatcaagtggctgccttcaaaatccaacccttctcttcccagctcatttccagtatgtattttcaaaggccatgtcatttttgaagtgcctgagaagaaaacagaactgccagcagactatgggacaaacgactaaatgccctccagacgttccagagtcctctgcctctcaggcttcagttcttcctgaaggaatctggagctggaaagcaggaagcaatttgctgtggaattttttccatcacagactccaagttcctcagcctttggactcttgaacttacaccagtgttttggcaggagcgctcgggcctttggccacagactgaaggctgcattgtcagcttccctacttttgaggttttgggactcagactgatccaccactggcttccttgctcttcaacttgaagacggcctatcgtgagactttacctcgtgattatgtgagtcaattctcctaataaactccccttcgtatgtacatataccctattacttctgtccctttagagaaccctgactaatacagtagagattgcctggacttattaataataatgactctgtttagttaatgtaacagacagataaagacaaatgagtgacacccatgcaattaaaataattttggtggggagtgagaggagttggttctccactcacagtggaaagttttagcgtatactgctgcacatgacatgggagtattttgcacttccactggaaaaaagtaaggggaataaaaacccctggattctacttgctgacttgagagtgactaaagcgatttatctgaaggttccccagggtggattcatagtggactcaggccagattctctgctgatgctttgaacttatgtccagagcatcatctccaccacaaaagagcttgcctgctctgtgtcctggccaaagagatgcacgtgctctctcactgggttgtggctcttgagtaactcctggaattacccagctggaatttctattcctttggaccacaaatttcatatcttcacctgctgcctatatcatgctaaaagatggaaatgtctcaactaaaccatgtaggtggactagcctcattaacaagataagcaatgggccattttctcactggttattaactatgtacattatctatgaaataacatatctggtcatggttactactctattctgtagggtggaatagaaaaaggtagaggatatatatttcagttgcatttttaaaattgtttattttgttttttaattgacaaataatattaggttggtgcaaaagtaattgcagtttttgccattaaaggtagacaaggctgggcacggtggctcagcacgcttgtaatcccagcactttgggaggcagaggcgggcagatcacaaggtcaggagaccgagaccatcctggctaacacggtgaaaccccatctctactaaaaatacaaaaaattagccgggtgtggtggtgggcacctgtagtcccagctactcgggaggctgaggcaggagaatggcgtgaacctgggaggtggagcttgtagtgagctgcaccactgcactccagcctgggcaacagagcaagaccccatatc

SEQ ID NO: 187276 - DNA, 1102 bp, Homo sapiens
  Payload ID: 16873
  Gene Symbol: SUMF1
  Gene Name: sulfatase modifying factor 1
  ENST ID: ENST00000458465
  CDS Start-End: 25-753
gggtcacatggcccgcgggacaacatggctgcgcccgcactagggctggtgtgtggacgttgccctgagctgggtctcgtcctcttgctgctgctgctctcgctgctgtgtggagcggcagggagccaggaggccgggaccggtgcgggcgcggggtcccttgcgggttcttgcggctgcggcacgccccagcggcctggcgcccatggcagttcggcagccgctcaccgatactcgcgggaggctaacgctccgggccccgtacccggagagcggcaactcgcgcactcaaagatggtccccatccctgctggagtatttacaatgggcacagatgatcctcagataaagcaggatggggaagcacctgcgaggagagttactattgatgccttttacatggatgcctatgaagtcagtaatactgaatttgagaagtttgtgaactcaactggctatttgacagaggttgatgccttccctcccaatggttatggcttatacaacatagtggggaacgcatgggaatggacttcagactggtggactgttcatcattctgttgaagaaacgcttaacccaaaaggtcccccttctgggaaagaccgagtgaagaaaggtggatcctacatgtgccataggtcttattgttacaggtatcgctgtgctgctcggagccagaacacacctgatagctctgcttcgaatctgggattccgctgtgcagccgaccgcctgcccactatggactgacaaccaaggaaagtcttccccagtccaaggagcagtcgtgtctgacctacattgggcttttctcagaactttgaacgatcccatgcaaagaattcccaccctgaggtgggttacatacctgcccaatggccaaaggaaccgccttgtgagaccaaattgctgacctgggtcagtgcatgtgctttatggtgtggtgcatctttggagatcatcaccatattttacttttgagagtctttaaagaggaaggggagtggagggaaccctgagctaggcttcaggaggcccgcgtcctacgcaggctctgccacaggggttagaccccaggtccgacgcttgaccttcctgg

SEQ ID NO: 187277 - DNA, 1894 bp, Homo sapiens
  Payload ID: 16874
  Gene Symbol: SUMF2
  Gene Name: sulfatase modifying factor 2
  Uniprot ID: Q8NBJ7
  ENST ID: ENST00000275607
  CDS Start-End: 196-837
tgtgcataggggtcgactgccgctgcggtgcatgagggcgcatgcgcagcggggccgtgggtgtacgcggcgcagcgcggcagtcctgatggcccggcatgggttaccgctgctgcccctgctgtcgctcctggtcggcgcgtggctcaagctagggattttgtcagggagaaaaagtatcggacagaagctgagatgtttggatggagctttgtctttgaggactttgtctctgatgagctgagaaacaaagccacccagccaatgaagtctgtactctggtggcttccagtggaaaaggcattttggaggcagcctgcaggtcctggctctggcatccgagagagactggagcacccagtgttacacgtgagctggaatgacgcccgtgcctactgtgcttggcggggaaaacgactgcccacggaggaagagtgggagtttgccgcccgagggggcttgaagggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacaattggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactaggtgaagcattgcattgtgggaatcacaaagcaaatagtactccagaaagacaaatatcagaagcttcctattctttttttttttttttttttttttgagacagggtctttctctgttgcccaggctagagtgcactggtgatcacggctcactctagccttgaattcctgggcccaagcaattctcccacctcagcctcctgagtagctgggactacaagtgtgcaccaccatgcctggctaattttttgaatttttgtagtgatgggatctcgctctgttgcccagggtggtctcgaactcctggcctcaagcgatcctcccacctcgacctcccaaagtgctgggattacaggtgtgagccacctcgcctgggcccccttctccatatgcctccaaaaacatgtccctggagagtagcctgctcccacactgtcactggatgtcatggggccaataaaatctcctgcaattgtgtatctc

SEQ ID NO: 187278 - DNA, 1876 bp, Homo sapiens
  Payload ID: 16874
  Gene Symbol: SUMF2
  Gene Name: sulfatase modifying factor 2
  ENST ID: ENST00000342190
  CDS Start-End: 1-1077
atgagggcgcatgcgcagcggggccgtgggtgtacgcggcgcagcgcggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgacgggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaagtctgtactctggtggcttccagtggaaaaggcattttggaggcagcctgcaggtcctggctctggcatccgagagagactggagcacccagtgttacacgtgagctggaatgacgcccgtgcctactgtgcttggcggggaaaacgactgcccacggaggaagagtgggagtttgccgcccgagggggcttgaagggtcaagtttacccatgggggaactggttccagccaaaccgcaccaacctgtggcagggaaagttccccaagggagacaaagctgaggatggcttccatggagtctccccagtgaatgctttccccgcccagaacaactacggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacaattggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactaggtgaagcattgcattgtgggaatcacaaagcaaatagtactccagaaagacaaatatcagaagcttcctattctttttttttttttttttttttttgagacagggtctttctctgttgcccaggctagagtgcactggtgatcacggctcactctagccttgaattcctgggcccaagcaattctcccacctcagcctcctgagtagctgggactacaagtgtgcaccaccatgcctggctaattttttgaatttttgtagtgatgggatctcgctctgttgcccagggtggtctcgaactcctggcctcaagcgatcctcccacctcgacctcccaaagtgctgggattacaggtgtgagccacctcgcctgggcccccttctccatatgcctccaaaaacatgtccctggagagtagcctgctcccacactgtcactggatgtcatggggccaataaaatctcctgcaattgtgtatctca

SEQ ID NO: 187279 - DNA, 1287 bp, Homo sapiens
  Payload ID: 16874
  Gene Symbol: SUMF2
  Gene Name: sulfatase modifying factor 2
  ENST ID: ENST00000395435
  CDS Start-End: 2-712
catgagggcgcatgcgcagcggggccgtgggtgtacgcggcgcagcgcggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgacgggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacaattggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactag

SEQ ID NO: 187280 - DNA, 1683 bp, Homo sapiens
  Payload ID: 16874
  Gene Symbol: SUMF2
  Gene Name: sulfatase modifying factor 2
  ENST ID: ENST00000395436
  CDS Start-End: 254-1171
gcaatggtatgacgcacaaaagcaatcttaaggggaatgaaaactgtccaaaggttcagaaaagtagtgaaggggcctctggaacggccgggaccctcaacgtggttttccttaattccctgggcggtcctgaaggtggtgtggccagtcctccgcctcgctccgtcagtttccccctgctgaactattgggtgcggggcgggtggtggcgcagcctgcgcatgtgcataggggtcgactgccgctgcggtgcatgagggcgcatgcgcagcggggccgtgggtgtacgcggcgcagcgcggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgacgggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaagcctgcaggtcctggctctggcatccgagagagactggagcacccagtgttacacgtgagctggaatgacgcccgtgcctactgtgcttggcggggaaaacgactgcccacggaggaagagtgggagtttgccgcccgagggggcttgaagggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacaattggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagac

SEQ ID NO: 187281 - DNA, 1771 bp, Homo sapiens
  Payload ID: 16874
  Gene Symbol: SUMF2
  Gene Name: sulfatase modifying factor 2
  ENST ID: ENST00000438133
  CDS Start-End: 5-457
cctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgacgggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaaggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacaattggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactaggtgaagcattgcattgtgggaatcacaaagcaaatagtactccagaaagacaaatatcagaagcttcctattctttttttttttttttttttttttgagacagggtctttctctgttgcccaggctagagtgcactggtgatcacggctcactctagccttgaattcctgggcccaagcaattctcccacctcagcctcctgagtagctgggactacaagtgtgcaccaccatgcctggctaattttttgaatttttgtagtgatgggatctcgctctgttgcccagggtggtctcgaactcctggcctcaagcgatcctcccacctcgacctcccaaagtgctgggattacaggtgtgagccacctcgcctgggcccccttctccatatgcctccaaaaacatgtccctggagagtagcctgctcccacactgtcactggatgtcatggggccaataaaatctcctgcaattgtgtatctc

SEQ ID NO: 187282 - DNA, 1249 bp, Homo sapiens
  Payload ID: 16874
  Gene Symbol: SUMF2
  Gene Name: sulfatase modifying factor 2
  ENST ID: ENST00000447501
  CDS Start-End: 3-554
tgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgacgggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaagtctgtactctggtggcttccagtggaaaaggcattttggaggcagcctgcaggtcctggctctggcatccgagagagactggagcacccagtgttacacgtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggactggcacaggctcaggacctgtcctcacaccaggcttctttccagaccatgctctccccagccctcatgctccctgatcatggccggccctgcggatgaggcaggcaagatgggtaagccctaggcctttttctcaggacgtgtctgtcctctctccccttctctgctggcaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacaca

SEQ ID NO: 187283 - DNA, 2052 bp, Homo sapiens
  Payload ID: 16874
  Gene Symbol: SUMF2
  Gene Name: sulfatase modifying factor 2
  ENST ID: ENST00000434526
  CDS Start-End: 32-994
tgtgcataggggtcgactgccgctgcggtgcatgagggcgcatgcgcagcggggccgtgggtgtacgcggcgcagcgcggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgacgggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaagtctgtactctggtggcttccagtggaaaaggcattttggaggcagcctgcaggtcctggctctggcatccgagagagactggagcacccagtgttacacgtgagctggaatgacgcccgtgcctactgtgcttggcggggaaaacgactgcccacggaggaagagtgggagtttgccgcccgagggggcttgaagggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacaattggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactaggtgaagcattgcattgtgggaatcacaaagcaaatagtactccagaaagacaaatatcagaagcttcctattctttttttttttttttttttttttgagacagggtctttctctgttgcccaggctagagtgcactggtgatcacggctcactctagccttgaattcctgggcccaagcaattctcccacctcagcctcctgagtagctgggactacaagtgtgcaccaccatgcctggctaattttttgaatttttgtagtgatgggatctcgctctgttgcccagggtggtctcgaactcctggcctcaagcgatcctcccacctcgacctcccaaagtgctgggattacaggtgtgagccacctcgcctgggcccccttctccatatgcctccaaaaacatgtccctggagagtagcctgctcccacactgtcactggatgtcatggggccaataaaatctcctgcaattgtgtatctca

SEQ ID NO: 187284 - DNA, 1171 bp, Homo sapiens
  Payload ID: 16874
  Gene Symbol: SUMF2
  Gene Name: sulfatase modifying factor 2
  ENST ID: ENST00000413756
  CDS Start-End: 24-1082
cgcggcgcagcgcggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgacgggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaagtctgtactctggtggcttccagtggaaaaggcattttggaggcagcctgcaggtcctggctctggcatccgagagagactggagcacccagtgttacacgtgagctggaatgacgcccgtgcctactgtgcttggcggggaaaacgactgcccacggaggaagagtgggagtttgccgcccgagggggcttgaagggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccagagtcttgctctgttgtccaggctggagtgcagtggcacagtctcagctcactacagcctcaaactgccaggctctagcgattcttccacctcagctcctcaagtatctgggactacaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtc

SEQ ID NO: 187285 - DNA, 1792 bp, Homo sapiens
  Payload ID: 16874
  Gene Symbol: SUMF2
  Gene Name: sulfatase modifying factor 2
  ENST ID: ENST00000423763
  CDS Start-End: 12-509
cggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgacgggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaagtctgtactctggtggcttccagtggaaaaggcattttggaggcaggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacaattggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactaggtgaagcattgcattgtgggaatcacaaagcaaatagtactccagaaagacaaatatcagaagcttcctattctttttttttttttttttttttttgagacagggtctttctctgttgcccaggctagagtgcactggtgatcacggctcactctagccttgaattcctgggcccaagcaattctcccacctcagcctcctgagtagctgggactacaagtgtgcaccaccatgcctggctaattttttgaatttttgtagtgatgggatctcgctctgttgcccagggtggtctcgaactcctggcctcaagcgatcctcccacctcgacctcccaaagtgctgggattacaggtgtgagccacctcgcctgggcccccttctccatatgcctccaaaaacatgtccctggagagtagcctgctcccacactgtcactggatgtcatggg

SEQ ID NO: 187286 - DNA, 1683 bp, Homo sapiens
  Payload ID: 16874
  Gene Symbol: SUMF2
  Gene Name: sulfatase modifying factor 2
  ENST ID: ENST00000436782
  CDS Start-End: 36-344
gccgtgggtgtacgcggcgcagcgcggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgacgggcctgtgcgggaggcgacagtgaaaccctttgccatcgacatatttcctgtcaccaacaaagatttcaggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacaattggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactaggtgaagcattgcattgtgggaatcacaaagcaaatagtactccagaaagacaaatatcagaagcttcctattctttttttttttttttttttttttgagacagggtctttctctgttgcccaggctagagtgcactggtgatcacggctcactctagccttgaattcctgggcccaagcaattctcccacctcagcctcctgagtagctgggactacaagtgtgcaccaccatgcctggctaattttttgaatttttgtagtgatgggatctcgctctgttgcccagggtggtctcgaactcctggcctcaagcgatcctcccacctcgacctcccaaagtgctgggattacaggtgtgagccacctcgcctgggcccccttctccatatgcctccaaaaacatgtccctggagagtagcctgctcccacactgtcactggatgtcatggggccaataaaatctcctgcaattgtgta

SEQ ID NO: 187287 - DNA, 912 bp, Homo sapiens
  Payload ID: 16874
  Gene Symbol: SUMF2
  Gene Name: sulfatase modifying factor 2
  ENST ID: ENST00000451338
  CDS Start-End: 1-912
catgggttaccgctgctgcccctgctgtcgctcctggtcggcgcgtggctcaagctaggaaatggacaggctactagcatggtccaactgcagggtgggagattcctgatgggaacaaattctccagacagcagagatggtgacgggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaagtcggggaggtgcctttgctgggccggagcatcttgcagtcggtctccttctttttcgcagtctgtactctggtggcttccagtggaaaaggcattttggaggcagcctgcaggtcctggctctggcatccgagagagactggagcacccagtgttacacgtgagctggaatgacgcccgtgcctactgtgcttggcggggaaaacgactgcccacggaggaagagtgggagtttgccgcccgagggggcttgaagggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggt

SEQ ID NO: 187288 - DNA, 881 bp, Homo sapiens
  Payload ID: 16874
  Gene Symbol: SUMF2
  Gene Name: sulfatase modifying factor 2
  ENST ID: ENST00000413952
  CDS Start-End: 1-881
atgagggcgcatgcgcagcggggccgtgggtgtacgcggcgcagcgcggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgacgggcctgtgcgggaggcgacagtgaaaccctttgccatcgacatatttcctgtcaccaacaaagatttcaggtacatcagggattttgtcagggagaaaaagtatcggacagaagctgagatgtttggatggagctttgtctttgaggactttgtctctgatgagctgagaaacaaagccacccagccaatgaagtctgtactctggtggcttccagtggaaaaggcattttggaggcagcctgcaggtcctggctctggcatccgagagagactggagcacccagtgttacacgtgagctggaatgacgcccgtgcctactgtgcttggcggggaaaacgactgcccacggaggaagagtgggagtttgccgcccgagggggcttgaagggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcac

SEQ ID NO: 187289 - DNA, 913 bp, Homo sapiens
  Payload ID: 16874
  Gene Symbol: SUMF2
  Gene Name: sulfatase modifying factor 2
  ENST ID: ENST00000452216
  CDS Start-End: 48-203
atgcgcagcggggccgtgggtgtacgcggcgcagcgcggcagtcctgatggcccggcatgggttaccgctgctgcccctgctgtcgctcctggtcggcgcgtggctcaagctagggattttgtcagggagaaaaagtatcggacagaagctgagatgtttggatggagctttgtctttgaggactttgtctctgatgagctgagaaacaaagccacccagccaatgaagtctgtactctggtggcttccagtggaaaaggcattttggaggcagcctgcaggtcctggctctggcatccgagagagactggagcacccagtgttacacgtgagctggaatgacgcccgtgcctactgtgcttggcggggaaaacgactgcccacggaggaagagtgggagtttgccgcccgagggggcttgaagggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttcccctt

SEQ ID NO: 187290 - DNA, 947 bp, Homo sapiens
  Payload ID: 16874
  Gene Symbol: SUMF2
  Gene Name: sulfatase modifying factor 2
  ENST ID: ENST00000437307
  CDS Start-End: 29-727
gtgtacgcggcgcagcgcggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgacgggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaagtctgtactctggtggcttccagtggaaaaggcattttggaggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggct

SEQ ID NO: 187291 - DNA, 2003 bp, Homo sapiens
  Payload ID: 16875
  Gene Symbol: SQRDL
  Gene Name: sulfide quinone reductase-like (yeast)
  Uniprot ID: Q9Y6N5
  ENST ID: ENST00000260324
  CDS Start-End: 387-1739
agcgtcaggtggcctcggtgtcctccgcctgtgcgccccagcctgcggggccgcccttcagggcgcgcaaggggcgagtctgtccagccggcagcaccccaggccggatggacgcttgttcctggttctgtgccccgtgagcgctcaacgccctggtgtgttcactgaccatggtgcctgggctgcggcgccgggcggggcacggcgggacttttcgggacctttcctggggggagcctcgctttccccgcctccagcctccgcccggatggcaggcgggcggggccccagtccaggccttgagacccagaagggagcgaaggtttttgctgcgccaacgcagtgaccgaaggctccgctcacgcccggcctgatcctgcctgaagatggtgccactggtggctgtggtatcagggccccgtgcccagctctttgcctgcctgctcaggctgggcactcagcaggtcggcccccttcagctgcacaccggggccagccatgcggccaggaaccattatgaggtgctggtgctgggtgggggcagtggcggaatcaccatggctgcccgcatgaagaggaaagtgggtgcagagaatgtggccattgttgagcccagtgagagacatttctaccagccaatctggacactggtgggtgctggtgccaaacaattgtcctcatctggtcgtcccacggcaagtgtgattccatctggtgtagaatggatcaaagctagagtgactgagttgaacccagacaagaactgcattcacacagatgacgacgagaagatctcctaccgatatcttattattgctctcggaatccagctggactatgagaagattaaaggcctacctgaaggtttcgctcatcccaaaatagggtcgaattattcagttaagactgtagagaagacatggaaagctctgcaggacttcaaagagggcaatgccatcttcaccttcccaaatactccagtgaagtgtgctggagcccctcagaagatcatgtacttatcagaagcctacttcaggaagacagggaagcgatccaaggccaatatcattttcaacacttctcttggagccattttcggggttaagaagtatgcagatgccctgcaggagatcatccaggagcggaacctcactgttaactacaagaaaaacctcattgaagtccgagccgataaacaagaggctgtatttgagaacctggacaaaccaggagagacccaagtgatttcatatgaaatgcttcatgtcacacctccaatgagcccaccagatgtcctcaagaccagtcctgtggctgatgctgctggttgggtggatgtggataaagaaactctgcaacacaggaggtacccaaatgtgtttgggattggggactgcaccaaccttcctacgtcaaagaccgctgctgcagtagctgcccagtcaggaatacttgataggacaatttctgtaattatgaagaatcaaacaccaacaaagaagtatgatggctacacatcatgtccactggtgaccggctacaaccgtgtgattcttgctgagtttgactacaaagcagagccgctagaaaccttcccctttgatcaaagcaaagagcgcctttccatgtatctcatgaaagctgacctgatgcctttcctgtattggaatatgatgctaaggggttactggggaggaccagcgtttctgcgcaagttgtttcatctaggtatgagttaaggatggctcagcacttgctcatcttggatggcttctgggccaaaactgcagtcactgaatgaccaagagcagcacgaaggacttggaacctatccttgtaaagagttccttgatgggtaatggtgaccaaatgcctcccttttcagtacctttgaacagcaaccatgtgggctactcatgatgggcttgattctttgggaataataaaatgaaataatacttttattttctgaataaaagtttgtcactgattgtgttctatga

SEQ ID NO: 187292 - DNA, 713 bp, Homo sapiens
  Payload ID: 16875
  Gene Symbol: SQRDL
  Gene Name: sulfide quinone reductase-like (yeast)
  ENST ID: ENST00000566934
  CDS Start-End: 1-545
gtggcggaatcaccatggctgcccgcatgaagaggaaagtgggtgcagagaatgtggccattgttgagcccagtgagagacatttctaccagccaatctggacactggtgggtgctggtgccaaacaattgtcctcatctggtcgtcccacggcaagtgtgattccatctggtgtagaatggatcaaagctagagtgactgagttgaacccagacaagaactgcattcacacagatgacgacgagaagatctcctaccgatatcttattattgctctcggaatccagctggactatgagaagattaaaggcctacctgaaggtttcgctcatcccaaaatagggtcgaattattcagttaagactgtagagaagacatggaaagctctgcaggacttcaaagagggcaatgccatcttcaccttcccaaatactccagtgaagtgtgctggagcccctcagaagatcatgtacttatcagaagcctacttcaggaaggtatgcttcctttctggggacagagatgagcagggcggacagtgctaattcactgattgcaagaattccattttatctctattgtaatcccttttttatctcggaatttttattacatgtgtacaaaattagttaactggaagtttataaaatataaaagaggagaaaatcactcatgatccaattgctttaataaagctgcagttttcaatttga

SEQ ID NO: 187293 - DNA, 566 bp, Homo sapiens
  Payload ID: 16875
  Gene Symbol: SQRDL
  Gene Name: sulfide quinone reductase-like (yeast)
  ENST ID: ENST00000565997
  CDS Start-End: 1-373
ggctgatgctgctggttgggtggatgtggataaagaaactctgcaacacaggaggtacccaaatgtgtttgggattggggactgcaccaaccttcctacgtcaaagaccgctgctgcagtagctgcccagtcaggaatacttgataggacaatttctgtaattatgaagaatcaaacaccaacaaagaagtatgatggctacacatcatgtccactggtgaccggctacaaccgtgtgattcttgctgagtttgactacaaagcagagccgctagaaaccttcccctttgatcaaagcaaagagcgcctttccatgtatctcatgaaagctgacctgatgcctttcctgtattggaatatgatgctaaggtaagtgcactgcctggttcctggatgaggaaagggatttgtagcacatctccacccaaaggggatgcagcctcttttcttcattattagcagtgaccaagtgttctgtcttccatgctctaggccctcttttgctgctggataaataataatagtaaatcactttcacataccaagtactctatcatctgctacct

SEQ ID NO: 187294 - DNA, 1792 bp, Homo sapiens
  Payload ID: 16875
  Gene Symbol: SQRDL
  Gene Name: sulfide quinone reductase-like (yeast)
  Uniprot ID: Q9Y6N5
  ENST ID: ENST00000568606
  CDS Start-End: 190-1542
ctcattttctcttgccgccaccatgtaagaagcgcctttcgcctccctccatgattctgaggcctccccagccacatggtacttgtatgcctagacagcgggcacagggcttgctggacacagaaggcaaggactcagagaatatccaccagatgaaagaatgactgcatgacctgatcctgcctgaagatggtgccactggtggctgtggtatcagggccccgtgcccagctctttgcctgcctgctcaggctgggcactcagcaggtcggcccccttcagctgcacaccggggccagccatgcggccaggaaccattatgaggtgctggtgctgggtgggggcagtggcggaatcaccatggctgcccgcatgaagaggaaagtgggtgcagagaatgtggccattgttgagcccagtgagagacatttctaccagccaatctggacactggtgggtgctggtgccaaacaattgtcctcatctggtcgtcccacggcaagtgtgattccatctggtgtagaatggatcaaagctagagtgactgagttgaacccagacaagaactgcattcacacagatgacgacgagaagatctcctaccgatatcttattattgctctcggaatccagctggactatgagaagattaaaggcctacctgaaggtttcgctcatcccaaaatagggtcgaattattcagttaagactgtagagaagacatggaaagctctgcaggacttcaaagagggcaatgccatcttcaccttcccaaatactccagtgaagtgtgctggagcccctcagaagatcatgtacttatcagaagcctacttcaggaagacagggaagcgatccaaggccaatatcattttcaacacttctcttggagccattttcggggttaagaagtatgcagatgccctgcaggagatcatccaggagcggaacctcactgttaactacaagaaaaacctcattgaagtccgagccgataaacaagaggctgtatttgagaacctggacaaaccaggagagacccaagtgatttcatatgaaatgcttcatgtcacacctccaatgagcccaccagatgtcctcaagaccagtcctgtggctgatgctgctggttgggtggatgtggataaagaaactctgcaacacaggaggtacccaaatgtgtttgggattggggactgcaccaaccttcctacgtcaaagaccgctgctgcagtagctgcccagtcaggaatacttgataggacaatttctgtaattatgaagaatcaaacaccaacaaagaagtatgatggctacacatcatgtccactggtgaccggctacaaccgtgtgattcttgctgagtttgactacaaagcagagccgctagaaaccttcccctttgatcaaagcaaagagcgcctttccatgtatctcatgaaagctgacctgatgcctttcctgtattggaatatgatgctaaggggttactggggaggaccagcgtttctgcgcaagttgtttcatctaggtatgagttaaggatggctcagcacttgctcatcttggatggcttctgggccaaaactgcagtcactgaatgaccaagagcagcacgaaggacttggaacctatccttgtaaagagttccttgatgggtaatggtgaccaaatgcctcccttttcagtacctttgaacagcaaccatgtgggctactcatgatgggcttgattctttgggaataataaaatgaaataatacttttattttctgaataaaagtttgtcactg

SEQ ID NO: 187295 - DNA, 613 bp, Homo sapiens
  Payload ID: 16875
  Gene Symbol: SQRDL
  Gene Name: sulfide quinone reductase-like (yeast)
  ENST ID: ENST00000561735
  CDS Start-End: 192-613
gttggcacccaggggcggaagcgtcaggtggcctcggtgtcctccgcctgtgcgccccagcctgcggggccgcccttcagggcgcgcaaggggcgagtctgtccagccggcagcaccccaggccggatggacgcttgttcctggttctgtgccccgtgagcgctcaacgccctgcctgatcctgcctgaagatggtgccactggtggctgtggtatcagggccccgtgcccagctctttgcctgcctgctcaggctgggcactcagcaggtcggcccccttcagctgcacaccggggccagccatgcggccaggaaccattatgaggtgctggtgctgggtgggggcagtggcggaatcaccatggctgcccgcatgaagaggaaagtgggtgcagagaatgtggccattgttgagcccagtgagagacatttctaccagccaatctggacactggtgggtgctggtgccaaacaattgtcctcatctggtcgtcccacggcaagtgtgattccatctggtgtagaatggatcaaagctagagtgactgagttgaacccagacaagaactgcattcacacagatgacgacgagaagatctcctaccgatatct

SEQ ID NO: 187296 - DNA, 567 bp, Homo sapiens
  Payload ID: 16875
  Gene Symbol: SQRDL
  Gene Name: sulfide quinone reductase-like (yeast)
  ENST ID: ENST00000563296
  CDS Start-End: 454-567
agtactggaggatcagcctctttgctctgatcttcctcctgagccttccctttcttgtgataaggatccctttcactgttccattctctatttccacccattcctgttgccagcccttcctgcccacgtgtctgcaaatcttcccagagccctgatttggatttattttccttctcccggatgttcttgaattggggtgtgttcctcttagtgctagctcctcctatcacttcttcttcccatcctttaatgatacttctttcagtttcccatatccccaagtgcactttcattcctcgcaaacttcacatgggtaggaatcaagtctgatttttttcaacagtgtatgcctagacagcgggcacagggcttgctggacacagaaggcaaggactcagagaatatccaccagatgaaagaatgactgcatgagtaacctgatcctgcctgaagatggtgccactggtggctgtggtatcagggccccgtgcccagctctttgcctgcctgctcaggctgggcactcagcaggtcggcccccttcagctgcacaccggggccagccat

SEQ ID NO: 187297 - DNA, 527 bp, Homo sapiens
  Payload ID: 16875
  Gene Symbol: SQRDL
  Gene Name: sulfide quinone reductase-like (yeast)
  ENST ID: ENST00000565227
  CDS Start-End: 309-527
aaagacagtactggaggatcagcctctttgctctgatcttcctcctgagccttccctttcttgtgataaggatccctttcactgttccattctctatttccacccattcctgttgccagcccttcctgcccacgtgtctgcaaatcttcccagagccctgatttggatttattttccttctcccggatgttcttgaattgggtgtatgcctagacagcgggcacagggcttgctggacacagaaggcaaggactcagagaatatccaccagatgaaagaatgactgcatgacctgatcctgcctgaagatggtgccactggtggctgtggtatcagggccccgtgcccagctctttgcctgcctgctcaggctgggcactcagcaggtcggcccccttcagctgcacaccggggccagccatgcggccaggaaccattatgaggtgctggtgctgggtgggggcagtggcggaatcaccatggctgcccgcatgaagaggaaagtgggtgcagagaatgtggccatt

SEQ ID NO: 187298 - DNA, 569 bp, Homo sapiens
  Payload ID: 16875
  Gene Symbol: SQRDL
  Gene Name: sulfide quinone reductase-like (yeast)
  ENST ID: ENST00000561493
  CDS Start-End: 146-569
gcagggagttttcccatgttccaggaggcagccagcttgtaactagcaagcattgctatgtttgtatttctgatacattttctaaaagagatcgcagaacaaagggtcctgactcaccaaggatacagcctgatcctgcctgaagatggtgccactggtggctgtggtatcagggccccgtgcccagctctttgcctgcctgctcaggctgggcactcagcaggtcggcccccttcagctgcacaccggggccagccatgcggccaggaaccattatgaggtgctggtgctgggtgggggcagtggcggaatcaccatggctgcccgcatgaagaggaaagtgggtgcagagaatgtggccattgttgagcccagtgagagacatttctaccagccaatctggacactggtgggtgctggtgccaaacaattgtcctcatctggtcgtcccacggcaagtgtgattccatctggtgtagaatggatcaaagctagagtgactgagttgaacccagacaagaactgcattcacacagatgacgacgagaagatctcctaccgatatctta

SEQ ID NO: 187299 - DNA, 2698 bp, Homo sapiens
  Payload ID: 16876
  Gene Symbol: SRXN1
  Gene Name: sulfiredoxin 1
  Uniprot ID: Q9BYN0
  ENST ID: ENST00000381962
  CDS Start-End: 186-599
cggcacctggcgagcggagccggagtcgggctggggaccgcggggtcgaggccggaccgcggcggggtcgggggagaaacgcgcgctgccctggcacgggcccccccccccggccgcgcggaatggtatggcccggccggagttaaggccggggggaggcggcgagtcccgcggcggcggcgacgatggggctgcgtgcaggaggaacgctgggcagggccggcgcgggtcggggggcgcccgaggggcccgggccgagcggcggcgcgcagggcggcagcatccactcgggccgcatcgccgcggtgcacaacgtgccgctgagcgtgctcatccggccgctgccgtccgtgttggaccccgccaaggtgcagagcctcgtggacacgatccgggaggacccagacagcgtgccccccatcgatgtcctctggatcaaaggggcccagggaggtgactacttctactcctttgggggctgccaccgctacgcggcctaccagcaactgcagcgagagaccatccccgccaagcttgtccagtccactctctcagacctaagggtgtacctgggagcatccacaccagacttgcagtagcagcctccttggcacctgctgccaccttcaagagcccagaagacacacctggcctccagcaggctgggccatgcagaagggatagcaggggtgcattctctttgcacctggcgagagggtctgactctgggcacccctctcaccagctacaaggccttggactcactgtacagtgtgggagccccagttcccacctctgtgacaataggatcatggccttacccttgaagcattaccgagaaggagaacagagatgggcttgaagagccacgtgctgccggctccaaattcccaaggacaaggatccctctgcatttttgtctatgtaacctcttatatggactacattcagctgcaaggaaaggaaaaccttgattgcagtggtttaaacaaacagaagattgtttttccacatagcatggattctggagatgggtggctaatggtattggttcaacaactccacgaaggtaggggtcacgtcttggatccttttgccttaatctcagtgctcgttacttcatggtcccaagatggctgctgtatccccaagaatcatgtctgcgttcaaggaaggaggggtggaggaagaggaagggccaaactagctggacccgtcaccttctatcagaaagtaaaacctcgtcagaagtctgtttcctgctctctccctctgcatatcttcacttagatgcccttggcccgagccagctaccattgcacctctagctgcaaacaaagctaagacagcagggaacagaattgtcatggctgaatagaccaatcgtgttccatctactgagactggcacactgcctcctgcaataaaactgggatcccattaccaagagagaaatgcagaattgtgtaccagttagcttttgctgtgtaacaaaccatccccaaacttggcagctagaaacaaaccctgtattttcccacaatcctatgggttggcaatttgggctgggctcaacagggcagttctgctgctcacacctgggatccctcatggagctaaggtcagctgttacctcagctgggcctggatggtctaggatagccttactcacttgcctggcaggtgacaggctgttggctggaattgcttggttctcctccatgtggcctctccagcaggctagctcaggcttattcacatgatggcttcaggattccaaagagagtgagagtagaagctgaaagacttcttgagttcttggcctggaactgggactaggacagtgtcacttctgctaagttcttttggtcagagcaaatcacaaggctttacccagattcaagggatgagaaacagactacatgtcttgatgaggggaaccacaaagagcttgtggccatttttcacctatcacaaataattttggatgggtatttatttggataaaggtatttccctcttccccctttctctctgtctcatggggcctcactctgccaagttggaaggcactaagacattgtcctggccctcagggtctaggggaagaggtgttggggcaggaagtgagtctctccatgggctggacccactgtagtaggagtgcctccttgtctgcactgctggtatggggttaggccaggtaggacattccagaggggcttctgaaaaccaagagtccctggggaaagggaacagagtaaggcaggccttgttctcactgccctctaagggaacttggtcactcggcacttttaagcctcagtttctccagttcaataataaggacaagagcttttcccatgcattctctttccccgggaaagttgactgaggtgaccagtaatagaattgaaaagggagagtgtcttcagtgcaatgtggcatcctggattgggtcttggaacaaaaacaggacattagtgggaaaattggaaatctgaaaaaagtctgaattttagttaatataccaatttcagtctcttggttttgacagatgtaccatggtgatgtaagatgttgaccttggggtaggctgggtgaagggtatacaggaactctttgtactatctctgcaacttctctgtaaatctagtatcattccaaaataaaagtttatttaatttaaaaaaaaaaa

SEQ ID NO: 187300 - DNA, 2364 bp, Homo sapiens
  Payload ID: 16877
  Gene Symbol: SUOX
  Gene Name: sulfite oxidase
  Uniprot ID: P51687
  ENST ID: ENST00000266971
  CDS Start-End: 229-1866
agtgagaggtcacttactgcagccggacataacggcgctggccccgccccttctcgagaactcgcagagctgggctggtaaaattgcagtgctgaagacactggacccgcaaaaggctgtccctcccaaacctgggattctgggctcactgagttcacctgcgagtcagccctacctgcactgctctggtctagtacaaacaggctgctggcattgaggtctgctacaatgctgctgctgcacagagctgtggtcctcaggctccaacaggcctgcagactcaagtcaatcccctcaaggatctgcattcaggcctgctccacaaatgattcatttcagccccagcgccccagcctcaccttctctggtgataactccagcacccagggatggagagtcatggggaccctattaggtctcggtgcagtgttggcctatcaggaccatcggtgtagggctgctcaggagtcaacacacatatacactaaggaggaagtgagttcccacaccagccctgagactgggatctgggtgactctgggctctgaggtctttgatgtcacagaatttgtggacctacatccaggggggccttcaaagctgatgctagcagctgggggtcccctagagcccttctgggccctctatgctgttcacaaccagtcccatgtgcgtgagttactggctcagtacaagattggggagctgaatcctgaagacaaggtagcccccaccgtggagacctctgacccttatgctgatgatcctgtacgtcacccagccctgaaggtcaacagccagcggccctttaatgcagagcctccccctgagctgctgacagaaaactacatcacacccaaccctatcttcttcacccggaaccatctgcctgtacctaacctggatccagacacctatcgcttacacgtagtaggagcacctgggggtcagtcactgtctctttccctggatgacttgcacaactttcccaggtacgagatcacagtcactctgcagtgtgccggcaaccgacgctctgagatgactcaggtcaaagaagtaaaaggtctggagtggagaacaggagccatcagcactgcacgctgggctggggcacggctctgtgatgtgttagcccaggctggccaccaactctgtgaaactgaggcccacgtctgctttgagggactggactcagaccctactgggactgcctatggagcatccatccctctggctcgggccatggaccctgaagctgaggtcctgctggcatatgagatgaatgggcagcctctgccacgtgaccacggcttccctgtgcgtgtggtggttcctggagtggtgggtgcccgccatgtcaaatggctgggcagagtgagtgtgcagccagaggaaagttacagccactggcaacggcgggattacaaaggcttctctccatctgtggactgggagactgtagattttgactctgctccatccattcaggaacttcctgtccagtcggccatcacagagccccgggatggagagactgtagaatcaggggaggtgaccatcaagggctatgcatggagtggtggtggcagggctgtgatccgggtggatgtgtctctggatgggggcctaacctggcaggtggctaagctggatggagaggaacagcgccccaggaaggcctgggcatggcgtctgtggcagttgaaagcccctgtgccagctggacaaaaggaactgaacattgtttgtaaggctgtggatgatggttacaatgtgcagccagacaccgtggccccaatctggaacctgcgaggtgttctcagcaatgcctggcatcgtgtccatgtctatgtctccccatgagcatggaaaggagccacctccacccctttccccacccattagcctcactgcttcagaaaaatctttcccacctttcaacttcttggatcacaactctggccttcctaagccatacccaagtacacatatagcacatttcacccaaggaccttccctctttggacactatgttacatacccctcttggcctttgaacctgtgccaggaagtgtgagctgttacagcaaggggctagaagtgaaaaaagtaattctggagacaagcactattttctcttcctaccccacctccatttctaatgcctactgccatcaaggccttgttttgcttttctttttggattgttcagagaaatgtgtgtggcatgtgtaagaaaagtgtatatactatcttatactacctctccaggttgccagagagttgcgaggagagcaaggggcacaaccgtctccctttatagttctacttttctaataaatagtctgtttaagatcataa

SEQ ID NO: 187301 - DNA, 2306 bp, Homo sapiens
  Payload ID: 16877
  Gene Symbol: SUOX
  Gene Name: sulfite oxidase
  Uniprot ID: P51687
  ENST ID: ENST00000356124
  CDS Start-End: 171-1808
aatggttgagccacccgcttccagccaatggctgagggataagctgaggggagtgagaggtcacttactgcagccggacataacggcgctggccccgccccttctcgagaactcgcagagctgggctggtaaaattgcagtgctgaagacactggacccggtctgctacaatgctgctgctgcacagagctgtggtcctcaggctccaacaggcctgcagactcaagtcaatcccctcaaggatctgcattcaggcctgctccacaaatgattcatttcagccccagcgccccagcctcaccttctctggtgataactccagcacccagggatggagagtcatggggaccctattaggtctcggtgcagtgttggcctatcaggaccatcggtgtagggctgctcaggagtcaacacacatatacactaaggaggaagtgagttcccacaccagccctgagactgggatctgggtgactctgggctctgaggtctttgatgtcacagaatttgtggacctacatccaggggggccttcaaagctgatgctagcagctgggggtcccctagagcccttctgggccctctatgctgttcacaaccagtcccatgtgcgtgagttactggctcagtacaagattggggagctgaatcctgaagacaaggtagcccccaccgtggagacctctgacccttatgctgatgatcctgtacgtcacccagccctgaaggtcaacagccagcggccctttaatgcagagcctccccctgagctgctgacagaaaactacatcacacccaaccctatcttcttcacccggaaccatctgcctgtacctaacctggatccagacacctatcgcttacacgtagtaggagcacctgggggtcagtcactgtctctttccctggatgacttgcacaactttcccaggtacgagatcacagtcactctgcagtgtgccggcaaccgacgctctgagatgactcaggtcaaagaagtaaaaggtctggagtggagaacaggagccatcagcactgcacgctgggctggggcacggctctgtgatgtgttagcccaggctggccaccaactctgtgaaactgaggcccacgtctgctttgagggactggactcagaccctactgggactgcctatggagcatccatccctctggctcgggccatggaccctgaagctgaggtcctgctggcatatgagatgaatgggcagcctctgccacgtgaccacggcttccctgtgcgtgtggtggttcctggagtggtgggtgcccgccatgtcaaatggctgggcagagtgagtgtgcagccagaggaaagttacagccactggcaacggcgggattacaaaggcttctctccatctgtggactgggagactgtagattttgactctgctccatccattcaggaacttcctgtccagtcggccatcacagagccccgggatggagagactgtagaatcaggggaggtgaccatcaagggctatgcatggagtggtggtggcagggctgtgatccgggtggatgtgtctctggatgggggcctaacctggcaggtggctaagctggatggagaggaacagcgccccaggaaggcctgggcatggcgtctgtggcagttgaaagcccctgtgccagctggacaaaaggaactgaacattgtttgtaaggctgtggatgatggttacaatgtgcagccagacaccgtggccccaatctggaacctgcgaggtgttctcagcaatgcctggcatcgtgtccatgtctatgtctccccatgagcatggaaaggagccacctccacccctttccccacccattagcctcactgcttcagaaaaatctttcccacctttcaacttcttggatcacaactctggccttcctaagccatacccaagtacacatatagcacatttcacccaaggaccttccctctttggacactatgttacatacccctcttggcctttgaacctgtgccaggaagtgtgagctgttacagcaaggggctagaagtgaaaaaagtaattctggagacaagcactattttctcttcctaccccacctccatttctaatgcctactgccatcaaggccttgttttgcttttctttttggattgttcagagaaatgtgtgtggcatgtgtaagaaaagtgtatatactatcttatactacctctccaggttgccagagagttgcgaggagagcaaggggcacaaccgtctccctttatagttctacttttctaataaatagtctgtttaagatcataa

SEQ ID NO: 187302 - DNA, 2860 bp, Homo sapiens
  Payload ID: 16877
  Gene Symbol: SUOX
  Gene Name: sulfite oxidase
  Uniprot ID: P51687
  ENST ID: ENST00000394109
  CDS Start-End: 725-2362
gtaatatagggtttggtgcaatctgtggtttcaaacatctactgggggtcgtagaacatatccccagtggataagggggtactactgtacttgttggctcttcatgttagctctgctaggcagatgtcatttcagagatgaggaagcaagttcagaacggcttggaatcttgctcaggaaatcgggctggttaatgaataacaagagatccagtttcacaaacccaaggcattttgcccccagaatctgggcttcttcacccatttaggctgtcactacttttttttcacttttttatccctgtttaagtcagtctgacccacagttgtcctctgctgacttcagaaataataatctggccagtagacatttggtttcggtcctttaggcccttcgccccaggcatcgttctctatggtggacaaagttcagaatggaagatgggagaaaggtgattctgattctagaagcacccatccctcctaccccattccccacccgcattacctgccatcctgtcagcacagtctgtctctgaagtgctccaagttttctctaagggcccatttggactcccactctcaagactcctcacttgcccagaaagctccttgctgaccttctctgtgtcttcctctcacccattcccttaggcctccctaatatcccctcccagggtctccctatcttgatcccagaatcttccttctacaggtctgctacaatgctgctgctgcacagagctgtggtcctcaggctccaacaggcctgcagactcaagtcaatcccctcaaggatctgcattcaggcctgctccacaaatgattcatttcagccccagcgccccagcctcaccttctctggtgataactccagcacccagggatggagagtcatggggaccctattaggtctcggtgcagtgttggcctatcaggaccatcggtgtagggctgctcaggagtcaacacacatatacactaaggaggaagtgagttcccacaccagccctgagactgggatctgggtgactctgggctctgaggtctttgatgtcacagaatttgtggacctacatccaggggggccttcaaagctgatgctagcagctgggggtcccctagagcccttctgggccctctatgctgttcacaaccagtcccatgtgcgtgagttactggctcagtacaagattggggagctgaatcctgaagacaaggtagcccccaccgtggagacctctgacccttatgctgatgatcctgtacgtcacccagccctgaaggtcaacagccagcggccctttaatgcagagcctccccctgagctgctgacagaaaactacatcacacccaaccctatcttcttcacccggaaccatctgcctgtacctaacctggatccagacacctatcgcttacacgtagtaggagcacctgggggtcagtcactgtctctttccctggatgacttgcacaactttcccaggtacgagatcacagtcactctgcagtgtgccggcaaccgacgctctgagatgactcaggtcaaagaagtaaaaggtctggagtggagaacaggagccatcagcactgcacgctgggctggggcacggctctgtgatgtgttagcccaggctggccaccaactctgtgaaactgaggcccacgtctgctttgagggactggactcagaccctactgggactgcctatggagcatccatccctctggctcgggccatggaccctgaagctgaggtcctgctggcatatgagatgaatgggcagcctctgccacgtgaccacggcttccctgtgcgtgtggtggttcctggagtggtgggtgcccgccatgtcaaatggctgggcagagtgagtgtgcagccagaggaaagttacagccactggcaacggcgggattacaaaggcttctctccatctgtggactgggagactgtagattttgactctgctccatccattcaggaacttcctgtccagtcggccatcacagagccccgggatggagagactgtagaatcaggggaggtgaccatcaagggctatgcatggagtggtggtggcagggctgtgatccgggtggatgtgtctctggatgggggcctaacctggcaggtggctaagctggatggagaggaacagcgccccaggaaggcctgggcatggcgtctgtggcagttgaaagcccctgtgccagctggacaaaaggaactgaacattgtttgtaaggctgtggatgatggttacaatgtgcagccagacaccgtggccccaatctggaacctgcgaggtgttctcagcaatgcctggcatcgtgtccatgtctatgtctccccatgagcatggaaaggagccacctccacccctttccccacccattagcctcactgcttcagaaaaatctttcccacctttcaacttcttggatcacaactctggccttcctaagccatacccaagtacacatatagcacatttcacccaaggaccttccctctttggacactatgttacatacccctcttggcctttgaacctgtgccaggaagtgtgagctgttacagcaaggggctagaagtgaaaaaagtaattctggagacaagcactattttctcttcctaccccacctccatttctaatgcctactgccatcaaggccttgttttgcttttctttttggattgttcagagaaatgtgtgtggcatgtgtaagaaaagtgtatatactatcttatactacctctccaggttgccagagagttgcgaggagagcaaggggcacaaccgtctccctttatagttctacttttctaataaatagtctgtttaagatcataa

SEQ ID NO: 187303 - DNA, 2394 bp, Homo sapiens
  Payload ID: 16877
  Gene Symbol: SUOX
  Gene Name: sulfite oxidase
  Uniprot ID: P51687
  ENST ID: ENST00000394115
  CDS Start-End: 298-1935
gaactcgcagagctgggctggtaaaattgcagtgctgaagacactggacccgcaaaaggctgtccctcccaaacctgggattctgggctcactgagttcacctgcgagtcagccctacctgcactgctctggtctagtacaaacaggctgctggcattgagggacggagtctccaactcctggcctctagcagtcctcctgtgtaggtctcccaaagtgctagtgtgtccggaattggtgggttcttggtctcactgacttcaagaatgaagccgcggaccctcgcagtctgctacaatgctgctgctgcacagagctgtggtcctcaggctccaacaggcctgcagactcaagtcaatcccctcaaggatctgcattcaggcctgctccacaaatgattcatttcagccccagcgccccagcctcaccttctctggtgataactccagcacccagggatggagagtcatggggaccctattaggtctcggtgcagtgttggcctatcaggaccatcggtgtagggctgctcaggagtcaacacacatatacactaaggaggaagtgagttcccacaccagccctgagactgggatctgggtgactctgggctctgaggtctttgatgtcacagaatttgtggacctacatccaggggggccttcaaagctgatgctagcagctgggggtcccctagagcccttctgggccctctatgctgttcacaaccagtcccatgtgcgtgagttactggctcagtacaagattggggagctgaatcctgaagacaaggtagcccccaccgtggagacctctgacccttatgctgatgatcctgtacgtcacccagccctgaaggtcaacagccagcggccctttaatgcagagcctccccctgagctgctgacagaaaactacatcacacccaaccctatcttcttcacccggaaccatctgcctgtacctaacctggatccagacacctatcgcttacacgtagtaggagcacctgggggtcagtcactgtctctttccctggatgacttgcacaactttcccaggtacgagatcacagtcactctgcagtgtgccggcaaccgacgctctgagatgactcaggtcaaagaagtaaaaggtctggagtggagaacaggagccatcagcactgcacgctgggctggggcacggctctgtgatgtgttagcccaggctggccaccaactctgtgaaactgaggcccacgtctgctttgagggactggactcagaccctactgggactgcctatggagcatccatccctctggctcgggccatggaccctgaagctgaggtcctgctggcatatgagatgaatgggcagcctctgccacgtgaccacggcttccctgtgcgtgtggtggttcctggagtggtgggtgcccgccatgtcaaatggctgggcagagtgagtgtgcagccagaggaaagttacagccactggcaacggcgggattacaaaggcttctctccatctgtggactgggagactgtagattttgactctgctccatccattcaggaacttcctgtccagtcggccatcacagagccccgggatggagagactgtagaatcaggggaggtgaccatcaagggctatgcatggagtggtggtggcagggctgtgatccgggtggatgtgtctctggatgggggcctaacctggcaggtggctaagctggatggagaggaacagcgccccaggaaggcctgggcatggcgtctgtggcagttgaaagcccctgtgccagctggacaaaaggaactgaacattgtttgtaaggctgtggatgatggttacaatgtgcagccagacaccgtggccccaatctggaacctgcgaggtgttctcagcaatgcctggcatcgtgtccatgtctatgtctccccatgagcatggaaaggagccacctccacccctttccccacccattagcctcactgcttcagaaaaatctttcccacctttcaacttcttggatcacaactctggccttcctaagccatacccaagtacacatatagcacatttcacccaaggaccttccctctttggacactatgttacatacccctcttggcctttgaacctgtgccaggaagtgtgagctgttacagcaaggggctagaagtgaaaaaagtaattctggagacaagcactattttctcttcctaccccacctccatttctaatgcctactgccatcaaggccttgttttgcttttctttttggattgttcagagaaatgtgtgtggcatgtgtaagaaaagtgtatatactatcttatactacctctccaggttgccagagagttgcgaggagagcaaggggcacaaccgtctccctttata

SEQ ID NO: 187304 - DNA, 556 bp, Homo sapiens
  Payload ID: 16877
  Gene Symbol: SUOX
  Gene Name: sulfite oxidase
  ENST ID: ENST00000547586
  CDS Start-End: 429-556
aactcgcagagctgggctggtaaaattgcagtgctgaagacactggacccgcaaaaggctgtccctcccaaacctgggattctgggctcactgagttcacctgcgagtcagccctacctgcactgctctggtctagtacaaacaggctgctggcattgagggacggagtctccaactcctggcctctagcagtcctcctgtgtaggtctcccaaagtgctagtgtgtccggaattggtgggttcttggtctcactgacttcaagaatgaagccgcggaccctcgcagtgagtgttacagttcttaaaggcagcgtgtccggagtttgttccttctgatgttcagatgtgtttggagtttcttccttctggtgggttcgtgctcttgctggctcaggagtgaagctgcagaccttcacagtctgctacaatgctgctgctgcacagagctgtggtcctcaggctccaacaggcctgcagactcaagtcaatcccctcaaggatctgcattcaggcctgctccacaaatgattcatttcagccccagcgccccagcct

SEQ ID NO: 187305 - DNA, 906 bp, Homo sapiens
  Payload ID: 16877
  Gene Symbol: SUOX
  Gene Name: sulfite oxidase
  ENST ID: ENST00000551841
  CDS Start-End: 120-434
caaaaggctgtccctcccaaacctgggattctgggctcactgagttcacctgcgagtcagccctacctgcactgctctggtctagtacaaacaggctgctggcattgaggtctgctacaatgctgctgctgcacagagctgtggtcctcaggctccaacaggcctgcagactcaagtcaatcccctcaaggatctgcattcaggcctgctccacaaatgattcatttcagccccagcgccccagcctcaccttctctggtgataactccagcacccagggatggagagtcatggggaccctattaggtctcggtgcagtgttggcctatcaggaccatcggtgtagggctgctcaggagtcaacacacatatacactaaggaggaagtacgagatcacagtcactctgcagtgtgccggcaaccgacgctctgagatgactcaggtcaaagaagtaaaaggtctggagtggagaacaggagccatcagcactgcacgctgggctggggcacggctctgtgatgtgttagcccaggctggccaccaactctgtgaaactgaggcccacgtctgctttgagggactggactcagaccctactgggactgcctatggagcatccatccctctggctcgggccatggaccctgaagctgaggtcctgctggcatatgagatgaatgggcagcctctgccacgtgaccacggcttccctgtgcgtgtggtggttcctggagtggtgggtgcccgccatgtcaaatggctgggcagagtgagtgtgcagccagaggaaagttacagccactggcaacggcgggattacaaaggcttctctccatctgtggactgggagactgtagattttgactctgctccatccattcaggaacttcctgtccagtcggcc

SEQ ID NO: 187306 - DNA, 952 bp, Homo sapiens
  Payload ID: 16877
  Gene Symbol: SUOX
  Gene Name: sulfite oxidase
  ENST ID: ENST00000546833
  CDS Start-End: 468-952
actggacccggtaaggagactgggggtggtaaagaagctggggaggaagggctgctgagctgggcagcggagggggccttggtgtccagctgtgctccgaacctcaagggcaacaaaactatcagtacctgcctccactccttctgtctgggtgctcttgagatcgcggggtgttgccgcaagacccttttgtgcctggatgccggacgtatgttcctacctaacgtgcccatggggagtgaggggtcatcacctgcaccaacgggtggcatttctgtattacagcaaaaggctgtccctcccaaacctgggattctgggctcactgagttcacctgcgagtcagccctacctgcactgctctggtctagtacaaacaggctgctggcattgaggcccttcgccccaggcatcgttctctatggtggacaaagttcagaatggaagatgggagaaaggtctgctacaatgctgctgctgcacagagctgtggtcctcaggctccaacaggcctgcagactcaagtcaatcccctcaaggatctgcattcaggcctgctccacaaatgattcatttcagccccagcgccccagcctcaccttctctggtgataactccagcacccagggatggagagtcatggggaccctattaggtctcggtgcagtgttggcctatcaggaccatcggtgtagggctgctcaggagtcaacacacatatacactaaggaggaagtgagttcccacaccagccctgagactgggatctgggtgactctgggctctgaggtctttgatgtcacagaatttgtggacctacatccaggggggccttcaaagctgatgctagcagctgggggtcccctagagcccttctgggccctctatgctgttcacaaccagtcccatgtgcgtgagttactggctcagtacaagattggggagctgaatcc

SEQ ID NO: 187307 - DNA, 543 bp, Homo sapiens
  Payload ID: 16877
  Gene Symbol: SUOX
  Gene Name: sulfite oxidase
  ENST ID: ENST00000552258
  CDS Start-End: 181-543
agagctgggctggtaaaattgcagtgctgaagacactggacccgggacggagtctccaactcctggcctctagcagtcctcctgtgtaggtctcccaaagtgctagtgtgtccggaattggtgggttcttggtctcactgacttcaagaatgaagccgcggaccctcgcagtctgctacaatgctgctgctgcacagagctgtggtcctcaggctccaacaggcctgcagactcaagtcaatcccctcaaggatctgcattcaggcctgctccacaaatgattcatttcagccccagcgccccagcctcaccttctctggtgataactccagcacccagggatggagagtcatggggaccctattaggtctcggtgcagtgttggcctatcaggaccatcggtgtagggctgctcaggagtcaacacacatatacactaaggaggaagtgagttcccacaccagccctgagactgggatctgggtgactctgggctctgaggtctttgatgtcacagaatttgtggacctacatccagggggg

SEQ ID NO: 187308 - DNA, 2352 bp, Homo sapiens
  Payload ID: 16877
  Gene Symbol: SUOX
  Gene Name: sulfite oxidase
  Uniprot ID: P51687
  ENST ID: ENST00000548274
  CDS Start-End: 217-1854
agctgggctggtaaaattgcagtgctgaagacactggacccgagacaggttttccccattttggccaggctggtctcaaactcctgacctcaggtgatttgcccgcctcagcctcccaaagtgctgggattacagacgtgagccactgcgccgggcattgttgttaatctcttactgtgggtaatttagtaattaaactataagaggtctgctacaatgctgctgctgcacagagctgtggtcctcaggctccaacaggcctgcagactcaagtcaatcccctcaaggatctgcattcaggcctgctccacaaatgattcatttcagccccagcgccccagcctcaccttctctggtgataactccagcacccagggatggagagtcatggggaccctattaggtctcggtgcagtgttggcctatcaggaccatcggtgtagggctgctcaggagtcaacacacatatacactaaggaggaagtgagttcccacaccagccctgagactgggatctgggtgactctgggctctgaggtctttgatgtcacagaatttgtggacctacatccaggggggccttcaaagctgatgctagcagctgggggtcccctagagcccttctgggccctctatgctgttcacaaccagtcccatgtgcgtgagttactggctcagtacaagattggggagctgaatcctgaagacaaggtagcccccaccgtggagacctctgacccttatgctgatgatcctgtacgtcacccagccctgaaggtcaacagccagcggccctttaatgcagagcctccccctgagctgctgacagaaaactacatcacacccaaccctatcttcttcacccggaaccatctgcctgtacctaacctggatccagacacctatcgcttacacgtagtaggagcacctgggggtcagtcactgtctctttccctggatgacttgcacaactttcccaggtacgagatcacagtcactctgcagtgtgccggcaaccgacgctctgagatgactcaggtcaaagaagtaaaaggtctggagtggagaacaggagccatcagcactgcacgctgggctggggcacggctctgtgatgtgttagcccaggctggccaccaactctgtgaaactgaggcccacgtctgctttgagggactggactcagaccctactgggactgcctatggagcatccatccctctggctcgggccatggaccctgaagctgaggtcctgctggcatatgagatgaatgggcagcctctgccacgtgaccacggcttccctgtgcgtgtggtggttcctggagtggtgggtgcccgccatgtcaaatggctgggcagagtgagtgtgcagccagaggaaagttacagccactggcaacggcgggattacaaaggcttctctccatctgtggactgggagactgtagattttgactctgctccatccattcaggaacttcctgtccagtcggccatcacagagccccgggatggagagactgtagaatcaggggaggtgaccatcaagggctatgcatggagtggtggtggcagggctgtgatccgggtggatgtgtctctggatgggggcctaacctggcaggtggctaagctggatggagaggaacagcgccccaggaaggcctgggcatggcgtctgtggcagttgaaagcccctgtgccagctggacaaaaggaactgaacattgtttgtaaggctgtggatgatggttacaatgtgcagccagacaccgtggccccaatctggaacctgcgaggtgttctcagcaatgcctggcatcgtgtccatgtctatgtctccccatgagcatggaaaggagccacctccacccctttccccacccattagcctcactgcttcagaaaaatctttcccacctttcaacttcttggatcacaactctggccttcctaagccatacccaagtacacatatagcacatttcacccaaggaccttccctctttggacactatgttacatacccctcttggcctttgaacctgtgccaggaagtgtgagctgttacagcaaggggctagaagtgaaaaaagtaattctggagacaagcactattttctcttcctaccccacctccatttctaatgcctactgccatcaaggccttgttttgcttttctttttggattgttcagagaaatgtgtgtggcatgtgtaagaaaagtgtatatactatcttatactacctctccaggttgccagagagttgcgaggagagcaaggggcacaaccgtctccctttatagttctacttttctaataaatagtctgtttaagatcataa

SEQ ID NO: 187309 - DNA, 2511 bp, Homo sapiens
  Payload ID: 16877
  Gene Symbol: SUOX
  Gene Name: sulfite oxidase
  Uniprot ID: P51687
  ENST ID: ENST00000550065
  CDS Start-End: 9-1646
ctgctacaatgctgctgctgcacagagctgtggtcctcaggctccaacaggcctgcagactcaagtcaatcccctcaaggatctgcattcaggcctgctccacaaatgattcatttcagccccagcgccccagcctcaccttctctggtgataactccagcacccagggatggagagtcatggggaccctattaggtctcggtgcagtgttggcctatcaggaccatcggtgtagggctgctcaggagtcaacacacatatacactaaggaggaagtgagttcccacaccagccctgagactgggatctgggtgactctgggctctgaggtctttgatgtcacagaatttgtggacctacatccaggggggccttcaaagctgatgctagcagctgggggtcccctagagcccttctgggccctctatgctgttcacaaccagtcccatgtgcgtgagttactggctcagtacaagattggggagctgaatcctgaagacaaggtagcccccaccgtggagacctctgacccttatgctgatgatcctgtacgtcacccagccctgaaggtcaacagccagcggccctttaatgcagagcctccccctgagctgctgacagaaaactacatcacacccaaccctatcttcttcacccggaaccatctgcctgtacctaacctggatccagacacctatcgcttacacgtagtaggagcacctgggggtcagtcactgtctctttccctggatgacttgcacaactttcccaggtacgagatcacagtcactctgcagtgtgccggcaaccgacgctctgagatgactcaggtcaaagaagtaaaaggtctggagtggagaacaggagccatcagcactgcacgctgggctggggcacggctctgtgatgtgttagcccaggctggccaccaactctgtgaaactgaggcccacgtctgctttgagggactggactcagaccctactgggactgcctatggagcatccatccctctggctcgggccatggaccctgaagctgaggtcctgctggcatatgagatgaatgggcagcctctgccacgtgaccacggcttccctgtgcgtgtggtggttcctggagtggtgggtgcccgccatgtcaaatggctgggcagagtgagtgtgcagccagaggaaagttacagccactggcaacggcgggattacaaaggcttctctccatctgtggactgggagactgtagattttgactctgctccatccattcaggaacttcctgtccagtcggccatcacagagccccgggatggagagactgtagaatcaggggaggtgaccatcaagggctatgcatggagtggtggtggcagggctgtgatccgggtggatgtgtctctggatgggggcctaacctggcaggtggctaagctggatggagaggaacagcgccccaggaaggcctgggcatggcgtctgtggcagttgaaagcccctgtgccagctggacaaaaggaactgaacattgtttgtaaggctgtggatgatggttacaatgtgcagccagacaccgtggccccaatctggaacctgcgaggtgttctcagcaatgcctggcatcgtgtccatgtctatgtctccccatgagcatggaaaggagccacctccacccctttccccacccattagcctcactgcttcagaaaaatctttcccacctttcaacttcttggatcacaactctggccttcctaagccatacccaagtacacatatagcacatttcacccaaggaccttccctctttggacactatgttacatacccctcttggcctttgaacctgtgccaggaagtgtgagctgagagcaaggggcacaaccgtctccctttatagttctacttttctaataaatagtctgtttaagatcataactcttgggcctggggagtgagcctattgcaggaggaaggatgcatttgtactgggatgtataatgagattagaccaaaacaaacaaaactggggaggaagacagagaggaagtaggcttgtaggttaagaagtagggcttccggctgagcacagtggctcacgcctgtaatcccagcacttgggaggccaaggcaggtggatcacttgaggtcaggagttcgagaccagcctggccaacatggcaaaacccagtctctaccaaaaatacaaaaattagctgggtgtggtggtgggtgcctgtaatcccagctacttgggaggctgaggcaggagaatcgcttgaaccaaggaggcagagttcaagcaattctgtctcagcctcccaggtagctgggacgacaggcgcacaccgccacgcccggctaatttcttttgtattttagtagagatgggtttcaccatgttgcccaggctggtctcgaactcctgagctcaggcagtacgtctgcctcggcctcccaaagtgctaggattacaggcgtgagccaccaagcccggcttttttttttttttttt

SEQ ID NO: 187310 - DNA, 1780 bp, Homo sapiens
  Payload ID: 16878
  Gene Symbol: SULT1E1
  Gene Name: sulfotransferase family 1E, estrogen-preferring, member 1
  Uniprot ID: P49888
  ENST ID: ENST00000226444
  CDS Start-End: 114-998
caaatgcagaagtggttctcatctttttttgcagcttaagatctgccttggtatttgaagagatataaactagatcaatttctttcacaggatcaactaaacagtgtaccacaatgaattctgaacttgactattatgaaaagtttgaagaagtccatgggattctaatgtataaagattttgtcaaatattgggataatgtggaagcgttccaggcaagaccagatgatcttgtcattgccacctaccctaaatctggtacaacctgggttagtgaaattgtgtatatgatctataaagagggtgatgtggaaaagtgcaaagaagatgtaatttttaatcgaatacctttcctggaatgcagaaaagaaaacctcatgaatggagtaaaacaattagatgagatgaattctcctagaattgtgaagactcatttgccacctgaacttcttcctgcctcattttgggaaaaggattgtaagataatctatctttgccggaatgcaaaggatgtggctgtttccttttattatttctttctaatggtggctggtcatccaaatcctggatcctttccagagtttgtggagaaattcatgcaaggacaggttccttatggttcctggtataaacatgtaaaatcttggtgggaaaagggaaagagtccacgtgtactatttcttttctacgaagacctgaaagaggatatcagaaaagaggtgataaaattgatacatttcctggaaaggaagccatcagaggagcttgtggacaggattatacatcatacttcgttccaagagatgaagaacaatccatccacaaattacacaacactgccagacgaaattatgaaccagaaattgtcgcccttcatgagaaagggaattacaggagactggaaaaatcactttacagtagccctgaatgaaaaatttgataaacattatgagcagcaaatgaaggaatctacactgaagtttcgaactgagatctaagaaggtctttctttacttaacatatctgatattaaagatttcttttcattattctccactttttcttattttagattgctagaaaagacataatcatggattatgttgacattttctttttaaatttttgtttaactttttttttttttttttgagacagagtctcactctgttgcctaggctggaggacagtggcacaatcatggctgattgcagccttgacctccttgactcaattgatcctcccatctcagcctcccaagtagctaggactacagacatgtgcaaccatgtttggctaatttttttaatgtttttttgtagagatgaggtcttattatattgtccaggctggtcttgaattcctgggctcaagcttcccaagtagctgcaacaacaggcacacaccaccatgctcaactaattttatttctattttttgtatagacaggggcttgctatagtgtccaggctggtctgaaacccttgagctcaagtgatcttcccacaccagcctcccaaaatactgggattacaggcttgagcctccatgcctggcccaggtaacatgtttattgagctgtacatgcatatgagaaataagaaacttttttttcctactatcatctcttaaattttgttttctttttcttttgcttcctcttcttcttttctattttttataaatatcatgcacaactataacctatgggaatgatgtagtaacacagattattcatcttgttagagttgtattaaaaataaacaagcatttcaaatta

SEQ ID NO: 187311 - DNA, 716 bp, Homo sapiens
  Payload ID: 16878
  Gene Symbol: SULT1E1
  Gene Name: sulfotransferase family 1E, estrogen-preferring, member 1
  ENST ID: ENST00000506796
  CDS Start-End: 1-383
atggttcctggtataaacatgtaaaatcttggtgggaaaagggaaagagtccacgtgtactatttcttttctacgaagacctgaaagaggatatcagaaaagaggtgataaaattgatacatttcctggaaaggaagccatcagaggagcttgtggacaggattatacatcatacttcgttccaagagatgaagaacaatccatccacaaattacacaacactgccagacgaaattatgaaccagaaattgtcgcccttcatgagaaagggaattacaggagactggaaaaatcactttacagtagccctgaatgaaaaatttgataaacattatgagcagcaaatgaaggaatctacactgaagtttcgaactgagatctaagaagacaggggcttgctatagtgtccaggctggtctgaaacccttgagctcaagtgatcttcccacaccagcctcccaaaatactgggattacaggcttgagcctccatgcctggcccaggtctaatgtcttcagggtccagtaaaagtacagcgtcataaaagacctccttctgctccctttgctgacacctaccttagcctcgtaagccagaagacttgaaaaggttctggtccacatctcagggatgacctggatcagtgaaatattggatttgatctttaacaatggggatgcagagaaatgtaaacgtgatgcaatatacaagcgagt

SEQ ID NO: 187312 - DNA, 2468 bp, Homo sapiens
  Payload ID: 16879
  Gene Symbol: SULT4A1
  Gene Name: sulfotransferase family 4A, member 1
  Uniprot ID: Q9BR01
  ENST ID: ENST00000330884
  CDS Start-End: 122-976
cggagctgccgccgcgcgccggtggggcgcgagcgtgtgcggggcgcgggcgcgggcgcgggcgcgggcgcgtgcgggctgcgagccgggaggcggcggcggcgacggcgacggcggcggcatggcggagagcgaggccgagacccccagcaccccgggggagttcgagagcaagtacttcgagttccatggcgtgcggctgccgcccttctgccgcgggaagatggaggagatcgccaacttcccggtgcggcccagcgacgtgtggatcgtcacctaccccaagtccggcaccagcttgctgcaggaggtggtctacttggtgagccagggcgctgaccccgatgagatcggcttgatgaacatcgacgagcagctcccggtcctggagtacccacagccgggcctggacatcatcaaggaactgacctctccccgcctcatcaagagccacctgccctaccgctttctgccctctgacctccacaatggagactccaaggtcatctatatggctcgcaaccccaaggatctggtggtgtcttattatcagttccaccgctctctgcggaccatgagctaccgaggcacctttcaagaattctgccggaggtttatgaatgataagctgggctacggctcctggtttgagcacgtgcaggagttctgggagcaccgcatggactcgaacgtgctttttctcaagtatgaagacatgcatcgggacctggtgacgatggtggagcagctggccagattcctgggggtgtcctgtgacaaggcccagctggaagccctgacggagcactgccaccagctggtggaccagtgctgcaacgctgaggccctgcccgtgggccggggaagagttgggctgtggaaggacatcttcaccgtctccatgaatgagaagtttgacttggtgtataaacagaagatgggaaagtgtgacctcacgtttgacttttatttataataacagaaacaacaacctgcatgctcacaatacccagacagtctactagccaaaagtcctgtatgcattcatttattccttgctggacaaactctggaagcagcgtgtgaaacagcgggggaagggaagagcggcgtgagcggagggagtgtgatgattcccaaccgaaagcagctgtctcgcctttagaacgtgcagcctctccatgtctgattacaaacagtctccacattgcagttccaatggcctggaccgtaaggataaagcctgtaatatatgcaactagaatgtctgccttttcaaccccgtattattgtattttatagagcttttcactggaaatctacataaatgtcagtaaaccaaataaaagttcatttccaaggggaatcaggagcgagccacacccgaatggtagaaagatctcagggttaactctttatttttgtagttttattatctaaggcacagccattctgttctcacttggttctgagatagtggtgagaacagaggatgagttgggtctgttggggggaatctggacacttgtttattctgacggagttcacttcttcagaaccttcctgaaatgagcagaaattgttcactaggtcttcagaatggacgtccttctgccagagacttccagcgggcggctccaaaggcccaatgcagaggagcccgcggagcatgtgctgagggaagtctgcctggtgaggctggcaggtgggagtctaatgcagtcaggagcatttgcatgcagtgggtggagagtcggccaccaaaggaccgagttgcgctcggaatttgagctgaattccacagccttactttgtttcctgaagtgatagcctactaatgctggcaagcagatgcttaatagtaaatttctaaaatccccgggtctttatcattcagtttgttctgtgcacctgaggcgctcagccgtgggaggaccattttgcgagtgtagccctgtttcactcggatcaggttggcacggccgcctgcgtgtctgtccacctcatccctccgtgtatctgagggagtaaaggtgaggtctttattgcttcactgcctaattttctcacccacattcgctgaagcgatggagagtcgggggccagtagccagccaaccccgtggggaccggggttgtctgtcatttatgtggctggaaagcacccaaagtggtggtcaggagggtcgctgctgtggaaggggtctccgttcttggtgctgtatttgaaacgggtgtagagagaagcttgtgtttttgtttgtaatggggagaagcgtggccaggcaggtggcacgtggcatcgcatggtgggctcggcagcaccttgcctgtgtttctgtgagggaggctgctttctgtgaaatttcatttatatttttctatttttagtactgtatggatgttactgagcactacacatgatccttctgtgcttgcttgcatctttaataaagacatgttcccggc

SEQ ID NO: 187313 - DNA, 2561 bp, Homo sapiens
  Payload ID: 16879
  Gene Symbol: SULT4A1
  Gene Name: sulfotransferase family 4A, member 1
  Uniprot ID: Q9BR01
  ENST ID: ENST00000422525
  CDS Start-End: 89-871
cgtgtgcggggcgcgggcgcgggcgcgggcgcgggcgcgtgcgggctgcgagccgggaggcggcggcggcgacggcgacggcggcggcatggcggagagcgaggccgagacccccagcaccccgggggagttcgagagcaagtacttcgagttccatggcgtgcggctgccgcccttctgccgcgggaagatggaggagatcgccaacttcccggtgcggcccagcgacgtgtggatcgtcacctaccccaagtccggcaccagcttgctgcaggaggtggtctacttggtgagccagggcgctgaccccgatgagatcggcttgatgaacatcgacgagcagctcccggtcctggagtacccacagccgggcctggacatcatcaaggaactgacctctccccgcctcatcaagagccacctgccctaccgctttctgccctctgacctccacaatggagactccaaggtcatctatatggctcgcaaccccaaggatctggtggtgtcttattatcagttccaccgctctctgcggaccatgagctaccgaggcacctttcaagaattctgccggaggtttatgaatgataagctgggctacggctcctggtttgagcacgtgcaggagttctgggagcaccgcatggactcgaacgtgctttttctcaagtatgaagacatgcatcgggacctggtgacgatggtggagcagctggccagattcctgggggtgtcctgtgacaaggcccagctggaagccctgacggagcactgccaccagctggtggaccagtgctgcaacgctgaggccctgcccgtgggccgggcacattgcgtctttgctcggaagatcttcttgagttggtgagaatgcagggccgagtagccagctgcattgcttagatttgattcatgtcacagcataaattgtcttgattccaaatcctaaaccaggaagagttgggctgtggaaggacatcttcaccgtctccatgaatgagaagtttgacttggtgtataaacagaagatgggaaagtgtgacctcacgtttgacttttatttataataacagaaacaacaacctgcatgctcacaatacccagacagtctactagccaaaagtcctgtatgcattcatttattccttgctggacaaactctggaagcagcgtgtgaaacagcgggggaagggaagagcggcgtgagcggagggagtgtgatgattcccaaccgaaagcagctgtctcgcctttagaacgtgcagcctctccatgtctgattacaaacagtctccacattgcagttccaatggcctggaccgtaaggataaagcctgtaatatatgcaactagaatgtctgccttttcaaccccgtattattgtattttatagagcttttcactggaaatctacataaatgtcagtaaaccaaataaaagttcatttccaaggggaatcaggagcgagccacacccgaatggtagaaagatctcagggttaactctttatttttgtagttttattatctaaggcacagccattctgttctcacttggttctgagatagtggtgagaacagaggatgagttgggtctgttggggggaatctggacacttgtttattctgacggagttcacttcttcagaaccttcctgaaatgagcagaaattgttcactaggtcttcagaatggacgtccttctgccagagacttccagcgggcggctccaaaggcccaatgcagaggagcccgcggagcatgtgctgagggaagtctgcctggtgaggctggcaggtgggagtctaatgcagtcaggagcatttgcatgcagtgggtggagagtcggccaccaaaggaccgagttgcgctcggaatttgagctgaattccacagccttactttgtttcctgaagtgatagcctactaatgctggcaagcagatgcttaatagtaaatttctaaaatccccgggtctttatcattcagtttgttctgtgcacctgaggcgctcagccgtgggaggaccattttgcgagtgtagccctgtttcactcggatcaggttggcacggccgcctgcgtgtctgtccacctcatccctccgtgtatctgagggagtaaaggtgaggtctttattgcttcactgcctaattttctcacccacattcgctgaagcgatggagagtcgggggccagtagccagccaaccccgtggggaccggggttgtctgtcatttatgtggctggaaagcacccaaagtggtggtcaggagggtcgctgctgtggaaggggtctccgttcttggtgctgtatttgaaacgggtgtagagagaagcttgtgtttttgtttgtaatggggagaagcgtggccaggcaggtggcacgtggcatcgcatggtgggctcggcagcaccttgcctgtgtttctgtgagggaggctgctttctgtgaaatttcatttatatttttctatttttagtactgtatggatgttactgagcactacacatgatccttctgtgcttgcttgcatctttaataaagacatgttcccgg

SEQ ID NO: 187314 - DNA, 2239 bp, Homo sapiens
  Payload ID: 16879
  Gene Symbol: SULT4A1
  Gene Name: sulfotransferase family 4A, member 1
  ENST ID: ENST00000432404
  CDS Start-End: 25-252
ggcggcgacggcgacggcggcggcatggcggagagcgaggccgagacccccagcaccccgggggagttcgagagcaagtacttcgagttccatggcgtgcggctgccgcccttctgccgcgggaagatggaggagatcgccaacttcccggtgcggcccagcgacgtgtggatcgtcacctaccccaagtccggaactgacctctccccgcctcatcaagagccacctgccctaccgctttctgccctctgacctccacaatggagactccaaggtcatctatatggctcgcaaccccaaggatctggtggtgtcttattatcagttccaccgctctctgcggaccatgagctaccgaggcacctttcaagaattctgccggaggtttatgaatgataagctgggctacggctcctggtttgagcacgtgcaggagttctgggagcaccgcatggactcgaacgtgctttttctcaagtatgaagacatgcatcgggacctggtgacgatggtggagcagctggccagattcctgggggtgtcctgtgacaaggcccagctggaagccctgacggagcactgccaccagctggtggaccagtgctgcaacgctgaggccctgcccgtgggccggggaagagttgggctgtggaaggacatcttcaccgtctccatgaatgagaagtttgacttggtgtataaacagaagatgggaaagtgtgacctcacgtttgacttttatttataataacagaaacaacaacctgcatgctcacaatacccagacagtctactagccaaaagtcctgtatgcattcatttattccttgctggacaaactctggaagcagcgtgtgaaacagcgggggaagggaagagcggcgtgagcggagggagtgtgatgattcccaaccgaaagcagctgtctcgcctttagaacgtgcagcctctccatgtctgattacaaacagtctccacattgcagttccaatggcctggaccgtaaggataaagcctgtaatatatgcaactagaatgtctgccttttcaaccccgtattattgtattttatagagcttttcactggaaatctacataaatgtcagtaaaccaaataaaagttcatttccaaggggaatcaggagcgagccacacccgaatggtagaaagatctcagggttaactctttatttttgtagttttattatctaaggcacagccattctgttctcacttggttctgagatagtggtgagaacagaggatgagttgggtctgttggggggaatctggacacttgtttattctgacggagttcacttcttcagaaccttcctgaaatgagcagaaattgttcactaggtcttcagaatggacgtccttctgccagagacttccagcgggcggctccaaaggcccaatgcagaggagcccgcggagcatgtgctgagggaagtctgcctggtgaggctggcaggtgggagtctaatgcagtcaggagcatttgcatgcagtgggtggagagtcggccaccaaaggaccgagttgcgctcggaatttgagctgaattccacagccttactttgtttcctgaagtgatagcctactaatgctggcaagcagatgcttaatagtaaatttctaaaatccccgggtctttatcattcagtttgttctgtgcacctgaggcgctcagccgtgggaggaccattttgcgagtgtagccctgtttcactcggatcaggttggcacggccgcctgcgtgtctgtccacctcatccctccgtgtatctgagggagtaaaggtgaggtctttattgcttcactgcctaattttctcacccacattcgctgaagcgatggagagtcgggggccagtagccagccaaccccgtggggaccggggttgtctgtcatttatgtggctggaaagcacccaaagtggtggtcaggagggtcgctgctgtggaaggggtctccgttcttggtgctgtatttgaaacgggtgtagagagaagcttgtgtttttgtttgtaatggggagaagcgtggccaggcaggtggcacgtggcatcgcatggtgggctcggcagcaccttgcctgtgtttctgtgagggaggctgctttctgtgaaatttcatttatatttttctatttttagtactgtatggatgttactgagcactacacatgatccttctgtgcttgcttgcatctttaataaagacatgttcccgg

SEQ ID NO: 187315 - DNA, 1162 bp, Homo sapiens
  Payload ID: 16880
  Gene Symbol: SULT1A1
  Gene Name: sulfotransferase family, cytosolic, 1A, phenol-preferring, member 1
  Uniprot ID: P50225
  ENST ID: ENST00000314752
  CDS Start-End: 82-969
cctgcattccccacacaacacccacaatcagccactgcgggcgaggagggcacgaggccaggttcccaagagctcaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcgtggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgtt

SEQ ID NO: 187316 - DNA, 1282 bp, Homo sapiens
  Payload ID: 16880
  Gene Symbol: SULT1A1
  Gene Name: sulfotransferase family, cytosolic, 1A, phenol-preferring, member 1
  Uniprot ID: P50225
  ENST ID: ENST00000350842
  CDS Start-End: 390-1043
ggctgctgcagcgcagtagctgctggaggctggcgaggcccggaggcggtgcaggaagcctccgaccacgcgggctcctgatcgcgggcgcccacagcgcggacatggcgggctggtggccggcgttgtcgcgcacggcccggcgccacccgtggcccaccaacgtgctgctctacgttgctcgagcaacgtagctctacgctctacgagcgtgccgtagctcgctcgtctccgccggggacgtgctgcagcaacggctgcagggccgctaggccgactggcgccagacgcggcgcgtggccacgttggtggtgaccttccacgccaacttcaactacgtgtggctgggcctgctggagcgcgcgctcccgggccgagcgccgcgcgccatgctggccaagttgctgtgcgaccaggtggtcggtgcgcccatcgcggtctcggccttctacgccggtatgagcattctccagggaaaggatgacatatttttggacctgaaacagaaattctggaacacctatatggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcgtggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgttaaaaaaataaaataaaataaaaccaatttttaaaaagagaataaaa

SEQ ID NO: 187317 - DNA, 1386 bp, Homo sapiens
  Payload ID: 16880
  Gene Symbol: SULT1A1
  Gene Name: sulfotransferase family, cytosolic, 1A, phenol-preferring, member 1
  Uniprot ID: P50225
  ENST ID: ENST00000395607
  CDS Start-End: 275-1162
tttccacatgtgaggggctgaggggctcaaggaggggagcatctccactgggtggaggctgggggtcccagcaggaagtggtgagacaaagggcgctggctggcagggagacagcacaggaaggtcctagagcttcctcagtgcagctggactctcctggagaccttcacacaccctgacatctgggccttgcccgacgagggtgctttcactggtctgcaccatggcccaggccctgggattttgaacagctccgcaggtgaatgaaaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcgtggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgttaaaaaaataaaataaaataaaaccaattttt

SEQ ID NO: 187318 - DNA, 1871 bp, Homo sapiens
  Payload ID: 16880
  Gene Symbol: SULT1A1
  Gene Name: sulfotransferase family, cytosolic, 1A, phenol-preferring, member 1
  Uniprot ID: P50225
  ENST ID: ENST00000395609
  CDS Start-End: 760-1647
cgaggcccggaggcggtgcaggaagcctccgaccacgcgggctcctgatcgcgggcgcccacagcgcggacatggcgggctggtggccggcgttgtcgcgcacggcccggcgccacccgtggcccaccaacgtgctgctctacgttgctcgagcaacgtagctctacgctctacgagcgtgccgtagctcgctcgtctccgccggggacgtgctgcagcaacggctgcagggccgctaggccgactggcgccagacgcggcgcgtggccacgttggtggtgaccttccacgccaacttcaactacgtgtggctgggcctgctggagcgcgcgctcccgggccgagcgccgcgcgccatgctggccaagttgctgtgcgaccaggtggtcggtgcgcccatcgcggtctcggccttctacgccggtatgagcattctccagggaaaggatgacatatttttggacctgaaacagaaattctggaacacctatatgcaaactcagtcgtggctttggagatcactttaagcttgtctccagctggcacactaaggagggtaatggagaagctcccccacccccaaccccaccccttccttccggaagcaaatctaagtccagccccggctccagatccctcccacagtggacctaggaaaccctcagctcagagaacaaccctgcattccccacacaacacccacaatcagccactgcgggcgaggagggcacgaggccaggttcccaagagctcaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcgtggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgttaaaaaaataaaataaaataaaaccaattttt

SEQ ID NO: 187319 - DNA, 1653 bp, Homo sapiens
  Payload ID: 16880
  Gene Symbol: SULT1A1
  Gene Name: sulfotransferase family, cytosolic, 1A, phenol-preferring, member 1
  ENST ID: ENST00000564818
  CDS Start-End: 56-226
ctacgtgtggctgggcctgctggagcgcgcgctcccgggccgagcgccgcgcgccatgctggccaagttgctgtgcgaccaggtggtcggtgcgcccatcgcggtctcggccttctacgccggtatgagcattctccagggaaaggatgacatatttttggacctgaaacagaaattctggaacacctatatgcaaactcagtcgtggctttggagatcactttaagcttgtctccagctggcacactaaggagggtaatggagaagctcccccacccccaaccccaccccttccttccggaagcaaatctaagtccagccccggctccagatccctcccacagtggacctaggaaaccctcagctcagagaacaaccctgcattccccacacaacacccacaatcagccactgcgggcgaggagggcacgaggccaggttcccaagagctcagctctggcccctagtagcagctcagttcctcaatgggccgtgtttgtcctggagcccagatggactgtggccaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcgtggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgttaaaaaaataaaataaaataaaaccaatttttaaaaagagaa

SEQ ID NO: 187320 - DNA, 615 bp, Homo sapiens
  Payload ID: 16880
  Gene Symbol: SULT1A1
  Gene Name: sulfotransferase family, cytosolic, 1A, phenol-preferring, member 1
  ENST ID: ENST00000567512
  CDS Start-End: 107-615
ggaaaccctcagctcagagaacaaccctgcattccccacacaacacccacaatcagccactgcgggcgaggagggcacgaggccaggttcccaagagctcaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccgggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggg

SEQ ID NO: 187321 - DNA, 1876 bp, Homo sapiens
  Payload ID: 16880
  Gene Symbol: SULT1A1
  Gene Name: sulfotransferase family, cytosolic, 1A, phenol-preferring, member 1
  ENST ID: ENST00000562058
  CDS Start-End: 357-527
cgaggcccggaggcggtgcaggaagcctccgaccacgcgggctcctgatcgcgggcgcccacagcgcggacatggcgggctggtggccggcgttgtcgcgcacggcccggcgccacccgtggcccaccaacgtgctgctctacgttgctcgagcaacgtagctctacgctctacgagcgtgccgtagctcgctcgtctccgccggggacgtgctgcagcaacggctgcagggccgctaggccgactggcgccagacgcggcgcgtggccacgttggtggtgaccttccacgccaacttcaactacgtgtggctgggcctgctggagcgcgcgctcccgggccgagcgccgcgcgccatgctggccaagttgctgtgcgaccaggtggtcggtgcgcccatcgcggtctcggccttctacgccggtatgagcattctccagggaaaggatgacatatttttggacctgaaacagaaattctggaacacctatatgcaaactcagtcgtggctttggagatcactttaagcttgtctccagctggcacactaaggagggtaatggagaagctcccccacccccaaccccaccccttccttccggaagcaaatctaagtccagccccggctccagatccctcccacagtggacctaggaaaccctcagctcagagaacaaccctgcattccccacacaacacccacaatcagccactgcgggcgaggagggcacgaggccaggttcccaagagctcaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcgtggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgttaaaaaaataaaataaaataaaaccaatttttaaaaa

SEQ ID NO: 187322 - DNA, 939 bp, Homo sapiens
  Payload ID: 16880
  Gene Symbol: SULT1A1
  Gene Name: sulfotransferase family, cytosolic, 1A, phenol-preferring, member 1
  ENST ID: ENST00000566189
  CDS Start-End: 96-939
acacccacaatcagccactgcgggcgaggagggcacgaggccaggttcccaagagctcagggaacgggcctggctctggcccctgacgcaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcgtggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcgg

SEQ ID NO: 187323 - DNA, 1651 bp, Homo sapiens
  Payload ID: 16880
  Gene Symbol: SULT1A1
  Gene Name: sulfotransferase family, cytosolic, 1A, phenol-preferring, member 1
  ENST ID: ENST00000563493
  CDS Start-End: 429-686
accgctcaggagctcctggaggaggcaggtgcaggtgccggctgctgcagcgcagtagctgctggaggctggcgaggcccggaggcggtgcaggaagcctccgaccacgcgggctcctgatcgcgggcgcccacagcgcggacatggcgggctggtggccggcgttgtcgcgcacggcccggcgccacccgtggcccaccaacgtgctgctctacgttgctcgagcaacgtagctctacgctctacgagcgtgccgtagctcgctcgtctccgccggggacgtgctgcagcaacggctgcagggccgctaggccgactggcgccagacgcggcgcgtggccacgttggtggtgaccttccacgccaacttcaactacgtgtggctgggcctgctggagcgcgcgctcccgggccgagcgccgcgcgccatgctggccaagttgctgtgcgaccaggtggtcggtgcgcccatcgcggtctcggccttctacgccggtatgagcattctccagggaaaggatgacatatttttggacctgaaacagaaattctggaacacctatatggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcgtggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgtt

SEQ ID NO: 187324 - DNA, 1578 bp, Homo sapiens
  Payload ID: 16880
  Gene Symbol: SULT1A1
  Gene Name: sulfotransferase family, cytosolic, 1A, phenol-preferring, member 1
  Uniprot ID: P50225
  ENST ID: ENST00000569554
  CDS Start-End: 66-953
ccactttcttgctgttgtgatggtggtaagggaacgggcctggctctggcccctgacgcaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcgtggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgttaaaaaaataaaataaaataaaaccaatttttaaaaagagaataaaatatgattgtgggccaggcagagtggctcatgcctgtaatcccagcaatttgagaagttgaggctagaggatcactggaggacaggagtttgggaccagcctgttcaacattacaagacatcatccctacaaaaatttgagaaaattatctgtacgtgatggtgggcacctgtagtcccagctacttgacaagtgaaggcaggaggatcgcctgagccagggaggttatggctgcagtgggctgactgggctaatccactcaagcctgagggacagagcaaatcttgcttgagaaataaataaaatacaatttacttaacataaattatgattcaggaccagtctggccaacatggtgaaaccccgtctctactaaaaaaaaaaaaa

SEQ ID NO: 187325 - DNA, 1090 bp, Homo sapiens
  Payload ID: 16881
  Gene Symbol: SULT1A2
  Gene Name: sulfotransferase family, cytosolic, 1A, phenol-preferring, member 2
  Uniprot ID: P50226
  ENST ID: ENST00000335715
  CDS Start-End: 118-1005
acactgacctaagaaaccctcagcacagacaacacccctgcattccccacacaacacccacactcagccactgcgggcgaggagggcacaaggccaggttcccaagagctcaggaacatggagctgatccaggacatctctcgcccgccactggagtacgtgaagggggtcccgctcatcaagtactttgcagaggcactggggcccctgcagagcttccaggcccggcctgatgacctgctcatcagcacctaccccaagtccggcaccacctgggtgagccagattctggacatgatctaccagggcggtgacctggaaaagtgtcaccgagctcccatcttcatgcgggtgcccttccttgagttcaaagtcccagggattccctcagggatggagactctgaaaaacacaccagccccacgactcctgaagacacacctgcccctggctctgctcccccagactctgttggatcagaaggtcaaggtggtctatgttgcccgcaacgcaaaggatgtggcggtttcctactaccacttctaccacatggccaaagtgtaccctcaccctgggacctgggaaagcttcctggagaagttcatggctggagaagtgtcctatgggtcctggtaccagcacgtgcaagagtggtgggagctgagccgcacccaccctgttctctacctcttctatgaagacatgaaggagaaccccaaaagggagattcaaaagatcctggagtttgtggggcgctccctgccagaggagactgtggacctcatggttgagcacacgtcgttcaaggagatgaagaagaaccctatgaccaactacaccaccgtccgccgggagttcatggaccacagcatctcccccttcatgaggaaaggcatggctggggactggaagaccaccttcaccgtggcgcagaatgagcgcttcgatgcggactatgcgaagaagatggcaggctgcagcctcagcttccgctctgagctgtgagaggggttcctggagtcactgcagagggagtgtgcgaatcaagcctgaccaagaggctccagaataaagtatgatttgtgttcaa

SEQ ID NO: 187326 - DNA, 1322 bp, Homo sapiens
  Payload ID: 16881
  Gene Symbol: SULT1A2
  Gene Name: sulfotransferase family, cytosolic, 1A, phenol-preferring, member 2
  Uniprot ID: P50226
  ENST ID: ENST00000395630
  CDS Start-End: 352-1239
gtttgtcctggagcccagatggactgtggccgggcaagtggatcacaggcctggccagcctaggagttgccacatgtgaggggccgaggggctcaaggaggggaacatcggggagaggagcctactgggtggaggctgggggtcccagcaggaaatggtgagacaaagggcgctggctggcaggaagacagcacaggaaggtcctagaggttcctcagtgcagctggactctcctggagaccttcacacaccctgacatctgggccccgcgccacgagggtgctttcactggtctgcaccatggcccaggccctgggattttgaacagctccgcaggtgaatgaaaggaacatggagctgatccaggacatctctcgcccgccactggagtacgtgaagggggtcccgctcatcaagtactttgcagaggcactggggcccctgcagagcttccaggcccggcctgatgacctgctcatcagcacctaccccaagtccggcaccacctgggtgagccagattctggacatgatctaccagggcggtgacctggaaaagtgtcaccgagctcccatcttcatgcgggtgcccttccttgagttcaaagtcccagggattccctcagggatggagactctgaaaaacacaccagccccacgactcctgaagacacacctgcccctggctctgctcccccagactctgttggatcagaaggtcaaggtggtctatgttgcccgcaacgcaaaggatgtggcggtttcctactaccacttctaccacatggccaaagtgtaccctcaccctgggacctgggaaagcttcctggagaagttcatggctggagaagtgtcctatgggtcctggtaccagcacgtgcaagagtggtgggagctgagccgcacccaccctgttctctacctcttctatgaagacatgaaggagaaccccaaaagggagattcaaaagatcctggagtttgtggggcgctccctgccagaggagactgtggacctcatggttgagcacacgtcgttcaaggagatgaagaagaaccctatgaccaactacaccaccgtccgccgggagttcatggaccacagcatctcccccttcatgaggaaaggcatggctggggactggaagaccaccttcaccgtggcgcagaatgagcgcttcgatgcggactatgcgaagaagatggcaggctgcagcctcagcttccgctctgagctgtgagaggggttcctggagtcactgcagagggagtgtgcgaatcaagcctgaccaagaggctccagaataaagtatgatttgtgttc

SEQ ID NO: 187327 - DNA, 1540 bp, Homo sapiens
  Payload ID: 16881
  Gene Symbol: SULT1A2
  Gene Name: sulfotransferase family, cytosolic, 1A, phenol-preferring, member 2
  ENST ID: ENST00000534108
  CDS Start-End: 445-1110
atcggggagaggagcctactgggtggaggctgggggtcccagcaggaaatggtgagacaaagggcgctggctggcaggaagacagcacaggaaggtcctagaggttcctcagtgcagctggactctcctggagaccttcacacaccctgacatctgggccccgcgccacgagggtgctttcactggtctgcaccatggcccaggccctgggattttgaacagctccgcaggtgaatgaaaggtgaggccaggctggggaaccaccacattagagcccgacctggttttcagccccagccccgccactgactggccttgtgagtgcgggcaagtcactcagcctccctaggcctcagtgacttccctgaaagcaagaattccactttcttgctgttgtgatggtggtaagggaacgggcctggctctggcccctgacgcaggaacatggagctgatccaggacatctctcgcccgccactggagtacgtgaagggggtcccgctcatcaagtactttgcagaggcactggggcccctgcagagcttccaggcccggcctgatgacctgctcatcagcacctaccccaagtccggcaccacctgggtgagccagattctggacatgatctaccagggcggtgacctggaaaagtgtcaccgagctcccatcttcatgcgggtgcccttccttgagttcaaagtcccagggattccctcaggtgtgtgtgtcctgggtgcaaggggagtggaggaagacagggctggggcttcagctcaccagaccttccctgacccactgctcagggatggagactctgaaaaacacaccagccccacgactcctgaagacacacctgcccctggctctgctcccccagactctgttggatcagaaggtcaaggtggtctatgttgcccgcaacgcaaaggatgtggcggtttcctactaccacttctaccacatggccaaagtgtaccctcaccctgggacctgggaaagcttcctggagaagttcatggctggagaagtgtcctatgggtcctggtaccagcacgtgcaagagtggtgggagctgagccgcacccaccctgttctctacctcttctatgaagacatgaaggagcaatccaagcctccactgaggagccctctgctgctcagaaccccaaaagggagattcaaaagatcctggagtttgtggggcgctccctgccagaggagactgtggacctcatggttgagcacacgtcgttcaaggagatgaagaagaaccctatgaccaactacaccaccgtccgccgggagttcatggaccacagcatctcccccttcatgaggaaaggcatggctggggactggaagaccaccttcaccgtggcgcagaatgagcgcttcgatgcggactatgcgaagaagatggcaggctgcagcctcagcttccgctctgagctgtgagaggggttcctggagtcactgcagagggagtgtgcgaatcaagcctgaccaagaggctccagaataaagtatgatttgtgttcaa

SEQ ID NO: 187328 - DNA, 1991 bp, Homo sapiens
  Payload ID: 16881
  Gene Symbol: SULT1A2
  Gene Name: sulfotransferase family, cytosolic, 1A, phenol-preferring, member 2
  ENST ID: ENST00000533150
  CDS Start-End: 1118-1906
ctcagccactgcgggcgaggagggcacaaggccaggttcccaagagctcaggtgagtgacacaccggaatggcccaggacgccctcaccctgctcagcttgtggctccaacattccagaagccgaggcctctgctatccctgccctctccccatggatatcccatttcagacaaccccggccggcctgaatccccctcccttccttttttttttttccggggaggccaggtcttgctgtcaccgaggctggagtgctgtgggatcctggccactgcagccttgaattcctgggctcaagtgattctcctgcctcagtagctaggactacagaccctcaccatcctgcctggatagttttaaaaaatatttttaaaagatttttagagatggggtcttccaatgctgcccagattggtctccaaattctggcctcagcctccctagggtctgggattacaggtgggagccaccctgcccaggatcctccttttgctgagtcatcacagttttgctcattcccacatcaggctctggcccccaataccagctcagttgctcaatgggctgtttgtcctggagcccagatggactgtggccgggcaagtggatcacaggcctggccagcctaggagttgccacatgtgaggggccgaggggctcaaggaggggaacatcggggagaggagcctactgggtggaggctgggggtcccagcaggaaatggtgagacaaagggcgctggctggcaggaagacagcacaggaaggtcctagaggttcctcagtgcagctggactctcctggagaccttcacacaccctgacatctgggccccgcgccacgagggtgctttcactggtctgcaccatggcccaggccctgggattttgaacagctccgcaggtgaatgaaaggtgaggccaggctggggaaccaccacattagagcccgacctggttttcagccccagccccgccactgactggccttgtgagtgcgggcaagtcactcagcctccctaggcctcagtgacttccctgaaagcaagaattccactttcttgctgttgtgatggtggtaagggaacgggcctggctctggcccctgacgcaggaacatggagctgatccaggacatctctcgcccgccactggagtacgtgaagggggtcccgctcatcaagtactttgcagaggcactggggcccctgcagagcttccaggcccggcctgatgacctgctcatcagcacctaccccaagtccggcaccacctgggtgagccagattctggacatgatctaccagggcggtgacctggaaaagtgtcaccgagctcccatcttcatgcgggtgcccttccttgagttcaaagtcccagggattccctcaggtgtgtgtgtcctgggtgcaaggggagtggaggaagacagggctggggcttcagctcaccagaccttccctgacccactgctcagggatggagactctgaaaaacacaccagccccacgactcctgaagacacacctgcccctggctctgctcccccagactctgttggatcagaaggtcaagcaatccaagcctccactgaggagccctctgctgctcagaaccccaaaagggagattcaaaagatcctggagtttgtggggcgctccctgccagaggagactgtggacctcatggttgagcacacgtcgttcaaggagatgaagaagaaccctatgaccaactacaccaccgtccgccgggagttcatggaccacagcatctcccccttcatgaggaaaggcatggctggggactggaagaccaccttcaccgtggcgcagaatgagcgcttcgatgcggactatgcgaagaagatggcaggctgcagcctcagcttccgctctgagctgtgagaggggttcctggagtcactgcagagggagtgtgcgaatcaagcctgaccaagaggctccagaataaagtatgatttgtgttcaa

SEQ ID NO: 187329 - DNA, 773 bp, Homo sapiens
  Payload ID: 16881
  Gene Symbol: SULT1A2
  Gene Name: sulfotransferase family, cytosolic, 1A, phenol-preferring, member 2
  ENST ID: ENST00000526384
  CDS Start-End: 198-773
agacagcacaggaaggtcctagaggttcctcagtgcagctggactctcctggagaccttcacacaccctgacatctgggccccgcgccacgagggtgctttcactggtctgcaccatggcccaggccctgggattttgaacagctccgcaggtgaatgaaagggaacgggcctggctctggcccctgacgcaggaacatggagctgatccaggacatctctcgcccgccactggagtacgtgaagggggtcccgctcatcaagtactttgcagaggcactggggcccctgcagagcttccaggcccggcctgatgacctgctcatcagcacctaccccaagtccggcaccacctgggtgagccagattctggacatgatctaccagggcggtgacctggaaaagtgtcaccgagctcccatcttcatgcgggtgcccttccttgagttcaaagtcccagggattccctcagggatggagactctgaaaaacacaccagccccacgactcctgaagacacacctgcccctggctctgctcccccagactctgttggatcagaaggtcaaggtggtctatgttgcccgcaacgcaaaggatgtggcggtttcctactaccacttctaccacatggccaaagtgtaccctcaccctgggacctgggaaagcttcctggagaagttcatggctggagaagtgtcctatgggtcctggtaccagcacgtgcaagagtggtgggagctgagccgcacccaccctgttctctacctcttc

SEQ ID NO: 187330 - DNA, 1097 bp, Homo sapiens
  Payload ID: 16882
  Gene Symbol: SULT1A3
  Gene Name: sulfotransferase family, cytosolic, 1A, phenol-preferring, member 3
  Uniprot ID: P0DMM9
  ENST ID: ENST00000338971
  CDS Start-End: 102-989
accctcagggcagagagcagccctacactccctacaccacacccatactcagcccctgcaggcaaggagagaacaggtcaggttcccgagagctcaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaa

SEQ ID NO: 187331 - DNA, 1326 bp, Homo sapiens
  Payload ID: 16882
  Gene Symbol: SULT1A3
  Gene Name: sulfotransferase family, cytosolic, 1A, phenol-preferring, member 3
  Uniprot ID: P0DMM9
  ENST ID: ENST00000395138
  CDS Start-End: 49-936
caatgggctgtgtttgttctggagcccagatggactgtggccaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaattaaaataaaa

SEQ ID NO: 187332 - DNA, 906 bp, Homo sapiens
  Payload ID: 16882
  Gene Symbol: SULT1A3
  Gene Name: sulfotransferase family, cytosolic, 1A, phenol-preferring, member 3
  Uniprot ID: P0DMM9
  ENST ID: ENST00000563322
  CDS Start-End: 1-906
atggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggaggagccctctgctgctcagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtga

SEQ ID NO: 187333 - DNA, 405 bp, Homo sapiens
  Payload ID: 16882
  Gene Symbol: SULT1A3
  Gene Name: sulfotransferase family, cytosolic, 1A, phenol-preferring, member 3
  ENST ID: ENST00000569485
  CDS Start-End: 1-405
ctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggaggagctcatggaccacagcatctcccccttcatgag

SEQ ID NO: 187334 - DNA, 858 bp, Homo sapiens
  Payload ID: 16882
  Gene Symbol: SULT1A3
  Gene Name: sulfotransferase family, cytosolic, 1A, phenol-preferring, member 3
  ENST ID: ENST00000563638
  CDS Start-End: 1-152
tgcccttccttgaggtcaatgatccaggggaaccctcagggctggagactctgaaagacacaccgcccccacggctcatcaagtcacacctgcccctggctctgctccctcagactctgttggatcagaaggtcaagagcgcaatcgtgtgatctcggttcactgcaaccaccgcctcctgggttcaagcaattctcctgcttcagcctcccaaggagctgggattacaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatccc

SEQ ID NO: 187335 - DNA, 1390 bp, Homo sapiens
  Payload ID: 16883
  Gene Symbol: SULT1A4
  Gene Name: sulfotransferase family, cytosolic, 1A, phenol-preferring, member 4
  Uniprot ID: P0DMN0
  ENST ID: ENST00000360423
  CDS Start-End: 102-989
accctcagggcagagagcagccctacactccctacaccacacccatactcagcccctgcaggcaaggagagaacaggtcaggttcccgagagctcaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaaaataaaatatgatttgtgttca

SEQ ID NO: 187336 - DNA, 740 bp, Homo sapiens
  Payload ID: 16883
  Gene Symbol: SULT1A4
  Gene Name: sulfotransferase family, cytosolic, 1A, phenol-preferring, member 4
  ENST ID: ENST00000569544
  CDS Start-End: 5-268
gaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccc

SEQ ID NO: 187337 - DNA, 906 bp, Homo sapiens; identical to SEQ ID NO: 187332
  Payload ID: 16883
  Gene Symbol: SULT1A4
  Gene Name: sulfotransferase family, cytosolic, 1A, phenol-preferring, member 4
  ENST ID: ENST00000565290
  CDS Start-End: 1-906

SEQ ID NO: 187338 - DNA, 858 bp, Homo sapiens; identical to SEQ ID NO: 187334
  Payload ID: 16883
  Gene Symbol: SULT1A4
  Gene Name: sulfotransferase family, cytosolic, 1A, phenol-preferring, member 4
  ENST ID: ENST00000563944
  CDS Start-End: 1-152

SEQ ID NO: 187339 - DNA, 7115 bp, Homo sapiens
  Payload ID: 16884
  Gene Symbol: SULT1B1
  Gene Name: sulfotransferase family, cytosolic, 1B, member 1
  Uniprot ID: O43704
  ENST ID: ENST00000310613
  CDS Start-End: 299-1189
ggaacttgcctcatgtgtgtgtatgtgtgtgtgtgtgattgtgggtgtgggtagtttaacctttttatatcttagctgcctgtaaactcagtgattgctacgttcagatcaaaccttgaacttttttttttctggtgccaggagccttcctgtgctccccattgcctgccagaaccaccaccgtttcccatggttactctacagcagcttcactgcctgaaaatgaaaactgaacaaagggattaaattgtgagaacaactgtcaatctattatatatttgtacaatctggtattaaaatgctttccccaaaagatattctgcgaaaagatctgaagttggtccatggttatcccatgacctgtgcttttgcaagcaactgggaaaaaattgaacagttccatagcagaccagatgacattgtgatagccacttatcctaaatcaggtactacttgggttagtgaaattatagacatgattctaaatgatggagatattgaaaaatgtaagcgaggttttattactgaaaaagttccaatgttggaaatgactctccctggattaagaacatcaggtatagaacaattggagaagaatccatcaccccggattgtgaaaacacatctaccgactgatcttcttcctaaatctttctgggaaaacaattgcaagatgatttatctggctcgtaatgccaaggatgtttcagtctcatattaccattttgacttaatgaataatttacagccttttcctggtacctgggaagaatatctggagaaattcttaactggaaaagtggcctatggttcctggtttactcatgttaaaaactggtggaagaaaaaggaagaacacccaatactttttttgtactatgaagatatgaaagagaatccaaaggaggaaatcaagaagatcattagatttctagagaagaacctgaatgatgagatcttggataggatcatccatcacacctcatttgaagtgatgaaggacaatcctttggtaaattatacacatctaccaactacagtgatggatcatagcaaatccccttttatgcgtaaagggacggctggtgactggaagaattacttcaccgtggcccaaaatgagaaatttgatgctatttatgagacagaaatgtccaaaactgcacttcaattccgcacagagatttaaagtgtctaaatcacacatctgaagaaataagagattgtctgtagttgattgaaacgagggcagttatgaattgatttgggcaatcaaatgaatttataaaggagaataatatgcttttaatatgttgattcttttcaatgttattaatcagatcccagttttgttcctttgattctgagtttccaaattctctaaggctaaagttcattgttaactttttgtaacaaaggaacaatgtaaccacaggctcttcctgcctttttctacactagtactgataagaaagaagggatttattttacttaatctcccatatattatgatttagaattaagttcccctccctagtaccatggtccaagaaatgctgttttcataatgagactatatttcctaactctgccccaatttccctttgccgaaaatttgacccaggacactgtgttccactgctgtctaccgagtttcaagttgttctctgagtcatagctcatcttcctgcagtgcctctatttggataacaaagttcatgtccccgatcatgtagttcagattttggaaatcttttttctatatcatacctaatgtctaagtctccgaaaggcaaacgcctacaatagtctctgtaggattggttacctgggaactggagctctgttctgaaaagcagccctgagggctgtgacctacttcttatggggagtcctctttttcccaacagacccgtttgaacttcagagaaatcacctactgctgtgttctggtcaccatttgggaacttcagttacttaatcttatatttggatagatttggataccttaatagcacctttaatatcctagacatgatcataacctctgcaaaatatttcccaatctggtgcccaaggaagactctctaggctgaatctccactctgccctcttgacccaatgttccttctacttattattacatgcttatatctatttgtgtggtctctgatctatgttttcttggaacatttatatatatatatatatatatatatatatatatatatatatatatatatgtacattttattattatactttaagttccaggttacatgtgcacaatgtgcaggtttgttatatatgcatacatgtgccatgttggtgtgctgcatccattaactcgtcatttacattaggtatacctcctaatgctatccttcccccctccctccaccccacaacaggccccagtgtgtgatgttacctttcctgtgtccaagtgttctcatcgttcaattcccaccaatgactaagaacatgaggtgtttggtttttttgttcttgcaatagtttgctgaaaagtatggtttccagctttatccatgtccctacaaaggacatgaactcatcattttttatggctgcacagtattctatggtgtatatgtgccacattttcttaatccagtctatcattgatggacatttgggttggttccaagtctttgctattgtgaatagtgccgcaataaatatacgtgtgcatgtgtctttatagcagcatgatttataatcctttgggtatatacccagtaatgggatggctgggtcaaatggtatttctagttctagatctctgaggaattgccacactgtcttccacaatggttgaactagtttacactcccaccaaaagtgtaaaagtgttcctatttctccacatcctttccagcacctgttgtttcctgactttttaatgattgccattctaactggtgtgagatggtatctcattgtggttttgatttgcatttccctgatggccagtgatgatgagcattttttcatgtgtctgttggctgcataaatgtcttcttttgagaagtatctgttcatattctttgcacacttgttgatggggttgttttttttttcttgtaaatttgtttgagttctttgtagattctggatattagccctttgtcagatgagtagattgcaaaaattttctcccattctgtaggttgcctgttcacgctgatggtagtttcttttgctgtgcagaagctctttagtttaattagatcccatttgtcaattttggcttttgttgccattgcttttggtgttttagacatgaagtccttgcccatgcctatgtcctgaatgatattgcctaggttttcttctagggtttttatggttttaggtcttacatttaagtctttaatccatcttgaattaatttttgtataaggtgtaaggaagggatccaggttctgctttctacatatggctagccagttttcccagcaccatttattaaatagggaatcctttccccattgcttgttttcgtcaggtttgtcaaagatcagataattgtagatgtgtagtattatttctgagggctctgttctgttccattggtctatatctctgttttggtccagtaccatgctgttttggttactgtagccttgtagtatagtttgaagtcaggtagtatgatgcttccagctttgctcttttggcttaggattgacttggcaatgcgggctcttttttggtttcttatgaactttaaagtagttttttccaattctgtgaagaaagtcattggtagcttaatggggatggcattgaatctataaatgaccttgggcagtatggccattttcatgatattgattcttcctatccatgagcatggaatgttcttctatttgtttgtatcctcttttatttcattgagcagtggtttgtagttctccttgaagtgatccttcacatcccttgtaagttggattcctaggtattttattctctttgaagcaattgtgaatgggagttcactcctgatttggctctctgtctgttattggtgtataagaatgcttgtgatttttgtacattgattttgtatcctgagactttgctgaagttgcttatcagcttaaggagattttgggctgagacaatggggttttctacatatacaatcatgtcatctgcaaacagggacaatttgacttcctcttctcctaattgaataccctttatttctttctcctgcctgattgccctggccagaacttccaacactatgttgaataggagtggtgagagacggcatccctgtcttgtgccagttttcaaagggaatgcttccaggttttgcccatgcagtatgatattggctggtggtttgtcatagagggctctccttattttgagatacattccatcaatacctaatttattgagagtttttagcatgaaggctgttgaattttgtcaaaggccttttctgcatctattgagataatcatgtggtttttgtctttggttctgtttatatgctggattacatttattgatttgcatatgttgaaccagccttgaatcccagggatgaagcccacttgatcatggtggataagctttttgatgtgctgctggattcggtttgccagtattttattgaggatttttgcatcaatgttcatcagggttattggtctaaaattctctttttttgttgtgtctctgccaggctttggtatcaggatgatgctggcctcataaaatgagttagggaggattccctccttttctgttcattggaatagtttcagaaggaatggtaccagctcctccttggacctctggtagaattcagctgtgaatctatctggtcctggacttcttttggttggtaagctattaattattgcctctatttcagagcatgttatttttctattcagagattcaacttcttcctggtttattcttgggagggtgtatgtgtcgaggaatttatccatttcttctagattttctagtttatttgcgtagaggtgtttttagtattctctgacggtagtttgtatttctgtgggatcatcggtggtgatatcccctttatctttttttattgcatctatttgattcttctctcttttcttctttattagtcttgctggtggtctatcaattttgttgatcttttcgaaaaaccagctcctgaattcactgattttttgaaggggtttttgtgtctttgtctccttcagttatgctctgatcttaactccagcttggcattagaagtagttgtttatatccccatgtgcagcaaagtctttttcctgagatcatatcacatgtgccaagttatatgccaagccatggttctcaagctgaaggtacagtaccctgggcccttacttgttctgaaaggggtgggggtggtggttttggacatactgttagactttctgagccacaactgaggtagctatggcttatcgtattttgacttcacaggtgaatctccgctgtcagccaggaatagccaggaatagctaaaatagctccttaagctgtaacatttctcttttccaaccccagcaaaggattggtctagtggtaacaacaaacctcatagaagtagtacacctattattctggagatacttgcttctatagatttattacaatatgttttataaagtattttagagtatataatttgtgtttatgttccacagaaacatattttataggagttaatcttgactatctaaaggtattgtgaactagttccagctttctccaatacccttgtccacgagaagtaaactaaatcatgtatctatttcctctattatctttattaaataataagttaatgtggcctgaatatatacggatttctgatactatggtctattactgagggaaaaaacaccactaaactatcctctaatctgtgtaatagattagctacactttcttcactagcaagataaaataatttccacattttctagttttactttgtagaaataactctctgtaattggactgtattcaacgaaaacttagtaagttgtaattatgcctcaggtatgtttctatgcactgagtgaagagtggagataaaaatagaatttagattttcctttactttttaaataggttgttgcctcttatatatttattctatgatgcaaatgtcactatcctaattcctcagtttatgtttaacagcacacagtggcacttctatgattcaaatacatttgataccctttgaaatcaatcagaatactgcaaaattaatttttctaaaacaatgcttttatcgttatttctcctgttgaatcatcagtacaatttccaaatgaaaacacttaaaataatctcatattacaatctttctctaacagaaccatgatgtaaggacagtgataacaaatatctgacaatgatatgattatttcctcatccatggaaattttccttaataaactaaagggctattttctaaaaagccaaagcattgcttacaagaacttttcatcatgacatggatagacactcagattcatacattcaaagggaagtgtcatgtattccctttcaatccaccctattctattgtgttatcttcctaaattattttctatctacattcttcattctctttcccattgaccctatgttctgtgtgataaaaattgcgtcattggaggcttttgaaggttaagtattatgccccatttcaccattaatcaacatacaacccttctccatattttgtaattcctttcatatacagaaaaaaagatactataatttcttcaaaatgcttgatattaatgatatatgggaaaacaattattttgtgcagcaatcttcagataactgggaaaggccggggaaaaagagagatactggtggttatcaatgacccatgtataaattgtttttattatgtaagctgtcttcacaaatgtcttcttatgtatgatcattagaactgttttatatatatatgtaaaatttccacattatcgagacattactttcagcagtgaagtaatccttttttaactgccacttaatgaattcaataaaatataatttattgtattttg

SEQ ID NO: 187340 - DNA, 694 bp, Homo sapiens
  Payload ID: 16884
  Gene Symbol: SULT1B1
  Gene Name: sulfotransferase family, cytosolic, 1B, member 1
  ENST ID: ENST00000510821
  CDS Start-End: 228-694
cttgaacttttttttttctggtgccaggagccttcctgtgctccccattgcctgccagaaccaccaccgtttcccatggttactctacagcagcttcactgcctgaaaatgaaaactgaacaaagggattaaattgtgagtggaactgaagcatgcaaggaatggaggtcttctcaagaaactaacaactgtcaatctattatatatttgtacaatctggtattaaaatgctttccccaaaagatattctgcgaaaagatctgaagttggtccatggttatcccatgacctgtgcttttgcaagcaactgggaaaaaattgaacagttccatagcagaccagatgacattgtgatagccacttatcctaaatcaggtactacttgggttagtgaaattatagacatgattctaaatgatggagatattgaaaaatgtaagcgaggttttattactgaaaaagttccaatgttggaaatgactctccctggattaagaacatcaggtatagaacaattggagaagaatccatcaccccggattgtgaaaacacatctaccgactgatcttcttcctaaatctttctgggaaaacaattgcaagatgatttatctggctcgtaatgccaaggatgtttcagtctcatattaccattttgacttaatgaataatttacagccttttcctggtacctg

SEQ ID NO: 187341 - DNA, 572 bp, Homo sapiens
  Payload ID: 16884
  Gene Symbol: SULT1B1
  Gene Name: sulfotransferase family, cytosolic, 1B, member 1
  ENST ID: ENST00000512870
  CDS Start-End: 353-572
actagttgagatacaaatccttctatccaagattcactattgaggactaaaaattattgatacacaaaacaacttgaatggatatcaacggaattaccctgaatgaaaaaaaaagctaatctcaaaaggagaaccctttatcctaagagagcagagggatgaagatccatcttctgtaactttttctgctgaataaaggagccttcctgtgctccccattgcctgccagaaccaccaccgtttcccatggttactctacagcagcttcactgcctgaaaatgaaaactgaacaaagggattaaattgtgagatattctgcgaaaagatctgaagttggtccatggttatcccatgacctgtgcttttgcaagcaactgggaaaaaattgaacagttccatagcagaccagatgacattgtgatagccacttatcctaaatcaggtactacttgggttagtgaaattatagacatgattctaaatgatggagatattgaaaaatgtaagcgaggttttattactgaaaaagttccaatgttggaaatgactctccctggattaagaacatcag

SEQ ID NO: 187342 - DNA, 2795 bp, Homo sapiens
  Payload ID: 16885
  Gene Symbol: SULT1C2
  Gene Name: sulfotransferase family, cytosolic, 1C, member 2
  Uniprot ID: O00338
  ENST ID: ENST00000251481
  CDS Start-End: 454-1344
agcttcgaggccagtgggaggagggaggggccaggcagctgagggccaggaaagatgtgaaaaactctagctggtgaccgagaggaggagtagagtgtgcccttagttcatatgaactagagggagttggtatttgcacagcagtcagggtcacatgagtgatcatggtacagtgagaagttctccctcccagggccaggtcacagggtttgtttctgttcaatccggattcttccagtaaaagcttcaacttcccacactgaagctgagagcctcccaaagtgctggctacctgctgagcgcccccgtaactctgacacagtagtaatttgagcctctgcaattgccgtctgcttcctgtgaaagtcctttccgtgcccactgacccttgagtgggcctttgagctgctgactttcagctggaacttgaagggaccccaaccctgagacactatggccctgacctcagacctggggaaacagataaaactgaaagaggtggaggggaccctcctgcagcctgcaactgtggacaactggagccagatccagagcttcgaggccaaaccagatgatctcctcatctgcacctaccctaaagcagggacaacgtggattcaggaaattgtggatatgattgaacagaatggggacgtggagaagtgccagcgagccatcatccaacaccgccatcctttcattgagtgggctcggccaccccaaccttctggtgtggaaaaagccaaagcaatgccctctccacggatactaaagactcacctttccactcagctgctgccaccgtctttctgggaaaacaactgcaagttcctttatgtagctcgaaatgccaaagactgtatggtttcctactaccatttccaaaggatgaaccacatgcttcctgaccctggtacctgggaagagtattttgaaaccttcatcaatggaaaagtggtttggggttcctggtttgaccacgtgaaaggatggtgggagatgaaagacagacaccagattctcttcctcttctatgaggacataaagagggacccaaagcatgaaattcggaaggtgatgcagttcatgggaaagaaggtggatgaaacagtgctagataaaattgtccaggagacgtcatttgagaaaatgaaagaaaatcccatgacaaatcgttctacagtttccaaatctatcttggaccagtcaatttcctccttcatgagaaaaggaactgtgggggattggaaaaaccacttcactgttgcccagaatgagaggtttgatgaaatctatagaagaaagatggaaggaacctccataaacttctgcatggaactctgagcaagatgtaaataaaattaaaaggtggatggcaagagtgcaaatactatcttcaatccttcagtcccagccagaagaatctctgaaagcatattgtgaatgtatacaatgtagtacaaacaatctctgtgatgattaacagtatgtcaccacttcattttttaaaaaggatcacgtctaatgcccattttcccaactattctttccaaagtaagatataaggtagcttaataaactaagtaaaacgtatgacttgagtacaaaaggattgttttaatccccattattctggaaagtgcatcctagtctcccagtctataacatcataataccttgagtataagtccaaatattaggttatatctatattaaaaacaaaatttctgtcatctgtcctggccattcaggcaactccagcctgggctcaatcctggagttctgtctggtcactatcagaaggaacactttgagggaaaccctggtgcagccagccctgaggaaacatggcctgagtgccctcactggtgggtgggaataaaatggaagtgcacagaggagatgtcagaagaccaaaacttggtgaatagtcccagtgctaggtcatataggaaacagaaagcatgacagtggccttttgggaacccaagttacgtcctggtgaaagcagaaaggaggagacaggatggctgtcaacaacgtcagcatgggcatggctcccaggcatggaggtaattgggtcttggcttcaatgccacccttttgggaagccctaaaccaagtgaggtgttcttttcccttgcttcccatatttgtcccagttgcagccctgttgttatgtatttactcttcaatttcttatttatacctctcactcaattgttaattctttgggttcagtctcatgccatatttactcctagtacctaatgcagtgcctggcacacagcaagtgcccttgagaacttgtagagggagtaaaaaagtgcatggataaatgactgcagcaaatcacaaattttgaactttgacccttttcttttagtcccaaatagtggcattccatagctgagggtagtaggagcagttcaccctgggagcagacaataagaggaagaatgaagccaactaaaattctgaatgctttttgttggatttcgtagggtattttttttaaaatagggtcttgctatgttgcccaggctggtcttaactgactgctttttattattaccatgcactggcaattccaaacaatgtcagtgttaaaatgcttctccctgaaaaagagaaaaaaaaaaggaaaaaaagaaaagaaaagtgaaaagaaaaactcttattggcctaagttctaaataatagctaggttaccactgagttttaactatatgtatatgagcttcaaataagcacctttttattatgtaaataaataaaagttatctgtatcccca

SEQ ID NO: 187343 - DNA, 2828 bp, Homo sapiens
  Payload ID: 16885
  Gene Symbol: SULT1C2
  Gene Name: sulfotransferase family, cytosolic, 1C, member 2
  Uniprot ID: O00338
  ENST ID: ENST00000326853
  CDS Start-End: 454-1377
agcttcgaggccagtgggaggagggaggggccaggcagctgagggccaggaaagatgtgaaaaactctagctggtgaccgagaggaggagtagagtgtgcccttagttcatatgaactagagggagttggtatttgcacagcagtcagggtcacatgagtgatcatggtacagtgagaagttctccctcccagggccaggtcacagggtttgtttctgttcaatccggattcttccagtaaaagcttcaacttcccacactgaagctgagagcctcccaaagtgctggctacctgctgagcgcccccgtaactctgacacagtagtaatttgagcctctgcaattgccgtctgcttcctgtgaaagtcctttccgtgcccactgacccttgagtgggcctttgagctgctgactttcagctggaacttgaagggaccccaaccctgagacactatggccctgacctcagacctggggaaacagataaaactgaaagaggtggaggggaccctcctgcagcctgcaactgtggacaactggagccagatccagagcttcgaggccaaaccagatgatctcctcatctgcacctaccctaaagcagggacaacgtggattcaggaaattgtggatatgattgaacagaatggggacgtggagaagtgccagcgagccatcatccaacaccgccatcctttcattgagtgggctcggccaccccaaccttctgagacaggatttcaccatgttgcccaggctggtctcaaactcctgagctcaagcaatccacctgcctcaacctcccaaagtgccaagattacagacctgctgccaccgtctttctgggaaaacaactgcaagttcctttatgtagctcgaaatgccaaagactgtatggtttcctactaccatttccaaaggatgaaccacatgcttcctgaccctggtacctgggaagagtattttgaaaccttcatcaatggaaaagtggtttggggttcctggtttgaccacgtgaaaggatggtgggagatgaaagacagacaccagattctcttcctcttctatgaggacataaagagggacccaaagcatgaaattcggaaggtgatgcagttcatgggaaagaaggtggatgaaacagtgctagataaaattgtccaggagacgtcatttgagaaaatgaaagaaaatcccatgacaaatcgttctacagtttccaaatctatcttggaccagtcaatttcctccttcatgagaaaaggaactgtgggggattggaaaaaccacttcactgttgcccagaatgagaggtttgatgaaatctatagaagaaagatggaaggaacctccataaacttctgcatggaactctgagcaagatgtaaataaaattaaaaggtggatggcaagagtgcaaatactatcttcaatccttcagtcccagccagaagaatctctgaaagcatattgtgaatgtatacaatgtagtacaaacaatctctgtgatgattaacagtatgtcaccacttcattttttaaaaaggatcacgtctaatgcccattttcccaactattctttccaaagtaagatataaggtagcttaataaactaagtaaaacgtatgacttgagtacaaaaggattgttttaatccccattattctggaaagtgcatcctagtctcccagtctataacatcataataccttgagtataagtccaaatattaggttatatctatattaaaaacaaaatttctgtcatctgtcctggccattcaggcaactccagcctgggctcaatcctggagttctgtctggtcactatcagaaggaacactttgagggaaaccctggtgcagccagccctgaggaaacatggcctgagtgccctcactggtgggtgggaataaaatggaagtgcacagaggagatgtcagaagaccaaaacttggtgaatagtcccagtgctaggtcatataggaaacagaaagcatgacagtggccttttgggaacccaagttacgtcctggtgaaagcagaaaggaggagacaggatggctgtcaacaacgtcagcatgggcatggctcccaggcatggaggtaattgggtcttggcttcaatgccacccttttgggaagccctaaaccaagtgaggtgttcttttcccttgcttcccatatttgtcccagttgcagccctgttgttatgtatttactcttcaatttcttatttatacctctcactcaattgttaattctttgggttcagtctcatgccatatttactcctagtacctaatgcagtgcctggcacacagcaagtgcccttgagaacttgtagagggagtaaaaaagtgcatggataaatgactgcagcaaatcacaaattttgaactttgacccttttcttttagtcccaaatagtggcattccatagctgagggtagtaggagcagttcaccctgggagcagacaataagaggaagaatgaagccaactaaaattctgaatgctttttgttggatttcgtagggtattttttttaaaatagggtcttgctatgttgcccaggctggtcttaactgactgctttttattattaccatgcactggcaattccaaacaatgtcagtgttaaaatgcttctccctgaaaaagagaaaaaaaaaaggaaaaaaagaaaagaaaagtgaaaagaaaaactcttattggcctaagttctaaataatagctaggttaccactgagttttaactatatgtatatgagcttcaaataagcacctttttattatgtaaataaataaaagttatctgtatcccca

SEQ ID NO: 187344 - DNA, 1206 bp, Homo sapiens
  Payload ID: 16885
  Gene Symbol: SULT1C2
  Gene Name: sulfotransferase family, cytosolic, 1C, member 2
  ENST ID: ENST00000409880
  CDS Start-End: 178-957
ccaaagtgctggctacctgctgagcgcccccgtaactctgacacagtagtaatttgagcctctgcaattgccgtctgcttcctgtgaaagtcctttccgtgcccactgacccttgagtgggcctttgagctgctgactttcagctggaacttgaagggaccccaaccctgagacactatggccctgacctcagacctggggaaacagataaaactgaaagaggtggaggggaccctcctgcagcctgcaactgtggacaactggagccagatccagagcttcgaggccaaaccagatgatctcctcatctgcacctaccctaaagcagggacaacgtggattcaggaaattgtggatatgattgaacagaatggggacgtggagaagtgccagcgagccatcatccaacaccgccatcctttcattgagtgggctcggccaccccaaccttctgctcgaaatgccaaagactgtatggtttcctactaccatttccaaaggatgaaccacatgcttcctgaccctggtacctgggaagagtattttgaaaccttcatcaatggaaaagtggtttggggttcctggtttgaccacgtgaaaggatggtgggagatgaaagacagacaccagattctcttcctcttctatgaggacataaagagggacccaaagcatgaaattcggaaggtgatgcagttcatgggaaagaaggtggatgaaacagtgctagataaaattgtccaggagacgtcatttgagaaaatgaaagaaaatcccatgacaaatcgttctacagtttccaaatctatcttggaccagtcaatttcctccttcatgagaaaaggaactgtgggggattggaaaaaccacttcactgttgcccagaatgagaggtttgatgaaatctatagaagaaagatggaaggaacctccataaacttctgcatggaactctgagcaagatgtaaataaaattaaaaggtggatggcaagagtgcaaatactatcttcaatccttcagtcccagccagaagaatctctgaaagcatattgtgaatgtatacaatgtagtacaaacaatctctgtgatgattaacagtatgtcaccacttcattttttaaaaaggatcacgtctaatgcccattttcccaactattctttccaaagtaagatataaggtagcttaataaactaagtaaaacgta

SEQ ID NO: 187345 - DNA, 928 bp, Homo sapiens
  Payload ID: 16885
  Gene Symbol: SULT1C2
  Gene Name: sulfotransferase family, cytosolic, 1C, member 2
  ENST ID: ENST00000409067
  CDS Start-End: 1-679
ctcagacctggggaaacagataaaactgaaagaggtggaggggaccctcctgcagcctgcaactgtggacaactggagccagatccagagcttcgaggccaaaccagatgatctcctcatctgcacctaccctaaagcagggacaacgtggattcaggaaattgtggatatgattgaacagaatggggacgtggagaagtgccagcgagccatcatccaacaccgccatcctttcattgagtgggctcggccaccccaaccttctggtgtggaaaaagccaaagcaatgccctctccacggatactaaagactcacctttccactcagctgctgccaccgtctttctgggaaaacaactgcaagttcctttatgtagctcgaaatgccaaagactgtatggtttcctactaccatttccaaaggatgaaccacatgcttcctgaccctggtacctgggaagagtattttgaaaccttcatcaatggaaaagtggtttggggttcctggtttgaccacgtgaaaggatggtgggagatgaaagacagacaccagattctcttcctcttctatgaggacataaagagggaactgtgggggattggaaaaaccacttcactgttgcccagaatgagaggtttgatgaaatctatagaagaaagatggaaggaacctccataaacttctgcatggaactctgagcaagatgtaaataaaattaaaaggtggatggcaagagtgcaaatactatcttcaatccttcagtcccagccagaagaatctctgaaagcatattgtgaatgtatacaatgtagtacaaacaatctctgtgatgattaacagtatgtcaccacttcattttttaaaaaggatcacgtctaatgcccattttcccaactattctttccaaagtaagatataaggtagctt

SEQ ID NO: 187346 - DNA, 1359 bp, Homo sapiens
  Payload ID: 16885
  Gene Symbol: SULT1C2
  Gene Name: sulfotransferase family, cytosolic, 1C, member 2
  ENST ID: ENST00000437390
  CDS Start-End: 178-1110
ccaaagtgctggctacctgctgagcgcccccgtaactctgacacagtagtaatttgagcctctgcaattgccgtctgcttcctgtgaaagtcctttccgtgcccactgacccttgagtgggcctttgagctgctgactttcagctggaacttgaagggaccccaaccctgagacactatggccctgacctcagacctggggaaacagataaaactgaaagaggtggaggggaccctcctgcagcctgcaactgtggacaactggagccagatccagagcttcgaggccaaaccagatgatctcctcatctgcacctaccctaaagcagggacaacgtggattcaggaaattgtggatatgattgaacagaatggggacgtggagaagtgccagcgagccatcatccaacaccgccatcctttcattgagtgggctcggccaccccaaccttctgtgcttgtactacgcagatgtttcctcttgagctattttaaaggtgtggaaaaagccaaagcaatgccctctccacggatactaaagactcacctttccactcagctgctgccaccgtctttctgggaaaacaactgcaagttcctttatgtagctcgaaatgccaaagactgtatggtttcctactaccatttccaaaggatgaaccacatgcttcctgaccctggtacctgggaagagtattttgaaaccttcatcaatggaaaagtggtttggggttcctggtttgaccacgtgaaaggatggtgggagatgaaagacagacaccagattctcttcctcttctatgaggacataaagagggacccaaagcatgaaattcggaaggtgatgcagttcatgggaaagaaggtggatgaaacagtgctagataaaattgtccaggagacgtcatttgagaaaatgaaagaaaatcccatgacaaatcgttctacagtttccaaatctatcttggaccagtcaatttcctccttcatgagaaaaggaactgtgggggattggaaaaaccacttcactgttgcccagaatgagaggtttgatgaaatctatagaagaaagatggaaggaacctccataaacttctgcatggaactctgagcaagatgtaaataaaattaaaaggtggatggcaagagtgcaaatactatcttcaatccttcagtcccagccagaagaatctctgaaagcatattgtgaatgtatacaatgtagtacaaacaatctctgtgatgattaacagtatgtcaccacttcattttttaaaaaggatcacgtctaatgcccattttcccaactattctttccaaagtaagatataaggtagcttaataaactaagtaaaacgta

SEQ ID NO: 187347 - DNA, 576 bp, Homo sapiens
  Payload ID: 16885
  Gene Symbol: SULT1C2
  Gene Name: sulfotransferase family, cytosolic, 1C, member 2
  ENST ID: ENST00000438339
  CDS Start-End: 187-576
gagagcctcccaaagtgctggctacctgctgagcgcccccgtaactctgacacagtagtaatttgagcctctgcaattgccgtctgcttcctgtgaaagtcctttccgtgcccactgacccttgagtgggcctttgagctgctgactttcagctggaacttgaagggaccccaaccctgagacactatggccctgacctcagacctggggaaacagataaaactgaaagaggtggaggggaccctcctgcagcctgcaactgtggacaactggagccagatccagagcttcgaggccaaaccagatgatctcctcatctgcacctaccctaaagcagggacaacgtggattcaggaaattgtggatatgattgaacagaatggggacgtggagaagtgccagcgagccatcatccaacaccgccatcctttcattgagtgggctcggccaccccaaccttctgctgctgccaccgtctttctgggaaaacaactgcaagttcctttatgtagctcgaaatgccaaagactgtatggtttcctactaccatttccaaaggatgaaccacatgcttcc

SEQ ID NO: 187348 - DNA, 872 bp, Homo sapiens
  Payload ID: 16885
  Gene Symbol: SULT1C2
  Gene Name: sulfotransferase family, cytosolic, 1C, member 2
  ENST ID: ENST00000442801
  CDS Start-End: 1-349
gacctcagacctggggaaacagataaaactgaaagaggtggaggggaccctcctgcagcctgcaactgtggacaactggagccagatccagagcttcgaggccaaaccagatgatctcctcatctgcacctaccctaaagcagggacaacgtggattcaggaaattgtggatatgattgaacagaatggggacgtggagaagtgccagcgagccatcatccaacaccgccatcctttcattgagtgggctcggccaccccaaccttctgttcctttatgtagctcgaaatgccaaagactgtatggtttcctactaccatttccaaaggatgaaccacatgcttcctgaccctggtacctgggaagagtattttgaaaccttcatcaatggaaaagtggtttggggttcctggtttgaccacgtgaaaggatggtgggagatgaaagacagacaccagattctcttcctcttctatgaggacataaagagggacccaaagcatgaaattcggaaggtgatgcagttcatgggaaagaaggtggatgaaacagtgctagataaaattgtccaggagacgtcatttgagaaaatgaaagaaaatcccatgacaaatcgttctacagtttccaaatctatcttggaccagtcaatttcctccttcatgagaaaaggaactgtgggggattggaaaaaccacttcactgttgcccagaatgagaggtttgatgaaatctatagaagaaagatggaaggaacctccataaacttctgcatggaactctgagcaagatgtaaataaaattaaaaggtggatggcaagagtgcaaatactatcttcaatccttcagtcccagccagaagaatctctgaa

SEQ ID NO: 187349 - DNA, 915 bp, Homo sapiens
  Payload ID: 16886
  Gene Symbol: SULT1C3
  Gene Name: sulfotransferase family, cytosolic, 1C, member 3
  Uniprot ID: Q6IMI6
  ENST ID: ENST00000329106
  CDS Start-End: 1-915
atggcgaagattgagaaaaacgctcccacgatggaaaaaaagccagaactgtttaacatcatggaagtagatggagtccctacgttgatattatcaaaagaatggtgggaaaaagtatgtaatttccaagccaagcctgatgatcttattctggcaacttacccaaagtcaggtacaacatggatgcatgaaattttagacatgattctaaatgatggtgatgtggagaaatgcaaaagagcccagactctagatagacacgctttccttgaactgaaatttccccataaagaaaaaccagatttggagttcgttcttgaaatgtcctcaccacaactgataaaaacacatctcccttcacatctgattccaccatctatctggaaagaaaactgcaagattgtctatgtggccagaaatcccaaggattgcctggtgtcctactaccactttcacaggatggcttcctttatgcctgatcctcagaacttagaggaattttatgagaaattcatgtccggaaaagttgttggcgggtcctggtttgaccatgtgaaaggatggtgggctgcaaaagacatgcaccggatcctctacctcttctacgaggatattaaaaaagacccaaagcgggaaattgagaagatactgaagttcctggaaaaagacatatcagaggaaattctgaataaaatcatctatcacacctcctttgatgtaatgaagcaaaacccaatgaccaactataccactttgcccaccagcattatggaccactccatctccccttttatgaggaaagggatgcctggagactggaagaactattttactgtggcccaaaatgaagaatttgacaaggactaccagaagaagatggcaggaagcaccctaaccttccgcacagagatctga

SEQ ID NO: 187350 - DNA, 1860 bp, Homo sapiens
  Payload ID: 16887
  Gene Symbol: SULT1C4
  Gene Name: sulfotransferase family, cytosolic, 1C, member 4
  Uniprot ID: O75897
  ENST ID: ENST00000272452
  CDS Start-End: 327-1235
ctgcagctcactttctccctgtttgctggccagcagggtttgtggccgcctctgctgtgacgccacagcctggtgaggagggggctgcagttcctcaggaaactgccagtggacaaagtcataaacaagagttccagttccctggaacctgagtcgggaggcctgcaactcactttctccctgtttgctggcccagacaggcctgtgctagagggctggatagtgtggtagtgtggtggatagagtgctgcctctatccacaacgcagccatatgctgactgaagataactttgtgtctggaagagccctctgatttcttacactaatggccttacacgacatggaggattttacatttgatggaacaaagcgcttaagtgtcaactacgtgaagggaattcttcaaccgacagacacctgtgacatctgggataagatctggaacttccaagccaagcctgatgacctgcttatttctacctatcctaaagcaggaacaacatggactcaggagatagtggaattaatacaaaatgaaggtgatgtggagaaaagtaaacgggcaccgactcatcaacgatttcctttcctcgaaatgaaaatcccatccttaggatctggtttggaacaagctcatgcaatgccctcaccacggatcctgaaaacacatcttccctttcacttgctgccaccatccttgctagagaaaaactgtaagataatctatgtagcaagaaatcccaaggacaacatggtgtcctattaccatttccaaagaatgaataaagctcttcctgctccaggaacatgggaagagtattttgagacttttctggctgggaaagtgtgctggggctcctggcatgaacatgtgaaaggatggtgggaagccaaagacaaacaccgtattctctatctcttctatgaggacatgaagaagaacccaaagcatgaaattcagaagctggcagaatttattgggaagaaattagatgacaaagttctagataaaattgtccattacacttcgtttgatgtcatgaaacagaatccaatggcaaactattcatcgattcctgctgaaatcatggaccactccatttctccattcatgagaaaaggggcagtgggagactggaagaaacacttcaccgtggctcagaatgagagatttgatgaagattacaagaagaaaatgactgataccagactaactttccacttccagttctagtaaggaagaaaaactgaaaatgttttagtttattacccagtatatttgggtaataatgaaagtttaattctcataacaaatgatatcagattccagttatcagaatagtttactgtgtttgctcttattcactctactaaaaaattattttaaaaggctggaggcaaggtggtgacaggcagcagggtggcgacatggagagagggaagctcaataaatcactaggtacaatcctggtatcattgccaattatcatcatatttacattttctacaatcatgtgcttattaacatattggaaatgcttcagtcctcacatgataatacactaacattttcagattaagttttggttcaagttaatttttttttttttttttttgagacggagtctcgctctgtcgcccaggctggagtgcagtggcacgatctcggctcactgcaagctctgcttcctgggttcacgctattcccctgcctcagcctcccgagtagctgggactatgggcgcccaccaccactcccggctaatttttttttttgtattcttagtagagacgaggtttcaccgtgttagccaggatgttctcgatctcctgaccccatgatccacccgcttcggcct

SEQ ID NO: 187351 - DNA, 1045 bp, Homo sapiens
  Payload ID: 16887
  Gene Symbol: SULT1C4
  Gene Name: sulfotransferase family, cytosolic, 1C, member 4
  Uniprot ID: O75897
  ENST ID: ENST00000409309
  CDS Start-End: 154-837
tttctccctgtttgctggcccagacaggcctgtgctagagggctggatagtgtggtagtgtggtggatagagtgctgcctctatccacaacgcagccatatgctgactgaagataactttgtgtctggaagagccctctgatttcttacactaatggccttacacgacatggaggattttacatttgatggaacaaagcgcttaagtgtcaactacgtgaagggaattcttcaaccgacagacacctgtgacatctgggataagatctggaacttccaagccaagcctgatgacctgcttatttctacctatcctaaagcaggaacaacatggactcaggagatagtggaattaatacaaaatgaaggtgatgtggagaaaagtaaacgggcaccgactcatcaacgatttcctttcctcgaaatgaaaatcccatccttaggatctgtgtgctggggctcctggcatgaacatgtgaaaggatggtgggaagccaaagacaaacaccgtattctctatctcttctatgaggacatgaagaagaacccaaagcatgaaattcagaagctggcagaatttattgggaagaaattagatgacaaagttctagataaaattgtccattacacttcgtttgatgtcatgaaacagaatccaatggcaaactattcatcgattcctgctgaaatcatggaccactccatttctccattcatgagaaaaggggcagtgggagactggaagaaacacttcaccgtggctcagaatgagagatttgatgaagattacaagaagaaaatgactgataccagactaactttccacttccagttctagtaaggaagaaaaactgaaaatgttttagtttattacccagtatatttgggtaataatgaaagtttaattctcataacaaatgatatcagattccagttatcagaatagtttactgtgtttgctcttattcactctactaaaaaattattttaaaaggctggaggcaaggtggtgacaggcagcagggtggcgacatggagagagggaa

SEQ ID NO: 187352 - DNA, 1987 bp, Homo sapiens
  Payload ID: 16888
  Gene Symbol: SULT2A1
  Gene Name: sulfotransferase family, cytosolic, 2A, dehydroepiandrosterone (DHEA)-preferring, member 1
  Uniprot ID: Q06520
  ENST ID: ENST00000222002
  CDS Start-End: 141-998
acaacaaacatgtgacatgctgggacaaggttaaagatcgttttatccttgctgtaaaagctgatctgcctgtagctgccacagcctccagcggtggctacagttgaaaccctcacaccacgcaggaagaggtcatcatcatgtcggacgatttcttatggtttgaaggcatagctttccctactatgggtttcagatccgaaaccttaagaaaagtacgtgatgagttcgtgataagggatgaagatgtaataatattgacttaccccaaatcaggaacaaactggttggctgagattctctgcctgatgcactccaagggggatgccaagtggatccaatctgtgcccatctgggagcgatcaccctgggtagagagtgagattgggtatacagcactcagtgaaacggagagtccacgtttattctcctcccacctccccatccagttattccccaagtctttcttcagttccaaggccaaggtgatttatctcatgagaaatcccagagatgttttggtgtctggttattttttctggaaaaacatgaagtttattaagaaaccaaagtcatgggaagaatattttgaatggttttgtcaaggaactgtgctatatgggtcatggtttgaccacattcatggctggatgcccatgagagaggagaaaaacttcctgttactgagttatgaggagctgaaacaggacacaggaagaaccatagagaagatctgtcaattcctgggaaagacgttagaacccgaagaactgaacttaattctcaagaacagctcctttcagagcatgaaagaaaacaagatgtccaattattccctcctgagtgttgattatgtagtggacaaagcacaacttctgagaaaaggtgtatctggggactggaaaaatcacttcacagtggcccaagctgaagactttgataaattgttccaagagaagatggcagatcttcctcgagagctgttcccatgggaataacgtccaaaacactctggatcttatatggagaatgacattgattctcctgtccttgtacatgtacctgactggggtcattgtgtaagacttattattttatcctgaaaccttaaatatcaaacctctgcatctctgatcccttccttgttaaaagttaccagggttggccaggcacggtggttcatgcctgtaatcccagcactatgggaggccgagacgggcggatcacgaggtcaggagactgagaccatcctggctaacacggtgaaaccccatctctactaaaaatacaaaaaccaaaaaaaattagccaggcgcattggctcatgtctgtaatcccagcactttgggaggtcgggggggtgggggaggatcacggggtcaggagatcgagaccatcctggccaacatgatgaaaccctatctctactaaaaatacaaaaattagccgggcatggtggtgcacgcctatagtcccagctactcgggaggctgaggtaggagaatcgtttgaactcaggaggcagaggttgcaatgagccaagatcgcgccactgcactccagcctgggtgacagagcgagaccgtctcaaaaagaaagaagtgactagggttcagagaaccagggttcaaagcccagggatgcaaaggttgcagtgagttgagtcatgggatcccagacttttttaaatgtttgcaatgtttcccgtttacagaatgctacaagaataatgtacgtactacctaaaaggatgtctaaatgtttgttaataaaaataagaaatagctacagtgacagattttagagcaaaaattagtaataaaaataagaaataaaattacaggagcaattaaggttccatttcttttcatcacatgtatctccacaatttattattgctctgatcttaaggagtgtaatttgcaatctaattttatcctcttactctgtgttgttaaaccatatacaataaacggtgtttatggag

SEQ ID NO: 187353 - DNA, 1295 bp, Homo sapiens
  Payload ID: 16889
  Gene Symbol: SULT2B1
  Gene Name: sulfotransferase family, cytosolic, 2B, member 1
  Uniprot ID: O00204
  ENST ID: ENST00000201586
  CDS Start-End: 179-1276
gttggaggcgtgggtagcagctgggagaaccggctgggtgctgcccctccccttgggccgggcacggagtaggcacctggcgggctccccaggtggcagacgctgtcgctgcgcacacctggcctctgtgccgcctgctccctgctcgtcctcccctccccaccctcacccacctgccatggacgggcccgccgagccccagatcccgggcttgtgggacacctatgaagatgacatctcggaaatcagccagaagttgccaggtgaatacttccggtacaagggcgtccccttccccgtcggcctgtactcgctcgagagcatcagcttggcggagaacacccaagatgtgcgggacgacgacatctttatcatcacctaccccaagtcaggcacgacctggatgatcgagatcatctgcttaatcctgaaggaaggggatccatcctggatccgctccgtgcccatctgggagcgggcaccctggtgtgagaccattgtgggtgccttcagcctcccggaccagtacagcccccgcctcatgagctcccatcttcccatccagatcttcaccaaggccttcttcagctccaaggccaaggtgatctacatgggccgcaacccccgggacgttgtggtctccctctatcattactccaagatcgccgggcagttaaaggacccgggcacacccgaccagttcctgagggacttcctcaaaggcgaagtgcagtttggctcctggttcgaccacattaagggctggcttcggatgaagggcaaagacaacttcctatttatcacctacgaggagctgcagcaggacttacagggctccgtggagcgcatctgtgggttcctgggccgtccgctgggcaaggaggcactgggctccgtcgtggcacactcaaccttcagcgccatgaaggccaacaccatgtccaactacacgctgctgcctcccagcctgctggaccaccgtcgcggggccttcctccggaaaggggtctgcggcgactggaagaaccacttcacggtggcccagagcgaagccttcgatcgtgcctaccgcaagcagatgcgggggatgccgaccttcccctgggatgaagacccggaggaggacggcagcccagatcctgagcccagccctgagcctgagcccaagcccagccttgagcccaacaccagcctggagcgtgagcccagacccaactccagccccagccccagccccggccaggcctctgagaccccgcacccacgaccctcataataaacacgtcgattctgtc

SEQ ID NO: 187354 - DNA, 1447 bp, Homo sapiens
  Payload ID: 16889
  Gene Symbol: SULT2B1
  Gene Name: sulfotransferase family, cytosolic, 2B, member 1
  Uniprot ID: O00204
  ENST ID: ENST00000323090
  CDS Start-End: 376-1428
ccgtgatctcggctcactgcaacctccgcctcctgggttcaaacgattctcctgcctcagcctccggagtaactgggagtacaggcatgcgccaccacgcctggctgatttttgtctttttagtaggggcggggtttcaccatgttggccaggctggtctcaaactcctgacctcaggtgatccacccacctctgtctcccaaagtgctgggattacaggagtgtgccactgcgcctgaccagctttataaagtttatagggacagtgtcaccactttacagaagagggactgaggctctgaggaggaagttccttgccagggtccgagtgtcgccaccctgagaactccagcacccacctccctactctccctcatggcgtctcccccacctttccacagccagaagttgccaggtgaatacttccggtacaagggcgtccccttccccgtcggcctgtactcgctcgagagcatcagcttggcggagaacacccaagatgtgcgggacgacgacatctttatcatcacctaccccaagtcaggcacgacctggatgatcgagatcatctgcttaatcctgaaggaaggggatccatcctggatccgctccgtgcccatctgggagcgggcaccctggtgtgagaccattgtgggtgccttcagcctcccggaccagtacagcccccgcctcatgagctcccatcttcccatccagatcttcaccaaggccttcttcagctccaaggccaaggtgatctacatgggccgcaacccccgggacgttgtggtctccctctatcattactccaagatcgccgggcagttaaaggacccgggcacacccgaccagttcctgagggacttcctcaaaggcgaagtgcagtttggctcctggttcgaccacattaagggctggcttcggatgaagggcaaagacaacttcctatttatcacctacgaggagctgcagcaggacttacagggctccgtggagcgcatctgtgggttcctgggccgtccgctgggcaaggaggcactgggctccgtcgtggcacactcaaccttcagcgccatgaaggccaacaccatgtccaactacacgctgctgcctcccagcctgctggaccaccgtcgcggggccttcctccggaaaggggtctgcggcgactggaagaaccacttcacggtggcccagagcgaagccttcgatcgtgcctaccgcaagcagatgcgggggatgccgaccttcccctgggatgaagacccggaggaggacggcagcccagatcctgagcccagccctgagcctgagcccaagcccagccttgagcccaacaccagcctggagcgtgagcccagacccaactccagccccagccccagccccggccaggcctctgagaccccgcacccacgaccctcataataaacacgtcgattctgtc

SEQ ID NO: 187355 - DNA, 902 bp, Homo sapiens
  Payload ID: 16890
  Gene Symbol: SULT6B1
  Gene Name: sulfotransferase family, cytosolic, 6B, member 1
  ENST ID: ENST00000407963
  CDS Start-End: 105-902
agaagaccgccccactctcgtcgcactagggaccccgaaatccgaccgcccatgggaagccactcgccagagtcttacctgaggggattccttaccccatcaccatgtgcacctcagaaactttccaagcgctggacaccttcgaagccagacatgatgacatcgtgctagcatcttatccaaagtgcggttcaaactggattctccacattgtcagtgaattaatatatgctgtttctaaaaaaaagtataaatatccagaattcccagttcttgaatgtggggattcagaaaaatatcagagaatgaaaggctttccatcaccaaggattttggcaactcacctccactatgacaaattacctgggtctatcttcgagaataaagccaagatattggtgatatttcgaaaccctaaagatacagcagtatcttttttgcatttccacaacgatgtccccgatattccaagctatggctcttgggatgaattcttcagacagttcatgaaaggacaagtttcttggggaaggtattttgattttgcaatcaattggaacaaacatcttgatggcgacaatgttaagttcatattatatgaagacctgaaagagaatctggctgctggaataaaacagattgctgagttcttgggattctttctaactggggagcaaattcaaactatctcagtccagagcaccttccaagccatgcgtgcgaagtctcaggacacacacggtgctgtcggcccattccttttccgcaaaggtgaagttggtgattggaaaaatttgttcagtgaaattcagaaccaggaaatggatgaaaaattcaaagagtgcttagcaggcacctccctcggagcaaagttgaagtatgaatcatattgccagggttga

SEQ ID NO: 187356 - DNA, 162 bp, Homo sapiens
  Payload ID: 16890
  Gene Symbol: SULT6B1
  Gene Name: sulfotransferase family, cytosolic, 6B, member 1
  ENST ID: ENST00000433192
  CDS Start-End: 113-162
ctagggaccccgaaatccgaccgcccatgggaagccactcgccagagtcttacctgagtgaaaaatgccatggccttgtttctcatagcaggggattccttaccccatcaccatgtgcacctcagaaactttccaagcgctggacaccttcgaagccagaca

SEQ ID NO: 187357 - DNA, 134 bp, Homo sapiens
  Payload ID: 16890
  Gene Symbol: SULT6B1
  Gene Name: sulfotransferase family, cytosolic, 6B, member 1
  ENST ID: ENST00000420611
  CDS Start-End: 85-134
ctggagtgctgctttcctccgaattagcaaatctggtttgccaacacagtatctgccttccaggggattccttaccccatcaccatgtgcacctcagaaactttccaagcgctggacaccttcgaagccagaca

SEQ ID NO: 187358 - DNA, 223 bp, Homo sapiens
  Payload ID: 16890
  Gene Symbol: SULT6B1
  Gene Name: sulfotransferase family, cytosolic, 6B, member 1
  ENST ID: ENST00000416345
  CDS Start-End: 174-223
ggcctagatgggaggatcacgacatcaggagaccgagaccatcctggctaacacgtgaaaaatgccatggccttgtttctcatagcaggtaaagaagaaccaaagaattcactggtactaacaattaaacctatgccctctgagatctcattgggattccttaccccatcaccatgtgcacctcagaaactttccaagcgctggacaccttcgaagccagaca

SEQ ID NO: 187359 - DNA, 1027 bp, Homo sapiens
  Payload ID: 16890
  Gene Symbol: SULT6B1
  Gene Name: sulfotransferase family, cytosolic, 6B, member 1
  Uniprot ID: Q6IMI4
  ENST ID: ENST00000535679
  CDS Start-End: 1-912
atggctgataaatccaaatttattgaatacattgacgaagctttagaaaaatcaaaagaaactgcactctctcatttatttttcacctatcaggggattccttaccccatcaccatgtgcacctcagaaactttccaagcgctggacaccttcgaagccagacatgatgacatcgtgctagcatcttatccaaagtgcggttcaaactggattctccacattgtcagtgaattaatatatgctgtttctaaaaaaaagtataaatatccagaattcccagttcttgaatgtggggattcagaaaaatatcagagaatgaaaggctttccatcaccaaggattttggcaactcacctccactatgacaaattacctgggtctatcttcgagaataaagccaagatattggtgatatttcgaaaccctaaagatacagcagtatcttttttgcatttccacaacgatgtccccgatattccaagctatggctcttgggatgaattcttcagacagttcatgaaaggacaagtttcttggggaaggtattttgattttgcaatcaattggaacaaacatcttgatggcgacaatgttaagttcatattatatgaagacctgaaagagaatctggctgctggaataaaacagattgctgagttcttgggattctttctaactggggagcaaattcaaactatctcagtccagagcaccttccaagccatgcgtgcgaagtctcaggacacacacggtgctgtcggcccattccttttccgcaaaggtgaagttggtgattggaaaaatttgttcagtgaaattcagaaccaggaaatggatgaaaaattcaaagagtgcttagcaggcacctccctcggagcaaagttgaagtatgaatcatattgccagggttgattccagtcaattcagcaggcctagatttattttccttaataataattaagtgtaaataattaaatgataattcaatcaaataatcaaataataattaaacaatattgaaatctaa

SEQ ID NO: 187360 - DNA, 4281 bp, Homo sapiens
  Payload ID: 16891
  Gene Symbol: SENP8
  Gene Name: SUMO/sentrin peptidase family member, NEDD8 specific
  Uniprot ID: Q96LD8
  ENST ID: ENST00000340912
  CDS Start-End: 217-855
cttcttcaccttacggcagagcagggaactcagctttagattctccctgtactggaaagggatgtcgcaaggttggggacgaaacctctgagtttgcgaccgtagctgtcgctttccggccaacacagaggtgcctgaaggctggttggggtggtgaggcccgaggcagctcttgttcagcttctggaatttctgagcagccctcgtcagtacaagatggaccccgtagtcttgagttacatggacagtctactgcggcaatcagatgtctcactattggatccgccaagctggctcaatgaccatattattgggtttgcgtttgagtactttgccaacagtcagtttcatgactgctctgatcacgtcagtttcatcagccctgaagtcacccagttcatcaagtgcactagcaacccagcagagattgccatgttccttgaaccactggacctccccaacaagagagttgtatttttagccatcaatgataactccaaccaggcagctggaggaacccactggagtttattggtctacctccaagataaaaatagcttttttcattatgattcccatagcaggagcaactcagttcacgcaaagcaggtagcagagaaactggaggctttcttaggcagaaaaggagacaaactggcctttgtggaagagaaagcccctgcccaacaaaacagctatgactgtgggatgtacgtgatatgtaacactgaggccttgtgtcagaacttctttaggcaacagacagaatcactgctgcagctactcacccctgcatacatcacaaagaagaggggagaatggaaagatctcattaccacacttgctaaaaagtagctattgaagtatatttgcgacttttgaaggctcctctttctgcccttccccatttgttggatggctgcaatctcagtgcctgagggaagatgcctagtagaggaaagcttaatactctttttcctgaaagaatatcatcctctgcattatccccatggaacgtttcactttaaccctgactggggagcaatatgttctgtgaaaatatcttgaaattgtacaccaaaaccttacaaccaacttatttgaacatttattacacacagggtttacgtaagacttttcttattggtatataattaatttcctttggtctcccttatccacattggcttattctggaggaaaagcagtgatctgtaaaacaaatcaagaatatattaaatctagaggaatgcagagaagaaaactataaaacagaaccaaaaacttgttgcacagcctacataattaagagatcaactggctggaagcagatcaaggcctaacttcattcaagacctaaatattatgagactcagttattcggttttatgtgacatctcttccattcaccatgcacaggcttttccagctatctatataatgtttgcaaatatttgataaagatgatgttaccctatcttcctccatctgattcctggaatgcttgaagaaaggggaaatcttgagtaacctcattaaaattaatgtctggtggacctctcagtttgctcactgattgggtagacttgctactctggattaataactgcttttctctgccttgtctattagccatgcacacacttcctccttatatccaaagttctttggttctaaaattcatagttgataccttcccaaggttacctgttgtttcagataaacatttgttcttcctgatagttataggttttcctctctgtccttaattctggcagaattgtttttagttatgtcatggtaatttcaggatgatttttgtatctgaaacttaacagacttagagttggtttgttttttaaatataaaggaagaaaagtgacctttctcagcccttttacttaattaaaaatgcagggaatgtaatttgtaaaatgtggaaccaagagtagaacgaaatactatccctccagaagcactgatgtgtttcagttgtttcaaatagtaaacaaccagatgacatgttaggtacacaaattaattctattcctaatgagaattagattgcaaggcctatgagacttgaaaaccaaagatgagcttcagccatgaaacttatttcagctacctccccagcctaaccctgcccccagccctcatggcccaaaataacctcaccactcagtgaccacagagaaagtaacttggttccttttagccgagaagggaaaacacagtaagggtaaataagtacaggttacatagcaggcctgagtgagcaggagctgaaactaaaagtcaaagagaaagctatcaaaaaaagtttccatttcaagtcggtacattttggataaaaaccagtcctaatggaagatggggctaggaaaaagattaggaactggcagtcatccatagaggtgaaatacagagggagggacagcaagagaagtgacaaaggtcactgatgataggccacaagtgtagataaagataagaaaacaatgttatttcagtgactgttgacttaggcagctaatctagactattaaagtcaaatcctctctgggaaaagttatctttctgacaatgcaaagtatgtttatttaaatatcagagtatcttcaatctgagaattaaagcatatgaaagcaatctttcctaactccctacgattcatcttataagtaaatttataagtaaatttttaaactacactagtcttttaaatatatatagaaaaatatatatacacacgtatagacatgtatatgtaatctatctacatatatataaaaaatgcattttccaaatgcattagcctgattggactgtgccacagattagtgtcctcctatgaaattttgagtatgtcatttgtaaatgttagcattataaattgcaggagaatttaagaattgacttgtatttcactggatactatagtacccggtaagttacacacctgcttgaccacataccattcatgttacatgacacaaaataggaaaaaatcttttgctggtattgcgttcccttctctcttagagtcaaaaggatctattctgcaaaattaatcaaaatattcaaaaggaaggcaggtttttcaaaactgggctaagcaattatcaaactgaactaacctgctttcagatatcctgttgtattgcccggtaagtatagtcacacttgtccaacccgtgtctcaatatggaattcagaaaagttaccatatataaacccagctataaatggttgtagaaaatataagtatcagtgggtttcctatgtaatagtgtttaaaacacaaatatttcaaccatttggcaaggtatatgttgaagttcacaagcgctggtcctaaccagatcagataaagtggattatgtttctgatatgtacctaattattttgactatactataattttacaatatgcatattgaccgtatgttttaataacacattccattgaaatgaccaagtagaatttctcagttacatggggcaggccgggcgcaatggctcatgcctgtaatcccaggactttgggaggccaaggcaggcagatcacctgaggtcaggagttcaagaccagcctggccaacatggcgaaaccccgtctctactaaaaatacaaaaattagccgggcatggtaggtgggcgcctgtaatcccagctactcagcaggctgaggcaggagaatcacttgaacctgggaggcggaggttgcagtgagctgagattgtgccactgcactccagcctaggcaacagagcgagactcttatctcaaaaaaaaaaaaaaaagtatttacagaaatgtacatgctatggtgttagagcatgaatgtcaaatccagggtctgtcagattcagtagtctcatctacaaaataaaccttgttttccttctgtcctactcagttccattttaagactaacaacaagtttgaaaacttagttttatattgctatgcagctaaacagctgtgtaaaaaatggctgataattactgttatgtacaaaagagaaacttattcaaggatggtgaatagcaacaactaacctttttatcactctgtaatgtgcagggtactttatgcacacatattacacaagtaccttgcatattatatatgcatcattatatatattaccatatatataaagtaacttgtacatttttgaggttctatagaaatatataatctcattaattcttatgttctcatgtttcaacaggtactgttattctcattttataaataaactcagaagctca

SEQ ID NO: 187361 - DNA, 1672 bp, Homo sapiens
  Payload ID: 16891
  Gene Symbol: SENP8
  Gene Name: SUMO/sentrin peptidase family member, NEDD8 specific
  Uniprot ID: Q96LD8
  ENST ID: ENST00000542035
  CDS Start-End: 334-972
acttactccaacagcagtcaagagaatgaacaggagggcatgacaagaggcagaagacagaaggcaagaagaccactcagcattacagaagcccaacaaacagatattttcagttaaaataagatagaggcaacaaaaagtaataaggaatgacctgaaatatcatgagggaaaatgtacaaggcagtgacagactggatgttggcagtgaagtacagagtgaagcggagggcaattcccaggttcctgaaggtttcatgaggaaagagtggtgccattaatcaagctcttgttcagcttctggaatttctgagcagccctcgtcagtacaagatggaccccgtagtcttgagttacatggacagtctactgcggcaatcagatgtctcactattggatccgccaagctggctcaatgaccatattattgggtttgcgtttgagtactttgccaacagtcagtttcatgactgctctgatcacgtcagtttcatcagccctgaagtcacccagttcatcaagtgcactagcaacccagcagagattgccatgttccttgaaccactggacctccccaacaagagagttgtatttttagccatcaatgataactccaaccaggcagctggaggaacccactggagtttattggtctacctccaagataaaaatagcttttttcattatgattcccatagcaggagcaactcagttcacgcaaagcaggtagcagagaaactggaggctttcttaggcagaaaaggagacaaactggcctttgtggaagagaaagcccctgcccaacaaaacagctatgactgtgggatgtacgtgatatgtaacactgaggccttgtgtcagaacttctttaggcaacagacagaatcactgctgcagctactcacccctgcatacatcacaaagaagaggggagaatggaaagatctcattaccacacttgctaaaaagtagctattgaagtatatttgcgacttttgaaggctcctctttctgcccttccccatttgttggatggctgcaatctcagtgcctgagggaagatgcctagtagaggaaagcttaatactctttttcctgaaagaatatcatcctctgcattatccccatggaacgtttcactttaaccctgactggggagcaatatgttctgtgaaaatatcttgaaattgtacaccaaaaccttacaaccaacttatttgaacatttattacacacagggtttacgtaagacttttcttattggtatataattaatttcctttggtctcccttatccacattggcttattctggaggaaaagcagtgatctgtaaaacaaatcaagaatatattaaatctagaggaatgcagagaagaaaactataaaacagaaccaaaaacttgttgcacagcctacataattaagagatcaactggctggaagcagatcaaggcctaacttcattcaagacctaaatattatgagactcagttattcggttttatgtgacatctcttccattcaccatgcacaggcttttccagctatctatataatgtttgcaaatatttgataaagatgatgttaccctatcttcctccatctgattcctggaatgcttgaagaaaggggaaatcttgagtaacctcattaaaattaatgtctggtgg

SEQ ID NO: 187362 - DNA, 550 bp, Homo sapiens
  Payload ID: 16891
  Gene Symbol: SENP8
  Gene Name: SUMO/sentrin peptidase family member, NEDD8 specific
  ENST ID: ENST00000564863
  CDS Start-End: 330-550
acttttttcagcccaacccctccaaacatgggtctcggtcggtccccttaagccacaatggagggaatacattaggctaagcaaatattccctcaggatttcatggcaaagccctttcaaccaaagaaaggatcgcgactaaggagaaagataacaagtggaaatggatcgtcataaaggtcttcatcctcatcatcatgttgagtaggctgaagaggaggaggaaaaggagcaattggtcttgctgtctcaggggtggcagaggcaaaagaaaatccatgtctcttgttcagcttctggaatttctgagcagccctcgtcagtacaagatggaccccgtagtcttgagttacatggacagtctactgcggcaatcagatgtctcactattggatccgccaagctggctcaatgaccatattattgggtttgcgtttgagtactttgccaacagtcagtttcatgactgctctgatcacgtcagtttcatcagccctgaagtcacccagttcatcaagtgcactagcaacccagcagagattgccatgtt

SEQ ID NO: 187363 - DNA, 599 bp, Homo sapiens
  Payload ID: 16891
  Gene Symbol: SENP8
  Gene Name: SUMO/sentrin peptidase family member, NEDD8 specific
  ENST ID: ENST00000567794
  CDS Start-End: 488-599
ataatggcacacacacaactggcctcatgcttccataacttcactctgcctcccacttttttcagcccaacccctccaaacatgggtctcggtcggtccccttaagccacaatggagggaatacattaggctaagcaaatattccctcaggatttcatggcaaagccctttcaaccaaagaaaggatcgcgactaaggagaaagataacaaggtttgcttgaggagaggtctgttgagagaggctacagtcggtggtgggagagaagccaaagtctgtgacggtgtctagagggactgacaccacatctaccgggatggaaatggatcgtcataaaggtcttcatcctcatcatcatgttgagtaggctgaagaggaggaggaaaaggagcaattggtcttgctgtctcaggggtggcagaggcaaaagaaaatccatgtctcttgttcagcttctggaatttctgagcagccctcgtcagtacaagatggaccccgtagtcttgagttacatggacagtctactgcggcaatcagatgtctcactattggatccgccaagctggctcaatgaccatattattgggtttgcgtttgagt

SEQ ID NO: 187364 - DNA, 703 bp, Homo sapiens
  Payload ID: 16891
  Gene Symbol: SENP8
  Gene Name: SUMO/sentrin peptidase family member, NEDD8 specific
  ENST ID: ENST00000564082
  CDS Start-End: 312-703
tcagctttagattctccctgtactggaaagggatgtcgcaaggttggggacgaaacctctgagtttgcgaccgtagctgtcgctttccggccaacacagaggtgcctgaaggctggttggggtggtgaggcccgaggcagtggaaatggatcgtcataaaggtcttcatcctcatcatcatgttgagtaggctgaagaggaggaggaaaaggagcaattggtcttgctgtctcaggggtggcagaggcaaaagaaaatccatgtctcttgttcagcttctggaatttctgagcagccctcgtcagtacaagatggaccccgtagtcttgagttacatggacagtctactgcggcaatcagatgtctcactattggatccgccaagctggctcaatgaccatattattgggtttgcgtttgagtactttgccaacagtcagtttcatgactgctctgatcacgtcagtttcatcagccctgaagtcacccagttcatcaagtgcactagcaacccagcagagattgccatgttccttgaaccactggacctccccaacaagagagttgtatttttagccatcaatgataactccaaccaggcagctggaggaacccactggagtttattggtctacctccaagataaaaatagcttttttcattatgattcccatagcaggagcaactcagttcacgcaaagca

SEQ ID NO: 187365 - DNA, 2049 bp, Homo sapiens
  Payload ID: 16892
  Gene Symbol: SAE1
  Gene Name: SUMO1 activating enzyme subunit 1
  Uniprot ID: Q9UBE0
  ENST ID: ENST00000270225
  CDS Start-End: 69-1109
gtggcgcgcgggtccggcgggcggttggcttgagcgggaccggagctgaggcaggaagagccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttagga

SEQ ID NO: 187366 - DNA, 2211 bp, Homo sapiens
  Payload ID: 16892
  Gene Symbol: SAE1
  Gene Name: SUMO1 activating enzyme subunit 1
  ENST ID: ENST00000414294
  CDS Start-End: 73-972
gtaggtggcgcgcgggtccggcgggcggttggcttgagcgggaccggagctgaggcaggaagagccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagaattgtttcctagaattgttgagagggtttatgcccagagacatcccagaagcactgaacgcactcatgccaagatgttaatacctttcctcactaaagagaaaccagggttccttggagaaatggctgtttccagatctggggtaggaaaattacagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttagga

SEQ ID NO: 187367 - DNA, 2313 bp, Homo sapiens
  Payload ID: 16892
  Gene Symbol: SAE1
  Gene Name: SUMO1 activating enzyme subunit 1
  Uniprot ID: Q9UBE0
  ENST ID: ENST00000413379
  CDS Start-End: 103-1002
agaagcactccgggcgtgctgccggcggcggtaggtggcgcgcgggtccggcgggcggttggcttgagcgggaccggagctgaggcaggaagagccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggatttgcttgtttttcttccacttcagaagcttctgagagggaatgggatgatcctaccagttgccttttcagacctgaggctctaactcaagagattcctcctctccctcaccattcctgccaccattttttctgggtgatgcagcaagagttaaattgttcacattctagaatgtgtagaagcttctggctccagttgtctaatggataattcagctaaatagtggctattttcagtggcaagaattataataataaagggaagtcaaaagtgatgcttcatatgccccaagtgccacagccgctacgggtcagagcttttattggaagaccaggtttgccttgatgcagccaaagtgcgttccagttcaccccactcttgcttgtgtttcttctttatgtaaattgtgtgatgtttcaataaatcagtctctttcctattctga

SEQ ID NO: 187368 - DNA, 1851 bp, Homo sapiens
  Payload ID: 16892
  Gene Symbol: SAE1
  Gene Name: SUMO1 activating enzyme subunit 1
  Uniprot ID: Q9UBE0
  ENST ID: ENST00000392776
  CDS Start-End: 37-837
agcgggaccggagctgaggcaggaagagccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgata

SEQ ID NO: 187369 - DNA, 744 bp, Homo sapiens
  Payload ID: 16892
  Gene Symbol: SAE1
  Gene Name: SUMO1 activating enzyme subunit 1
  ENST ID: ENST00000600706
  CDS Start-End: 129-744
gaagcactccgggcgtgctgccggcggcgtttgagccaccatcatcctccctcaccttaactgtgacatcttcctacccccatggctttccatcatgcctcgaagaaaatccagaatccttccattgcatgctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacct

SEQ ID NO: 187370 - DNA, 570 bp, Homo sapiens
  Payload ID: 16892
  Gene Symbol: SAE1
  Gene Name: SUMO1 activating enzyme subunit 1
  ENST ID: ENST00000597808
  CDS Start-End: 172-570
tccgcggacgaggtactgcgcaggcgtgggagggtctgcgcatgcgcagaagcactccgggcgtgctgccggcggcggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagca

SEQ ID NO: 187371 - DNA, 483 bp, Homo sapiens
  Payload ID: 16892
  Gene Symbol: SAE1
  Gene Name: SUMO1 activating enzyme subunit 1
  ENST ID: ENST00000600753
  CDS Start-End: 271-483
aggtggcgcgcgggtccggcgggcggttggcttgagcgggaccggagctgaggcaggaagagccggcgccatggtggagaaggaggaggctggcggcggcattagcgaggaggaggcggcacagtatgaccggcagatccgcctgtggggactggaggcccagaaacggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgta

SEQ ID NO: 187372 - DNA, 1831 bp, Homo sapiens
  Payload ID: 16892
  Gene Symbol: SAE1
  Gene Name: SUMO1 activating enzyme subunit 1
  ENST ID: ENST00000598840
  CDS Start-End: 94-891
ccgggcgtgctgccggcggcggtaggtggcgcgcgggtccggcgggcggttggcttgagcgggaccggagctgaggcaggaagagccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctaaggtggtcttctgccctgttaaagaagccctggaggtggactggagcagtgagaaagcaaaggctgctctgaagcgcacgacctccgactactttctccttcaagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttagga

SEQ ID NO: 187373 - DNA, 723 bp, Homo sapiens
  Payload ID: 16892
  Gene Symbol: SAE1
  Gene Name: SUMO1 activating enzyme subunit 1
  ENST ID: ENST00000594144
  CDS Start-End: 253-723
ggccgaggggaggcggaaatagccgaaaggagctgagcaggagcgaggaggcgacgggggagagccagaaagagctgaagacagggtctctctgtcgcgcagactagagtgcagtggtgtgatcacaactcacttcagccttgacttcttgggctcaggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggag

SEQ ID NO: 187374 - DNA, 709 bp, Homo sapiens
  Payload ID: 16892
  Gene Symbol: SAE1
  Gene Name: SUMO1 activating enzyme subunit 1
  ENST ID: ENST00000594526
  CDS Start-End: 415-709
gaaactgagacggtccggaaagagccgaaagcggtgtccgggtgggtggcaggaggtggaaacagccgaaagaaaagcagccaggttcctgggatggctctagggagggttatttacactgtgagtgaggaggcattcacagagaagttcctccagagtgtggaagaagcactaccatttggcaccaacgcctggagaacaaaggaggagaccattggccaaagagaggcatttccattttgttggaacctgctgaccaccaacccatagcattttttccctttcttccttgctaatccaatcgcagattcattgaggaggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatg

SEQ ID NO: 187375 - DNA, 2106 bp, Homo sapiens
  Payload ID: 16892
  Gene Symbol: SAE1
  Gene Name: SUMO1 activating enzyme subunit 1
  ENST ID: ENST00000596995
  CDS Start-End: 43-195
ggcttgagcgggaccggagctgaggcaggaagagccggcgccatggtggagaaggaggaggctggcggcggcattagcgaggaggaggcggcacagtatgaccggcagatccgcctgtggggactggaggcccagaaacggtcagggccggcgcggcttgaggccgctagggtctggagggggcgtctattctgaggcgtttgcggcccggaaggagcgggaaggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttagg

SEQ ID NO: 187376 - DNA, 4679 bp, Homo sapiens
  Payload ID: 16893
  Gene Symbol: SENP1
  Gene Name: SUMO1/sentrin specific peptidase 1
  Uniprot ID: Q9P0U3
  ENST ID: ENST00000448372
  CDS Start-End: 397-2331
gaggccgttccttctggtctctctctcctgggccgcggagagaccgtctccctgccgttacagcaggccccatcccagcgcccagccgtacttggggaaaggccggttgcgattccggggctttcccgccagagctgggtcttctctggggagagctgttttcaccgggaagctcggctttctgtggtaccggcttcatctcccgccttccttgagacccgagtgatatttcttgactacttctgcgtctcacgtaaacatttctccaactctcctactctgtggtatctccctgagatgtgatatcgctagtgccaccatcagaaagaaacgtctggaccctcctgctcaggactttgtatctttgctaaagtcagtgatgtgaaaagacttgaaatggatgatattgctgataggatgaggatggatgctggagaagtgactttagtgaaccacaactccgtattcaaaacccacctcctgccacaaacaggttttccagaggaccagctttcgctttctgaccagcagattttatcttccaggcaaggacatttggaccgatcttttacatgttccacaagaagtgcagcttataatccaagctattactcagataatccttcctcagacagttttcttggctcaggcgatttaagaacctttggccagagtgcaaatggccaatggagaaattctaccccatcgtcaagctcatctttacaaaaatcaagaaacagccgaagtctttacctcgaaacccgaaagacctcaagtggattatcaaacagttttgcgggaaagtcaaaccatcactgccatgtatctgcatatgaaaaatcttttcctattaaacctgttccaagtccatcttggagtggttcatgtcgtcgaagtcttttgagccccaagaaaactcagaggcgacatgttagtacagcagaagagacagttcaagaagaagaaagagagatttacagacagctgctacagatggtcacagggaaacagtttactatagccaaacccaccacacattttcctttacacctgtctcgatgtcttagttccagtaaaaatactttgaaagactcactgtttaaaaatggaaactcttgtgcatctcagatcattggctctgatacttcatcatctggatctgccagcattttaactaaccaggaacagctgtcccacagtgtatattccctatcttcttataccccagatgttgcatttggatccaaagattctggtactcttcatcatccccatcatcaccactctgttccacatcagccagataacttagcagcttcaaatacacaatctgaaggatcagactctgtgattttactgaaagtgaaagattcccagactccaactcccagttctactttcttccaggcagagctgtggatcaaagaattaactagtgtttatgattctcgagcacgagaaagattgcgccagattgaagaacagaaggcattggccttacagcttcaaaaccagagattgcaggagcgggaacattcagtacatgattcagtagaactacatcttcgtgtacctcttgaaaaggagattcctgttactgttgtccaagaaacacaaaaaaaaggtcataaattaactgatagtgaagatgaatttcctgaaattacagaggaaatggagaaagaaataaagaatgtatttcgtaatgggaatcaggatgaagttctcagtgaagcatttcgcctgaccattacacgcaaagatattcaaactctaaaccatctgaattggctcaatgatgagatcatcaatttctacatgaatatgctgatggagcgaagtaaagagaagggcttgccaagtgtgcatgcatttaatacctttttcttcactaaattaaaaacggctggttatcaggcagtgaaacgttggacaaagaaagtagatgtattttctgttgacattcttttggtgcccattcacctgggagtacactggtgtctagctgttgtggactttagaaagaagaatattacctattacgactccatgggtgggataaacaatgaagcctgcagaatactcttgcaatacctaaagcaagaaagcattgacaagaaaaggaaagagtttgacaccaatggctggcagcttttcagcaagaaaagccaggagattcctcagcagatgaatggaagtgactgtgggatgtttgcctgcaaatatgctgactgtattaccaaagacagaccaatcaacttcacacagcaacacatgccatacttccggaagcggatggtctgggagatcctccaccgaaaactcttgtgaagactgtctcacttagcagaccttgaccatgtgggggaccagctctttgttgtctacagccagagaccttggaaacagctgctcccagccctctgctgttgtaacacccttgatcctggaccaggccctggcgagatgcattcacaagcacatctgcctttccttttgtatctcagatactatttttgcaaagaaactttggtgctgtgaaaggggtgagggacatccctaagctgaagagagagactgcttttcacttcttcagttctgccatcttgttttcaaagggctccagcctcactcagtccctaattatgggactgagaaaagcttggaaagaatcttggtttcatataaattcttgttgttaggccttactaagaagtaggaaagggcatgggcaaaaggtagggataaaaaccaccagcatatacatggacatacacacacacccacacacacaaacacacacacacacacaattttcacgatgtatggtcaggaatgtgactgtaaactggactttggggcccaggcataagtcccttcctccaggacctttcctatttatatgtccctatacaaaatccatctgcttttatacgtagctgttttatcatctgtagcttcatcctatccggaggcacagcacatgagccctggacaggtcccaaagttccaagcagtcctttccgtgaaagcaggggtttgcatgtgctaccaacacatgatacggggaagacccacccagggagcggtttcagtggcgcaacaaagcaccacttttactgttgcctacttctgaccaagaagaaaaaggaccttagtatttagcataaaattccagcgctggatgaatgcagatctagtttggtctgtggctagtttaaatatgtttctaaccacagagaatttcatatatatatacatatatatatacacatacatatatatatatatatatgtatgtataaaatttcacagggatatgcttttttttttaaagactgaatgtgttcaccatttagcctgtagatttatttccattttccaaattccagcacacagagatcccagcccctatgagtagggtgtttgtggactacctaatggaatatttttgaggcctggatgaactttgccatatgggtagaggttacagagggaggtgatattttcagctaaaaaaaaaaacgggtggagtttggactgatcaacttgagatttaaaaactgctattccttttgttctttctagcatctctccccaccctctgagagctcctcaggcttagatagtgaagtgatcaaatgccagtgtcattttgtacttaagttccaaagtaggaacattttatacttttttctgtattgtaataggtagttttgtatgaaatcttttctcctctcccgttgtaccgcattctttccagcattgtgctttttccctgggcttatttgaaaattttactgttttatacaagctcgtttagtacatttttctatgttttaccacaagttacaatttgaaaagaaaactattttttttaaatattccattgttaactgaatgttactgtttccactccagcaactacatgtcctcccttcaactgcctgccttttggggaaagaccaccttttgtgtgtttgttttttctctctctttctttccctttctctttctatctctctttatttttctttctttttctttgtttttgagttttctataggaaataaatagctttctatatatgagttgctggggaccttcacattctcttttagaaagctgtggcatgcagtctcattgcaggactcctggaatattgtctggttcttggtatttactgtatgtaagcaacaacttgaaaggtggcaatatggtgtcgatttggactatgaatcaaaagacctttttcaggttctttcactattgtctgggggactcagaacaagattgttctctgtatttattgtttgtccatttaggtaacatctgtcttaccttcctcacagactttgtacagaccaaagcaacaaatatttattgccatgtatagcagaaaatgaaacatgcaacaaaagcactttgaaaaatatataaggaattgttgagcctgtctgaatttgggccccctttctgactaatgcagttttgcacaaggtagaagttagtgaccctgagaccatcttaccaccctggacctggtccaaatacagacttacacagtggaccattctttcctgagctagccaacaagagcaggagtagtatctggaaactttcccctttgtttaggggtaggctttgatgaccaggaaaaaaaaaaaggtatttctgca

SEQ ID NO: 187377 - DNA, 2260 bp, Homo sapiens
  Payload ID: 16893
  Gene Symbol: SENP1
  Gene Name: SUMO1/sentrin specific peptidase 1
  Uniprot ID: Q9P0U3
  ENST ID: ENST00000549518
  CDS Start-End: 326-2260
attccgagtacgagaaagcgaaaaagcccagactgaaaagggtactgagaaattacgactagtcttaaatgctcccttcgcttctcgggcctcgccacaccgcgcaggcgccccactggtccttaactctgttctttgacctcctgccccagccccctcctcttcagccacctagcgactcttccggtgctgtgaaggcggttccggttcgcggcggttcccgggttttgcgttccgcgcccggccggaaaccccttcgcatggcagccggttccggttcggactttgtatctttgctaaagtcagtgatgtgaaaagacttgaaatggatgatattgctgataggatgaggatggatgctggagaagtgactttagtgaaccacaactccgtattcaaaacccacctcctgccacaaacaggttttccagaggaccagctttcgctttctgaccagcagattttatcttccaggcaaggacatttggaccgatcttttacatgttccacaagaagtgcagcttataatccaagctattactcagataatccttcctcagacagttttcttggctcaggcgatttaagaacctttggccagagtgcaaatggccaatggagaaattctaccccatcgtcaagctcatctttacaaaaatcaagaaacagccgaagtctttacctcgaaacccgaaagacctcaagtggattatcaaacagttttgcgggaaagtcaaaccatcactgccatgtatctgcatatgaaaaatcttttcctattaaacctgttccaagtccatcttggagtggttcatgtcgtcgaagtcttttgagccccaagaaaactcagaggcgacatgttagtacagcagaagagacagttcaagaagaagaaagagagatttacagacagctgctacagatggtcacagggaaacagtttactatagccaaacccaccacacattttcctttacacctgtctcgatgtcttagttccagtaaaaatactttgaaagactcactgtttaaaaatggaaactcttgtgcatctcagatcattggctctgatacttcatcatctggatctgccagcattttaactaaccaggaacagctgtcccacagtgtatattccctatcttcttataccccagatgttgcatttggatccaaagattctggtactcttcatcatccccatcatcaccactctgttccacatcagccagataacttagcagcttcaaatacacaatctgaaggatcagactctgtgattttactgaaagtgaaagattcccagactccaactcccagttctactttcttccaggcagagctgtggatcaaagaattaactagtgtttatgattctcgagcacgagaaagattgcgccagattgaagaacagaaggcattggccttacagcttcaaaaccagagattgcaggagcgggaacattcagtacatgattcagtagaactacatcttcgtgtacctcttgaaaaggagattcctgttactgttgtccaagaaacacaaaaaaaaggtcataaattaactgatagtgaagatgaatttcctgaaattacagaggaaatggagaaagaaataaagaatgtatttcgtaatgggaatcaggatgaagttctcagtgaagcatttcgcctgaccattacacgcaaagatattcaaactctaaaccatctgaattggctcaatgatgagatcatcaatttctacatgaatatgctgatggagcgaagtaaagagaagggcttgccaagtgtgcatgcatttaatacctttttcttcactaaattaaaaacggctggttatcaggcagtgaaacgttggacaaagaaagtagatgtattttctgttgacattcttttggtgcccattcacctgggagtacactggtgtctagctgttgtggactttagaaagaagaatattacctattacgactccatgggtgggataaacaatgaagcctgcagaatactcttgcaatacctaaagcaagaaagcattgacaagaaaaggaaagagtttgacaccaatggctggcagcttttcagcaagaaaagccaggagattcctcagcagatgaatggaagtgactgtgggatgtttgcctgcaaatatgctgactgtattaccaaagacagaccaatcaacttcacacagcaacacatgccatacttccggaagcggatggtctgggagatcctccaccgaaaactcttgtga

SEQ ID NO: 187378 - DNA, 4967 bp, Homo sapiens
  Payload ID: 16893
  Gene Symbol: SENP1
  Gene Name: SUMO1/sentrin specific peptidase 1
  ENST ID: ENST00000552189
  CDS Start-End: 478-870
ggccgccggtggccgttaggctacctgaggccgttccttctggtctctctctcctgggccgcggagagaccgtctccctgccgttacagcaggccccatcccagcgcccagccgtacttggggaaaggccggttgcgattccggggctttcccgccagagctgggtcttctctggggagagctgttttcaccgggaagctcggctttctgtggtaccggcttcatctcccgccttccttgagacccgagtgatatttcttgactacttctgcgtctcacgtaaacatttctccaactctcctactctgtggtatctccctgagatgtgatatcgctagtgccaccatcagaaagaaacgtctggaccctcctgctcaggttatgaaaatccccttaactgccacaatttgcttacctggctcatcgcctcctggactttgtatctttgctaaagtcagtgatgtgaaaagacttgaaatggatgatattgctgataggatgaggatggatgctggagaagtgactttagtgaaccacaactccgtattcaaaacccacctcctgccacaaacaggttttccagaggaccagctttcgctttctgaccagcagattttatcttccaggcaaggacatttggaccgatcttttacatgttccacaagaagtgcagcttataatccaagctattactcaggcccaggcctgggagtgcttgcaagatatagttggggtaaaatgttgacttttggtggacaccacggagtcacattgatgcagataaggcacatggctgtggcaggattcagctccttcatcaattttcagataatccttcctcagacagttttcttggctcaggcgatttaagaacctttggccagagtgcaaatggccaatggagaaattctaccccatcgtcaagctcatctttacaaaaatcaagaaacagccgaagtctttacctcgaaacccgaaagacctcaagtggattatcaaacagttttgcgggaaagtcaaaccatcactgccatgtatctgcatatgaaaaatcttttcctattaaacctgttccaagtccatcttggagtggttcatgtcgtcgaagtcttttgagccccaagaaaactcagaggcgacatgttagtacagcagaagagacagttcaagaagaagaaagagagatttacagacagctgctacagatggtcacagggaaacagtttactatagccaaacccaccacacattttcctttacacctgtctcgatgtcttagttccagtaaaaatactttgaaagactcactgtttaaaaatggaaactcttgtgcatctcagatcattggctctgatacttcatcatctggatctgccagcattttaactaaccaggaacagctgtcccacagtgtatattccctatcttcttataccccagatgttgcatttggatccaaagattctggtactcttcatcatccccatcatcaccactctgttccacatcagccagataacttagcagcttcaaatacacaatctgaaggatcagactctgtgattttactgaaagtgaaagattcccagactccaactcccagttctactttcttccaggcagagctgtggatcaaagaattaactagtgtttatgattctcgagcacgagaaagattgcgccagattgaagaacagaaggcattggccttacagcttcaaaaccagagattgcaggagcgggaacattcagtacatgattcagtagaactacatcttcgtgtacctcttgaaaaggagattcctgttactgttgtccaagaaacacaaaaaaaaggtcataaattaactgatagtgaagatgaatttcctgaaattacagaggaaatggagaaagaaataaagaatgtatttcgtaatgggaatcaggatgaagttctcagtgaagcatttcgcctgaccattacacgcaaagatattcaaactctaaaccatctgaattggctcaatgatgagatcatcaatttctacatgaatatgctgatggagcgaagtaaagagaagggcttgccaagtgtgcatgcatttaatacctttttcttcactaaattaaaaacggctggttatcaggcagtgaaacgttggacaaagaaagtagatgtattttctgttgacattcttttggtgcccattcacctgggagtacactggtgtctagctgttgtggactttagaaagaagaatattacctattacgactccatgggtgggataaacaatgaagcctgcagaatactcttgcaatacctaaagcaagaaagcattgacaagaaaaggaaagagtttgacaccaatggctggcagcttttcagcaagaaaagccaggagattcctcagcagatgaatggaagtgactgtgggatgtttgcctgcaaatatgctgactgtattaccaaagacagaccaatcaacttcacacagcaacacatgccatacttccggaagcggatggtctgggagatcctccaccgaaaactcttgtgaagactgtctcacttagcagaccttgaccatgtgggggaccagctctttgttgtctacagccagagaccttggaaacagctgctcccagccctctgctgttgtaacacccttgatcctggaccaggccctggcgagatgcattcacaagcacatctgcctttccttttgtatctcagatactatttttgcaaagaaactttggtgctgtgaaaggggtgagggacatccctaagctgaagagagagactgcttttcacttcttcagttctgccatcttgttttcaaagggctccagcctcactcagtccctaattatgggactgagaaaagcttggaaagaatcttggtttcatataaattcttgttgttaggccttactaagaagtaggaaagggcatgggcaaaaggtagggataaaaaccaccagcatatacatggacatacacacacacccacacacacaaacacacacacacacacaattttcacgatgtatggtcaggaatgtgactgtaaactggactttggggcccaggcataagtcccttcctccaggacctttcctatttatatgtccctatacaaaatccatctgcttttatacgtagctgttttatcatctgtagcttcatcctatccggaggcacagcacatgagccctggacaggtcccaaagttccaagcagtcctttccgtgaaagcaggggtttgcatgtgctaccaacacatgatacggggaagacccacccagggagcggtttcagtggcgcaacaaagcaccacttttactgttgcctacttctgaccaagaagaaaaaggaccttagtatttagcataaaattccagcgctggatgaatgcagatctagtttggtctgtggctagtttaaatatgtttctaaccacagagaatttcatatatatatacatatatatatacacatacatatatatatatatatatgtatgtataaaatttcacagggatatgcttttttttttaaagactgaatgtgttcaccatttagcctgtagatttatttccattttccaaattccagcacacagagatcccagcccctatgagtagggtgtttgtggactacctaatggaatatttttgaggcctggatgaactttgccatatgggtagaggttacagagggaggtgatattttcagctaaaaaaaaaaacgggtggagtttggactgatcaacttgagatttaaaaactgctattccttttgttctttctagcatctctccccaccctctgagagctcctcaggcttagatagtgaagtgatcaaatgccagtgtcattttgtacttaagttccaaagtaggaacattttatacttttttctgtattgtaataggtagttttgtatgaaatcttttctcctctcccgttgtaccgcattctttccagcattgtgctttttccctgggcttatttgaaaattttactgttttatacaagctcgtttagtacatttttctatgttttaccacaagttacaatttgaaaagaaaactattttttttaaatattccattgttaactgaatgttactgtttccactccagcaactacatgtcctcccttcaactgcctgccttttggggaaagaccaccttttgtgtgtttgttttttctctctctttctttccctttctctttctatctctctttatttttctttctttttctttgtttttgagttttctataggaaataaatagctttctatatatgagttgctggggaccttcacattctcttttagaaagctgtggcatgcagtctcattgcaggactcctggaatattgtctggttcttggtatttactgtatgtaagcaacaacttgaaaggtggcaatatggtgtcgatttggactatgaatcaaaagacctttttcaggttctttcactattgtctgggggactcagaacaagattgttctctgtatttattgtttgtccatttaggtaacatctgtcttaccttcctcacagactttgtacagaccaaagcaacaaatatttattgccatgtatagcagaaaatgaaacatgcaacaaaagcactttgaaaaatatataaggaattgttgagcctgtctgaatttgggccccctttctgactaatgcagttttgcacaaggtagaagttagtgaccctgagaccatcttaccaccctggacctggtccaaatacagacttacacagtggaccattctttcctgagctagccaacaagagcaggagtagtatctggaaactttcccctttgtttaggggtaggctttgatgaccaggaaaaaaaaaaaggtatttctgcattttatggcccaaaggcatgttattaatatcttatgtaatttactttaaactaaataagacttttttctcctgtgt

SEQ ID NO: 187379 - DNA, 562 bp, Homo sapiens
  Payload ID: 16893
  Gene Symbol: SENP1
  Gene Name: SUMO1/sentrin specific peptidase 1
  ENST ID: ENST00000551798
  CDS Start-End: 136-562
tcgcatggcagccggttccggttcgagacaagattttgccttatttcccaggctggtctcgaactcctgggctcaagccattcgtctgcctcagcctcccaaagtgctagtattacagatgatattgctgataggatgaggatggatgctggagaagtgactttagtgaaccacaactccgtattcaaaacccacctcctgccacaaacaggttttccagaggaccagctttcgctttctgaccagcagattttatcttccaggcaaggacatttggaccgatcttttacatgttccacaagaagtgcagcttataatccaagctattactcagataatccttcctcagacagttttcttggctcaggcgatttaagaacctttggccagagtgcaaatggccaatggagaaattctaccccatcgtcaagctcatctttacaaaaatcaagaaacagccgaagtctttacctcgaaacccgaaagacctcaagtggattatcaaacagttttgcgggaaagtcaaaccatcactgccatgtatctgcatatgaaaaatctt

SEQ ID NO: 187380 - DNA, 1932 bp, Homo sapiens
  Payload ID: 16893
  Gene Symbol: SENP1
  Gene Name: SUMO1/sentrin specific peptidase 1
  Uniprot ID: Q9P0U3
  ENST ID: ENST00000549595
  CDS Start-End: 1-1932
atggatgatattgctgataggatgaggatggatgctggagaagtgactttagtgaaccacaactccgtattcaaaacccacctcctgccacaaacaggttttccagaggaccagctttcgctttctgaccagcagattttatcttccaggcaaggacatttggaccgatcttttacatgttccacaagaagtgcagcttataatccaagctattactcagataatccttcctcagacagttttcttggctcaggcgatttaagaacctttggccagagtgcaaatggccaatggagaaattctaccccatcgtcaagctcatctttacaaaaatcaagaaacagccgaagtctttacctcgaaacccgaaagacctcaagtggattatcaaacagttttgcgggaaagtcaaaccatcactgccatgtatctgcatatgaaaaatcttttcctattaaacctgttccaagtccatcttggagtggttcatgtcgtcgaagtcttttgagccccaagaaaactcagaggcgacatgttagtacagcagaagagacagttcaagaagaagaaagagagatttacagacagctgctacagatggtcacagggaaacagtttactatagccaaacccaccacacattttcctttacacctgtctcgatgtcttagttccagtaaaaatactttgaaagactcactgtttaaaaatggaaactcttgtgcatctcagatcattggctctgatacttcatcatctggatctgccagcattttaactaaccaggaacagctgtcccacagtgtatattccctatcttcttataccccagatgttgcatttggatccaaagattctggtactcttcatcatccccatcatcaccactctgttccacatcagccagataacttagcagcttcaaatacacaatctgaaggatcagactctgtgattttactgaaagtgaaagattcccagactccaactcccagttctactttcttccaggcagagctgtggatcaaagaattaactagtgtttatgattctcgagcacgagaaagattgcgccagattgaagaacagaaggcattggccttacagcttcaaaaccagagattgcaggagcgggaacattcagtacatgattcagtagaactacatcttcgtgtacctcttgaaaaggagattcctgttactgttgtccaagaaacacaaaaaaaaggtcataaattaactgatagtgaagatgaatttcctgaaattacagaggaaatggagaaagaaataaagaatgtatttcgtaatgggaatcaggatgaagttctcagtgaagcatttcgcctgaccattacacgcaaagatattcaaactctaaaccatctgaattggctcaatgatgagatcatcaatttctacatgaatatgctgatggagcgaagtaaagagaagggcttgccaagtgtgcatgcatttaatacctttttcttcactaaattaaaaacggctggttatcaggcagtgaaacgttggacaaagaaagtagatgtattttctgttgacattcttttggtgcccattcacctgggagtacactggtgtctagctgttgtggactttagaaagaagaatattacctattacgactccatgggtgggataaacaatgaagcctgcagaatactcttgcaatacctaaagcaagaaagcattgacaagaaaaggaaagagtttgacaccaatggctggcagcttttcagcaagaaaagccagattcctcagcagatgaatggaagtgactgtgggatgtttgcctgcaaatatgctgactgtattaccaaagacagaccaatcaacttcacacagcaacacatgccatacttccggaagcggatggtctgggagatcctccaccgaaaactcttgtga

SEQ ID NO: 187381 - DNA, 6308 bp, Homo sapiens
  Payload ID: 16894
  Gene Symbol: SENP5
  Gene Name: SUMO1/sentrin specific peptidase 5
  Uniprot ID: Q96HI0
  ENST ID: ENST00000323460
  CDS Start-End: 250-2517
gcaggcggaagggcgcggaggaggtgacgcgataggccagcgccggcgtcgcggcagccgcttcagaggaagctcggcggctgtggccgcggcgaacaggccggacgcctcgtcgctggcggggcttcccttggagctgacgaaggcggggtccgcggtccaggctgctgccgcgacggggccggcggcggggcagctgccaggaacgagggtagcagctgcatccagatctcattatgcatcagaaaaatgaaaaaacagaggaaaattctatggaggaaaggaatccacttagccttttctgagaaatggaatactgggtttggaggctttaagaagttttattttcaccaacacttgtgcattctgaaagctaagctgggaaggccagttacttggaatagacagttgagacatttccagggtagaaagaaagctcttcaaatccagaaaacgtggatcaaggatgaacccctttgtgctaagaccaagttcaatgtggctactcaaaatgttagtactttgtcctctaaagtgaaaagaaaggacgctaaacacttcatttcctcctcaaagactctcctgagactccaagcagagaagctgttgtcatcagcaaagaattctgaccatgaatactgcagagagaaaaatctcttgaaggcagttactgactttccatcaaatagtgctttaggtcaggccaatggtcacagacctaggacagacccacaaccttctgactttcccatgaagttcaatggggagagccaaagtccaggtgagagtggcacgattgtggtcaccttgaacaaccataagagaaagggcttttgttacggctgctgccaagggccggagcaccacaggaatgggggacccttgattccaaaaaagttccaacttaaccaacatagaaggataaaattatctcctcttatgatgtatgagaaattatccatgattagatttcggtacaggattctcagatcccagcacttcagaaccaaaagcaaggtttgcaagctaagaaaagcccagcgaagctgggtacagaaagtcactggggaccatcaagagacccgtagggagaacggtgagggtggcagttgcagcccatttccttccccagaacctaaagacccttcttgtcggcatcagccgtactttccagatatggacagcagtgctgtggtgaaggggacgaactctcatgtgcctgattgccacactaaaggaagctctttcttgggcaaggagcttagtttagacgaagcattccctgaccaacagaatggcagtgccacaaacgcctgggaccagtcatcctgttcttctcctaagtgggagtgtacagagctgattcatgacatccccttaccagaacatcgttctaataccatgttcatttcagaaactgaaagagaaattatgactctgggtcaggaaaatcagacaagttctgtcagtgatgacagagtaaaactgtcagtgtctggagcagatacatctgtgagtagcgtagatgggcctgtgtcccaaaaggctgttcaaaatgagaactcataccagatggaggaggatggatctctcaagcagagcattcttagttctgagttgctggaccacccttactgtaaaagtccactggaggctcccttggtgtgcagtggactcaaactagaaaatcaagtaggaggtggaaagaacagtcagaaagcctctccagtggatgatgaacagctgtcagtctgtctttctggattcctagatgaggttatgaagaagtatggcagtttggttccactcagtgaaaaagaagtccttggaagattaaaagatgtctttaatgaagacttttctaatagaaaaccatttatcaatagggaaataacaaactatcgggccagacatcaaaaatgtaacttccgtatcttctataataaacacatgctggatatggacgacctggcgactctggatggtcagaactggctgaatgaccaggtcattaatatgtatggtgagctgataatggatgcagtcccagacaaagttcacttcttcaacagcttttttcatagacagctggtaaccaaaggatataatggagtaaaaagatggactaaaaaggtggatttgtttaaaaagagtcttctgttgattcctattcacctggaagtccactggtctctcattactgtgacactctctaatcgaattatttcattttatgattcccaaggcattcattttaagttttgtgtagagaatataagaaagtatttgctgactgaagccagagaaaaaaatagacctgaatttcttcagggttggcagactgctgttacgaagtgtattccacaacagaaaaacgacagtgactgtggagtctttgtgctccagtactgcaagtgcctcgccttagagcagcctttccagttttcacaagaagacatgccccgagtgcggaagaggatttacaaggagctatgtgagtgccggctcatggactgaaactcagcagggactctgggaagtctgaccaagttggagcagatggtttgttacttgaatctccaaacacttagttgaatttttacagatatttcagatcagtggtgttgggccactattgttacctcaaatttattttttgcccttattcatttctccagctaccatgtactattgtttaatgttcagtttggtttcatttttaattttatggttctgtgcgtcccccatatttaatatttattattcaaacgcatgcatatagacagagcatgcagtgaagagtattaaaaaaaaaagcttagtagatttggtgcagcttttgaaacttagttagacgtgaactgaatacaggtttcaaatttactcccagaacctaaaaatgcaagatgtttttgatacaacataactctgagaatagtaagtgttccctggggcattaagggtagctgggggtggttttgacaaatccagtcctgttttactttaccagcggcaactttcaccaacttccctctccaagtgagtcttagagagtgcagtccattccttttgaagggtgagatggaagtggtcgtaaactgactggtgtcttctgtttctggaggcacacttgtaagcacagtggctgctttgggaggagtaaggtgtgagaaaaagcaaccttggaggccagtaacaatgacagatttcaatcgtggttttaggaattataatacgtggcatacatctcataaaggcttttgctgggatattgaattccctgaatttttctgttttcgacctgttaaaaaaatcttaacatccatcaaactagtggtcaaacaaatgagaatgcagctgttctcagagtaatttttaagttgtcatttccctgtgttgcctcccaattggaagaagttaaggtttaccaaatgcatttctatttcaagggtatctgaaacgtaaacattcaaaactgaaggctgactgacttgagatgttttgcaggtggctggagagaagagggaaggtaatagagacaacttagtcccatgggagcgcagcaaccgtgtcaggttctttctcctgtcccattagtgacctcagtaacatgcagggtacgtctggcttctgcatggccagtgctgacactagcacagctgttcttctccttctgttgaacctcatcttctgaagaaaggccaagtggcccttgtccatacacttagctgcattaggatgaatatcacgcgtctcacatctttaatccagcctttcgtgacatgttggaaagatacatgtgaaacctacccagttaccctttctgaattgggaggaaaaccaaccaatgtatgtatgagaaactcagaagtctgaatagaaaaacaaagtaaatggcagaagattctcgagtttatgcccgcgtaggtttggagtgttgaaaaagctaaaatgtttagtttcacttggccctgaggtatggttgagaaggctgactgccagcagttgaggattgagtccgaccatgtttacatgcagggttcccaacaccagtggtgacactgggaagcagccccagcactttcctctcctgagtcctccagacccaaaatccttaatgtcaaaccaggtcagtgtttcttactgtgtttcaagtcgttaaaaagactgagagtagaggcactttatgctgctataggtggggttctgtcagcgttaggaaaaaatgacagtttagggtaaggaagatctcataatgagtttttcaaacataattatgcaaacatgagatttttcaaaacatgccagaaatttgcctctgattttttttttttttttttttttttttttgtgggggtgtggtataccaaagtagccagtcactgggctgtcagttcaaaatgtcttgtacttcagagtgaggaagtgtttcagttcctcagtgacagaacctggcatgcagaagagacagaattgttcctgtaagaaaatcaacgccgagagagagctgcccaaatccagtgactcttccacttccagtctcatgcttcatagggcaccttgaggtgtgctgcccagtgtggcttagactaaatgttgagtttgggttttttgtttttttttttttttgagtcagagtctcactgtccctcaggctggagtgcaatggcgcaatcttgcctcactgcaacctccacctcccaggttcaagcgattctcctgcctcagcctcccaagtagctgggattacaggtgtgtgccaccacgccccaccgatttttgtacttttagtagagacaggatttcaccatgttggccaggctggtcttgaactcctgacctcaagtgatctgcccgcctgggcctcccaaagtgctgggattacaggcgggagccaccgtgcctggccaatgttaagtattttaaaagtcattttaaaatatttgtcattgatgaaacttggtttcagcacacgtaattgctttccctctcttcttgtgattaggtgtaaacctctatttaactcaagtcctagattagaatgtcctttgtcctgatgtttgcagtaattgcttccttggttaataaagatatttttgaaatatactctggactgttggtgaaagaggcaggcatggctttactggtactagtttggcactgaactgtttgggtgcccatgaggtaggcagaccttatgctttttttttttgagacggagtcttgctctgttgcccaggctggagtgcagtgatgtgatctcggctcactgcaacccctgcctcccaggttcaagtgattctcctgcctcagcttccccaatagctgggactacaggtgtgcgccaccactcccagctaatttttgtatttttagtagagacagggttttgccatgttggtcaggctggtctcggaactcctgacctcaggtgatccacccgcctctgcctcacaaagtgctgggattacaggcatgagctaccgtgcctggcctaaaccttacgcttttgaggttgagtgcaggccttgtgataactaagcgctacttttgacgagccttcaacaagctgcccagtcctctcctcagcagacgcatcaggttgtagttgcatctttacagtggtctttccttttattaaatctatagcagtgaatatagatttgattcaacttttagttacgttctctcaagaatcctaatcaactttcagttagcctcttaagaaagggaaaaaaaggtgctgccagtcatccccaaattatgtttttggctgtgcattctattttctacatagcactgaatctgagtaacagtcatcctggatttatagttggaacagaacagtaacagacctaactgggactcagccagcactagcctcatcttagctgccccttttctctgctttgcagtttactgcttccctgggctagccataacggggttctgggcaggtcagactcttcagcaagacagtgtattaatagtgtgaattagatacactgatgacctgctctgcctagttaagaaactgaattaatcagcagttacaaagcacatactttgttacgtgctaggctttgcctcctggcctctagataattaagacggcccagggaataccagcagagaagtgctaattgtatttgggtgttacaaaagcagacctagacgagctgttcacttaactggtacctgttggtcagaaaaagaatttatttagagattatgatcatgtaaaattacagtactcaacccttctagcaaagtatttttttgaaaaataaactaaatgcctttataaa

SEQ ID NO: 187382 - DNA, 2491 bp, Homo sapiens
  Payload ID: 16894
  Gene Symbol: SENP5
  Gene Name: SUMO1/sentrin specific peptidase 5
  Uniprot ID: Q96HI0
  ENST ID: ENST00000445299
  CDS Start-End: 250-2379
gcaggcggaagggcgcggaggaggtgacgcgataggccagcgccggcgtcgcggcagccgcttcagaggaagctcggcggctgtggccgcggcgaacaggccggacgcctcgtcgctggcggggcttcccttggagctgacgaaggcggggtccgcggtccaggctgctgccgcgacggggccggcggcggggcagctgccaggaacgagggtagcagctgcatccagatctcattatgcatcagaaaaatgaaaaaacagaggaaaattctatggaggaaaggaatccacttagccttttctgagaaatggaatactgggtttggaggctttaagaagttttattttcaccaacacttgtgcattctgaaagctaagctgggaaggccagttacttggaatagacagttgagacatttccagggtagaaagaaagctcttcaaatccagaaaacgtggatcaaggatgaacccctttgtgctaagaccaagttcaatgtggctactcaaaatgttagtactttgtcctctaaagtgaaaagaaaggacgctaaacacttcatttcctcctcaaagactctcctgagactccaagcagagaagctgttgtcatcagcaaagaattctgaccatgaatactgcagagagaaaaatctcttgaaggcagttactgactttccatcaaatagtgctttaggtcaggccaatggtcacagacctaggacagacccacaaccttctgactttcccatgaagttcaatggggagagccaaagtccaggtgagagtggcacgattgtggtcaccttgaacaaccataagagaaagggcttttgttacggctgctgccaagggccggagcaccacaggaatgggggacccttgattccaaaaaagttccaacttaaccaacatagaaggataaaattatctcctcttatgatgtatgagaaattatccatgattagatttcggtacaggattctcagatcccagcacttcagaaccaaaagcaaggtttgcaagctaagaaaagcccagcgaagctgggtacagaaagtcactggggaccatcaagagacccgtagggagaacggtgagggtggcagttgcagcccatttccttccccagaacctaaagacccttcttgtcggcatcagccgtactttccagatatggacagcagtgctgtggtgaaggggacgaactctcatgtgcctgattgccacactaaaggaagctctttcttgggcaaggagcttagtttagacgaagcattccctgaccaacagaatggcagtgccacaaacgcctgggaccagtcatcctgttcttctcctaagtgggagtgtacagagctgattcatgacatccccttaccagaacatcgttctaataccatgttcatttcagaaactgaaagagaaattatgactctgggtcaggaaaatcagacaagttctgtcagtgatgacagagtaaaactgtcagtgtctggagcagatacatctgtgagtagcgtagatgggcctgtgtcccaaaaggctgttcaaaatgagaactcataccagatggaggaggatggatctctcaagcagagcattcttagttctgagttgctggaccacccttactgtaaaagtccactggaggctcccttggtgtgcagtggactcaaactagaaaatcaagtaggaggtggaaagaacagtcagaaagcctctccagtggatgatgaacagctgtcagtctgtctttctggattcctagatgaggttatgaagaagtatggcagtttggttccactcagtgaaaaagaagtccttggaagattaaaagatgtctttaatgaagacttttctaatagaaaaccatttatcaatagggaaataacaaactatcgggccagacatcaaaaatgtaacttccgtatcttctataataaacacatgctggatatggacgacctggcgactctggatggtcagaactggctgaatgaccaggtcattaatatgtatggtgagctgataatggatgcagtcccagacaaagttcacttcttcaacagcttttttcatagacagctggtaaccaaaggatataatggagtaaaaagatggactaaaaagaatataagaaagtatttgctgactgaagccagagaaaaaaatagacctgaatttcttcagggttggcagactgctgttacgaagtgtattccacaacagaaaaacgacagtgactgtggagtctttgtgctccagtactgcaagtgcctcgccttagagcagcctttccagttttcacaagaagacatgccccgagtgcggaagaggatttacaaggagctatgtgagtgccggctcatggactgaaactcagcagggactctgggaagtctgaccaagttggagcagatggtttgttacttgaatctccaaacacttagttgaatttttacagatatttcagatcagtggtgttggg

SEQ ID NO: 187383 - DNA, 973 bp, Homo sapiens
  Payload ID: 16894
  Gene Symbol: SENP5
  Gene Name: SUMO1/sentrin specific peptidase 5
  ENST ID: ENST00000419026
  CDS Start-End: 147-884
cggcgaacaggccggacgcctcgtcgctggcggggcttcccttggagctgacgaaggcggggtccgcggtccaggctgctgccgcgacggggccggcggcggggcagctgccaggaacgagggtagcaggattcctagatgaggttatgaagaagtatggcagtttggttccactcagtgaaaaagaagtccttggaagattaaaagatgtctttaatgaagacttttctaatagaaaaccatttatcaatagggaaataacaaactatcgggccagacatcaaaaatgtaacttccgtatcttctataataaacacatgctggatatggacgacctggcgactctggatggtcagaactggctgaatgaccaggtcattaatatgtatggtgagctgataatggatgcagtcccagacaaagttcacttcttcaacagcttttttcatagacagctggtaaccaaaggatataatggagtaaaaagatggactaaaaaggtggatttgtttaaaaagagtcttctgttgattcctattcacctggaagtccactggtctctcattactgtgacactctctaatcgaattatttcattttatgattcccaaggcattcattttaagttttgtgtagagaatataagaaagtatttgctgactgaagccagagaaaaaaatagacctgaatttcttcagggttggcagactgctgttacgaagtgtattccacaacagaaaaacgacagtgactgtggagtctttgtgctccagtactgcaagtgcctcgccttagagcagcctttccagttttcacaagaagacatgccccgagtgcggaagaggatttacaaggagctatgtgagtgccggctcatggactgaaactcagcagggactctgggaagtctgaccaagttggagcagatggtttgttacttgaatctccaaacacttagttgaatttttacaga

SEQ ID NO: 187384 - DNA, 484 bp, Homo sapiens
  Payload ID: 16894
  Gene Symbol: SENP5
  Gene Name: SUMO1/sentrin specific peptidase 5
  ENST ID: ENST00000448068
  CDS Start-End: 1-296
atttgtttaaaaagagtcttctgttgattcctattcacctggaagtccactggtctctcattactgtgacactctctaatcgaattatttcattttatgattcccaaggcattcattttaagttttgtgtagagtgtattccacaacagaaaaacgacagtgactgtggagtctttgtgctccagtactgcaagtgcctcgccttagagcagcctttccagttttcacaagaagacatgccccgagtgcggaagaggatttacaaggagctatgtgagtgccggctcatggactgaaactcagcagggactctgggaagtctgaccaagttggagcagatggtttgttacttgaatctccaaacacttagttgaatttttacagatatttcagatcagtggtgttgggccactattgttacctcaaatttattttttgcccttattcatttctccagctaccatgtactattgtttaatgttca

SEQ ID NO: 187385 - DNA, 622 bp, Homo sapiens
  Payload ID: 16894
  Gene Symbol: SENP5
  Gene Name: SUMO1/sentrin specific peptidase 5
  ENST ID: ENST00000434433
  CDS Start-End: 1-233
tgctgactgaagccagagaaaaaaatagacctgaatttcttcagggttggcagactgctgttacgaagtgtattccacaacagaaaaacgacagtgactgtggagtctttgtgctccagtactgcaagtgcctcgccttagagcagcctttccagttttcacaagaagacatgccccgagtgcggaagaggatttacaaggagctatgtggctggagagaagagggaaggtaatagagacaacttagtcccatgggagcgcagcaaccgtgtcaggttctttctcctgtcccattagtgacctcagtaacatgcagggtacgtctggcttctgcatggccagtgctgacactagcacagctgttcttctccttctgttgaacctcatcttctgaagaaaggccaagtggcccttgtccatacacttagctgcattaggatgaatatcacgcgtctcacatctttaatccagcctttcgtgacatgttggaaagatacatgtgaaacctacccagttaccctttctgaattgggaggaaaaccaaccaatgtatgtatgagaaactcagaagtctgaatagaaaaacaaagtaaatggcagaagattctcgagtttatgcccg

SEQ ID NO: 187386 - DNA, 2700 bp, Homo sapiens
  Payload ID: 16895
  Gene Symbol: SENP6
  Gene Name: SUMO1/sentrin specific peptidase 6
  ENST ID: ENST00000327284
  CDS Start-End: 599-2656
agaggagacccacccctgtccacatggacagtcgcaaaggcctccgctgatgcattcacgcctgggcggggtgggcggacggccgtagcggcggcggctgcagaacgagctaggggcctgggggcgcctgacggtcgcagagacctcgccgctccggcgcggcgggtgcggccattttacggcctgggacgaagggaggcgtgtttgtgtgctcgctttcattctcctttcttgggaacccacggctgggggaagtttctcaggcagcctgggtgggcggtggatggggagtcgtgggccgagaggaaccgggcccgggaagcgccgtcgtcgtcgtcgccggtcgcgttcccccggagaggcctgagaagctcgggccgcgggcctcgctgcccgccagcccgcggacaggcccgggcgcgcctggcctgcctttgtataggcccgtctgaacgtgggagcgcagcccgcctgacggctgagcccgaggcccgcaaccctgcggcgtctaccctcctccggcgcggcccctcatcccggcgagcacggcggcggtgtgggccatggattaagaaggaggcggcgtgggaggaggaagatggcggccggcaagagcggcggtagcgcaggggagattacttttctggaagctttggctagatcagagtctaagagagatggaggttttaaaaataattggagctttgatcatgaagaagaaagtgaaggagatacagataaagatgggacaaatctgctcagtgtggatgaagatgaggattctgaaacctcaaaaggaaaaaagttaaatcgtcgatctgaaattgttgctaatagctctggtgaattcatcttgaagacatatgtaagacgaaacaagtctgaaagttttaaaactttgaaaggcaacccaattggacttaacatgttgagcaacaataagaaattgagtgaaaatacgcaaaatacgtcattatgttctggaactgtagttcatggtagacgttttcatcatgctcatgcacagataccagtagtaaaaacagcagcccaaaggaaagaatacccacctcatgtccaaaaagttgaaattaatcctgtaaggttaagtcggctccaaggtgttgaacgtataatgaagaaaacagaagagtccgaatcacaagtggagcctgaaattaagaggaaagtacaacagaaacgacactgtagtacctatcagcctactcctcctctatctcctgcttcaaaaaaatgtttaacccatttagaggatttgcaaagaaattgcagacaagctattactttgaatgagtctactggaccattattaagaacgtcaattcatcagaattctggaggacagaagtcacaaaacacaggattaacaaccaagaagttttatggcaacaatgtggaaaaggttccaattgatattattgtgaattgtgatgacagtaaacacacttatttacagactaatggaaaagtcattttacctggggcaaaaatacccaaaatcacaaacttgaaagaaaggaaaacaagtttgtcagacctaaatgatccaatcattttgtccagtgatgatgatgatgacaacgacagaactaacagaagagaaagcatatctcctcagcctgctgattcagcatgttcttcccctgcaccatccactggaaaagtagaagcagcgctaaatgaaaatacttgcagagcagagcgtgaactacgaagcattccagaagactcagagttaaatacagttacattgccaagaaaagcaagaatgaaagaccagtttggcaattctattatcaacacacctctgaaacgtcgtaaagtgttttctcaagaacctccagatgctttagctttaagctgccaaagttcctttgacagtgtcattttaaactgtcgaagtatacgagtaggaacactcttccggctgttaatagagcctgtaattttttgtttagattttatcaagatacagctagacgaaccagaccatgatcctgtagagattatattaaatacctctgatctaactaaatgtgaatggtgtaatgtccgaaaattacctgtagtgtttcttcaagcaattccagcagtttatcaaaagctgagcatccaactgcaaatgaataaggaggataaagtttggaatgattgtaaaggagtaaataaattaacaaatttagaagaacaatatataattttaatttttcaaaatggccttgatcctccggcaaatatggtatttgaaagtatcattaatgaaattggtataaagaataacatctccaatttttttgcgaaaattccctttgaagaagctaatggcagacttgttgcctgtacaagaacctatgaagagagcatcaaaggaagttgtgggcaaaaggaaaacaaaattaaaactgtatcatttgaatctaaaatacaacttagaagcaaacaagaatttcagttttttgatgaagaagaagaaactggagaaaaccacaccatcttcattggcccagtagaaaagttgatagtatatccaccacctccagctaagggaggcatctctgttaccaatgaggacctgcactgtctaaatgaaggagaatttttaaatgatgttattatagacttttatttgaagtaagttaattttccactgatcttttattaaatctttaacattccgtc

SEQ ID NO: 187387 - DNA, 4644 bp, Homo sapiens
  Payload ID: 16895
  Gene Symbol: SENP6
  Gene Name: SUMO1/sentrin specific peptidase 6
  Uniprot ID: Q9GZR1
  ENST ID: ENST00000370010
  CDS Start-End: 1017-4334
actaccttttctcttcggttggctgtagtttaaattctaaggtctcctcaagaaatgacattttcacatttcttaggcatctgtggtgccagaggagcaaacccatcgcacacgccaggtctgccatggggccctgggcggtggggattttggatgtaacgtgtctaggccgagcccgcgccgtgaaaggcctaccctgccgaaagcccgggcggcgggcgcccacaagtcagggctcggtgcggcgccgcagccagctctgcccgcgagccgagtccgggctgctgagggggagccgcgctgggggcggcggcgtcggggcgggggcgggagccgggcggcagctccagcgcccgtgggggaggagcggcagcggcggcggctggagctgctgtggcgaccgacgcgaggcggtggcagaggagacccacccctgtccacatggacagtcgcaaaggcctccgctgatgcattcacgcctgggcggggtgggcggacggccgtagcggcggcggctgcagaacgagctaggggcctgggggcgcctgacggtcgcagagacctcgccgctccggcgcggcgggtgcggccattttacggcctgggacgaagggaggcgtgtttgtgtgctcgctttcattctcctttcttgggaacccacggctgggggaagtttctcaggcagcctgggtgggcggtggatggggagtcgtgggccgagaggaaccgggcccgggaagcgccgtcgtcgtcgtcgccggtcgcgttcccccggagaggcctgagaagctcgggccgcgggcctcgctgcccgccagcccgcggacaggcccgggcgcgcctggcctgcctttgtataggcccgtctgaacgtgggagcgcagcccgcctgacggctgagcccgaggcccgcaaccctgcggcgtctaccctcctccggcgcggcccctcatcccggcgagcacggcggcggtgtgggccatggattaagaaggaggcggcgtgggaggaggaagatggcggccggcaagagcggcggtagcgcaggggagattacttttctggaagctttggctagatcagagtctaagagagatggaggttttaaaaataattggagctttgatcatgaagaagaaagtgaaggagatacagataaagatgggacaaatctgctcagtgtggatgaagatgaggattctgaaacctcaaaaggaaaaaagttaaatcgtcgatctgaaattgttgctaatagctctggtgaattcatcttgaagacatatgtaagacgaaacaagtctgaaagttttaaaactttgaaaggcaacccaattggacttaacatgttgagcaacaataagaaattgagtgaaaatacgcaaaatacgtcattatgttctggaactgtagttcatggtagacgttttcatcatgctcatgcacagataccagtagtaaaaacagcagcccaaaggaaagaatacccacctcatgtccaaaaagttgaaattaatcctgtaaggttaagtcggctccaaggtgttgaacgtataatgaagaaaacagaagagtccgaatcacaagtggagcctgaaattaagaggaaagtacaacagaaacgacactgtagtacctatcagcctactcctcctctatctcctgcttcaaaaaaatgtttaacccatttagaggatttgcaaagaaattgcagacaagctattactttgaatgagtctactggaccattattaagaacgtcaattcatcagaattctggaggacagaagtcacaaaacacaggattaacaaccaagaagttttatggcaacaatgtggaaaaggttccaattgatattattgtgaattgtgatgacagtaaacacacttatttacagactaatggaaaagtcattttacctggggcaaaaatacccaaaatcacaaacttgaaagaaaggaaaacaagtttgtcagacctaaatgatccaatcattttgtccagtgatgatgatgatgacaacgacagaactaacagaagagaaagcatatctcctcagcctgctgattcagcatgttcttcccctgcaccatccactggaaaagtagaagcagcgctaaatgaaaatacttgcagagcagagcgtgaactacgaagcattccagaagactcagagttaaatacagttacattgccaagaaaagcaagaatgaaagaccagtttggcaattctattatcaacacacctctgaaacgtcgtaaagtgttttctcaagaacctccagatgctttagctttaagctgccaaagttcctttgacagtgtcattttaaactgtcgaagtatacgagtaggaacactcttccggctgttaatagagcctgtaattttttgtttagattttatcaagatacagctagacgaaccagaccatgatcctgtagagattatattaaatacctctgatctaactaaatgtgaatggtgtaatgtccgaaaattacctgtagtgtttcttcaagcaattccagcagtttatcaaaagctgagcatccaactgcaaatgaataaggaggataaagtttggaatgattgtaaaggagtaaataaattaacaaatttagaagaacaatatataattttaatttttcaaaatggccttgatcctccggcaaatatggtatttgaaagtatcattaatgaaattggtataaagaataacatctccaatttttttgcgaaaattccctttgaagaagctaatggcagacttgttgcctgtacaagaacctatgaagagagcatcaaaggaagttgtgggcaaaaggaaaacaaaattaaaactgtatcatttgaatctaaaatacaacttagaagcaaacaagaatttcagttttttgatgaagaagaagaaactggagaaaaccacaccatcttcattggcccagtagaaaagttgatagtatatccaccacctccagctaagggaggcatctctgttaccaatgaggacctgcactgtctaaatgaaggagaatttttaaatgatgttattatagacttttatttgaaatacttggtgcttgaaaaactgaagaaggaagacgctgaccgaattcatatattcagttcttttttctataaacgccttaatcagagagagaggagaaatcatgaaacaactaatctgtcaatacagcaaaaacggcatgggagagtaaaaacatggacccggcacgtagatatttttgagaaggattttatttttgtaccccttaatgaagctgcacactggtttttggctgttgtttgtttccccggtttggaaaaaccaaagtatgaacctaatcctcattaccatgaaaatgctgtcatacagaaatgttcaactgtagaggacagttgtatttcttcttcagccagtgaaatggagagttgttcacaaaactcttctgccaagcctgtaattaagaagatgctaaacaaaaaacattgcatagctgtaattgattccaatcctgggcaggaagaaagtgaccctcgttataagagaaacatatgcagtgtaaaatacagtgtgaaaaaaataaatcatactgcgagtgaaaatgaagaattcaataaaggagaatctacatcccagaaagttgctgataggactaaaagtgagaatggcctacagaatgaaagtttaagttccacacatcatacagatggcttaagcaaaatcagactaaactatagcgatgaatcacctgaagctggtaaaatgcttgaagatgaactcgtcgacttctcagaagatcaggataaccaggatgatagcagtgacgatggattcctcgctgatgacaactgcagttcagaaataggacagtggcatttaaagcctactatctgtaaacaaccttgtatcctacttatggactcactccgaggcccttctcggtcaaatgttgtcaaaattttaagagagtatttagaagtggaatgggaagttaaaaaaggaagcaaaagaagtttttccaaagatgttatgaagggctctaatccaaaagtaccacagcaaaacaacttcagtgactgtggtgtatatgtattgcagtatgtagagagcttttttgagaatccaattctcagttttgaactacctatgaatttggcaaactggtttcctccaccaagaatgagaacaaaaagagaagaaatccgaaacataattctgaagctacaggaagatcagagcaaagagaaaagaaagcataaggacacttactcaacagaagcacctttaggcgaaggaacagaacaatatgtcaatagtatctcagattgaccatttctgttacttgtcatttctactttcagaaactaaatgactttcaaatttgggtatagacaataaagaactgaagtgctcactactcagtgatttggaaattttgatgcttgtataaatgtcagataattaatttccaaaggcgtatgtattaagtaaaagtctgtaaatatgttaatgaggccaatttttccagcatttataattatttttttcacttgttaggaagcttttgttatgtattttctgttaatagtacctaaaattgcaacttctaaacacaaataaaaagaaaatatttatagga

SEQ ID NO: 187388 - DNA, 2685 bp, Homo sapiens
  Payload ID: 16895
  Gene Symbol: SENP6
  Gene Name: SUMO1/sentrin specific peptidase 6
  ENST ID: ENST00000424947
  CDS Start-End: 1-1749
ttgagcaacaataagaaattgagtgaaaatacgcaaaatacgtcattatgttctggaactgtagttcatggtagacgttttcatcatgctcatgcacagataccagtagtaaaaacagcagcccaaagcagtctggaccgaaaagaaaggaaagaatacccacctcatgtccaaaaagttgaaattaatcctgtaaggttaagtcggctccaaggtgttgaacgtataatgaagaaaacagaagagtccgaatcacaagtggagcctgaaattaagaggaaagtacaacagaaacgacactgtagtacctatcagcctactcctcctctatctcctgcttcaaaaaaatgtttaacccatttagaggatttgcaaagaaattgcagacaagctattactttgaatgagtctactggaccattattaagaacgtcaattcatcagaattctggaggacagaagtcacaaaacacaggattaacaaccaagaagttttatggcaacaatgtggaaaaggttccaattgatattattgtgaattgtgatgacagtaaacacacttatttacagactaatggaaaagtcattttacctggggcaaaaatacccaaaatcacaaacttgaaagaaaggaaaacaagtttgtcagacctaaatgatccaatcattttgtccagtgatgatgatgatgacaacgacagaactaacagaagagaaagcatatctcctcagcctgctgattcagcatgttcttcccctgcaccatccactggaaaagtagaagcagcgctaaatgaaaatacttgcagagcagagcgtgaactacgaagcattccagaagactcagagttaaatacagttacattgccaagaaaagcaagaatgaaagaccagtttggcaattctattatcaacacacctctgaaacgtcgtaaagtgttttctcaagaacctccagatgctttagctttaagctgccaaagttcctttgacagtgtcattttaaactgtcgaagtatacgagtaggaacactcttccggctgttaatagagcctgtaattttttgtttagattttatcaagatacagctagacgaaccagaccatgatcctgtagagattatattaaatacctctgatctaactaaatgtgaatggtgtaatgtccgaaaattacctgtagtgtttcttcaagcaattccagcagtttatcaaaagctgagcatccaactgcaaatgaataaggaggataaagtttggaatgattgtaaaggagtaaataaattaacaaatttagaagaacaatatataattttaatttttcaaaatggccttgatcctccggcaaatatggtatttgaaagtatcattaatgaaattggtataaagaataacatctccaatttttttgcgaaaattccctttgaagaagctaatggcagacttgttgcctgtacaagaacctatgaagagagcatcaaaggaagttgtgggcaaaaggaaaacaaaattaaaactgtatcatttgaatctaaaatacaacttagaagcaaacaagaatttcagttttttgatgaagaagaagaaactggagaaaaccacaccatcttcattggcccagtagaaaagttgatagtatatccaccacctccagctaagggaggcatctctgttaccaatgaggacctgcactgtctaaatgaaggagaatttttaaatgatgttattatagacttttatttgaagtaagttaattttccactgatcttttattaaatctttaacattccgtcatatcttatgtctttgttttccagagtcaggctttttgagttttaaattccatctctgccacttactgtgtgacatttggggagttattttttctgtttctgtctttgcacattttaaaaatgagaattctatctaaaaagttgtgaaaattgggccagggagatatctggcttatgtctataatcctgacactttgggaggtcaaggtgggaggatcgcttgagcccaagagttcacgaccagcctgggaaacaaagtgagaccttgtctccacaaaaaatttaaaaattagccagtcatatacctatagtcccagccacttgggaggctcagacaggaagattacctgagcccatgagttcgaagttgcactgagccatgatggcgccactgcactccagcctggtcaacaaagcaaaactctacccccacacccacccccgaaaacaggagttgtgagaattaaatgagatcgtacatatcaagtagtaggaaaaatgcctagtacagtgttagaagtttatggtcttgtaggaagcacaaatacagaattaaagcaatgatagaagcattaacatggtacagtcctagcagatgagagaatgcttcattatctttggaggttgggagatatgagggaccaggaagctttcctggaagagcttacattatgacccaatatacattatgacccaacataacacatgtatacacctatgtgcaatgtgtttatacatttatcaatttgtatgtttttactggtttgtgatataaaatggacatgtatatgaaataaaacagaacttagcatcagtatgcatagttctctgtaatattttctagtttcttatactgtgtttcattaaacaaaacaaaacttttaaaaattga

SEQ ID NO: 187389 - DNA, 6501 bp, Homo sapiens
  Payload ID: 16895
  Gene Symbol: SENP6
  Gene Name: SUMO1/sentrin specific peptidase 6
  Uniprot ID: Q9GZR1
  ENST ID: ENST00000447266
  CDS Start-End: 479-3817
ggggcgcctgacggtcgcagagacctcgccgctccggcgcggcgggtgcggccattttacggcctgggacgaagggaggcgtgtttgtgtgctcgctttcattctcctttcttgggaacccacggctgggggaagtttctcaggcagcctgggtgggcggtggatggggagtcgtgggccgagaggaaccgggcccgggaagcgccgtcgtcgtcgtcgccggtcgcgttcccccggagaggcctgagaagctcgggccgcgggcctcgctgcccgccagcccgcggacaggcccgggcgcgcctggcctgcctttgtataggcccgtctgaacgtgggagcgcagcccgcctgacggctgagcccgaggcccgcaaccctgcggcgtctaccctcctccggcgcggcccctcatcccggcgagcacggcggcggtgtgggccatggattaagaaggaggcggcgtgggaggaggaagatggcggccggcaagagcggcggtagcgcaggggagattacttttctggaagctttggctagatcagagtctaagagagatggaggttttaaaaataattggagctttgatcatgaagaagaaagtgaaggagatacagataaagatgggacaaatctgctcagtgtggatgaagatgaggattctgaaacctcaaaaggaaaaaagttaaatcgtcgatctgaaattgttgctaatagctctggtgaattcatcttgaagacatatgtaagacgaaacaagtctgaaagttttaaaactttgaaaggcaacccaattggacttaacatgttgagcaacaataagaaattgagtgaaaatacgcaaaatacgtcattatgttctggaactgtagttcatggtagacgttttcatcatgctcatgcacagataccagtagtaaaaacagcagcccaaagcagtctggaccgaaaagaaaggaaagaatacccacctcatgtccaaaaagttgaaattaatcctgtaaggttaagtcggctccaaggtgttgaacgtataatgaagaaaacagaagagtccgaatcacaagtggagcctgaaattaagaggaaagtacaacagaaacgacactgtagtacctatcagcctactcctcctctatctcctgcttcaaaaaaatgtttaacccatttagaggatttgcaaagaaattgcagacaagctattactttgaatgagtctactggaccattattaagaacgtcaattcatcagaattctggaggacagaagtcacaaaacacaggattaacaaccaagaagttttatggcaacaatgtggaaaaggttccaattgatattattgtgaattgtgatgacagtaaacacacttatttacagactaatggaaaagtcattttacctggggcaaaaatacccaaaatcacaaacttgaaagaaaggaaaacaagtttgtcagacctaaatgatccaatcattttgtccagtgatgatgatgatgacaacgacagaactaacagaagagaaagcatatctcctcagcctgctgattcagcatgttcttcccctgcaccatccactggaaaagtagaagcagcgctaaatgaaaatacttgcagagcagagcgtgaactacgaagcattccagaagactcagagttaaatacagttacattgccaagaaaagcaagaatgaaagaccagtttggcaattctattatcaacacacctctgaaacgtcgtaaagtgttttctcaagaacctccagatgctttagctttaagctgccaaagttcctttgacagtgtcattttaaactgtcgaagtatacgagtaggaacactcttccggctgttaatagagcctgtaattttttgtttagattttatcaagatacagctagacgaaccagaccatgatcctgtagagattatattaaatacctctgatctaactaaatgtgaatggtgtaatgtccgaaaattacctgtagtgtttcttcaagcaattccagcagtttatcaaaagctgagcatccaactgcaaatgaataaggaggataaagtttggaatgattgtaaaggagtaaataaattaacaaatttagaagaacaatatataattttaatttttcaaaatggccttgatcctccggcaaatatggtatttgaaagtatcattaatgaaattggtataaagaataacatctccaatttttttgcgaaaattccctttgaagaagctaatggcagacttgttgcctgtacaagaacctatgaagagagcatcaaaggaagttgtgggcaaaaggaaaacaaaattaaaactgtatcatttgaatctaaaatacaacttagaagcaaacaagaatttcagttttttgatgaagaagaagaaactggagaaaaccacaccatcttcattggcccagtagaaaagttgatagtatatccaccacctccagctaagggaggcatctctgttaccaatgaggacctgcactgtctaaatgaaggagaatttttaaatgatgttattatagacttttatttgaaatacttggtgcttgaaaaactgaagaaggaagacgctgaccgaattcatatattcagttcttttttctataaacgccttaatcagagagagaggagaaatcatgaaacaactaatctgtcaatacagcaaaaacggcatgggagagtaaaaacatggacccggcacgtagatatttttgagaaggattttatttttgtaccccttaatgaagctgcacactggtttttggctgttgtttgtttccccggtttggaaaaaccaaagtatgaacctaatcctcattaccatgaaaatgctgtcatacagaaatgttcaactgtagaggacagttgtatttcttcttcagccagtgaaatggagagttgttcacaaaactcttctgccaagcctgtaattaagaagatgctaaacaaaaaacattgcatagctgtaattgattccaatcctgggcaggaagaaagtgaccctcgttataagagaaacatatgcagtgtaaaatacagtgtgaaaaaaataaatcatactgcgagtgaaaatgaagaattcaataaaggagaatctacatcccagaaagttgctgataggactaaaagtgagaatggcctacagaatgaaagtttaagttccacacatcatacagatggcttaagcaaaatcagactaaactatagcgatgaatcacctgaagctggtaaaatgcttgaagatgaactcgtcgacttctcagaagatcaggataaccaggatgatagcagtgacgatggattcctcgctgatgacaactgcagttcagaaataggacagtggcatttaaagcctactatctgtaaacaaccttgtatcctacttatggactcactccgaggcccttctcggtcaaatgttgtcaaaattttaagagagtatttagaagtggaatgggaagttaaaaaaggaagcaaaagaagtttttccaaagatgttatgaagggctctaatccaaaagtaccacagcaaaacaacttcagtgactgtggtgtatatgtattgcagtatgtagagagcttttttgagaatccaattctcagttttgaactacctatgaatttggcaaactggtttcctccaccaagaatgagaacaaaaagagaagaaatccgaaacataattctgaagctacaggaagatcagagcaaagagaaaagaaagcataaggacacttactcaacagaagcacctttaggcgaaggaacagaacaatatgtcaatagtatctcagattgaccatttctgttacttgtcatttctactttcagaaactaaatgactttcaaatttgggtatagacaataaagaactgaagtgctcactactcagtgatttggaaattttgatgcttgtataaatgtcagataattaatttccaaaggcgtatgtattaagtaaaagtctgtaaatatgttaatgaggccaatttttccagcatttataattatttttttcacttgttaggaagcttttgttatgtattttctgttaatagtacctaaaattgcaacttctaaacacaaataaaaagaaaatatttataggaggaaatgattaatttgatattctttagtgaacttgtttaattcctcagtgggtgtgacatatttcatgggaatattcaaatatctatggtaatattttgaccctttatatttgttctaaaataagtcaaaatgtgaaaataatattaaatctaagatattttgaactaagcatctttatatgcttgtgtaacaggaacaaagtaacagcctttcaattcatatactgccttgtgttcagtgaacccaagaaatgtaataaatatttgtaattttacacaaatatttaagaggaaagagtattaagagcaattcaaaaaaagtaaccttatactactaaaaaaaaaattcttgcatatattatcatcaaatgcatttttgaagacatcaaagactcaggttaaaactattttggtaagtgcagcttgaatttcaaatatcccgtgttacctttctctattacagcttaaagtatgctacaatctgtgtcatatagttaattgataagcatttttaatctgtgtaaacacaggaatttaaataggaatttactatttttttataaagcttttgctattttttcattgctcattttgttcttattattttgataaagtatcagactttttgcttgagttcttcagtgtaaattattttttacatgtaaaagtactgtattcaaccagttgcataatacagcaaaaatctttgaattcccctttaaaataactaaaatttgatggtttccatgacagatttatagcacatatagggatcttgcatgtatctgcagaaacttcattatttttcaaatgaaatggtgtatacttctttcaaatgaactttgagacttgaaacatattttagtcattttttgttaaatattgaatttttaaatacacatatatcaaaaatagttgagaataaaaagaaagcctaatcatcagcaattattttatttttaatttggccatctctgacattgcagtcaatatcttagggtattttcttgaatttaataaagtcccatgggtgggttcagggtgaatgggagtattaacaacaaccaaaaaatatctattgagacacagtagagtctcagtaagagaaatattaaaatgtaagaaaggtcaccattagtgatatcaactgtagtttgttactttgaactatatttctgattaactctttatagtaataacttagagctgttagctcagatatcttaattagctcatatgaaaaacaagtttaattttattatttactgaacatggcaaaatgcttttcaatctataataaaactgggataaaaaattgaagttgttttttttaaaacctaatagcaataagcaaaattggcatacataatttttttaatgaactatattttgtcagaatctgaaggtactgaaaaactattctaaaatgcctacttgtttttgcattaatttgtaatgcttacattttgcacccttagataatgtttgataagataaaaatataatttatcccttgtaccaactcaagtcaatcagattttaacatgaaaaatatagattaatgtatgtcagctttctagaggtagaatactcagctatttgatggcatttttcccaccccatgtgaaattttatttttggaagttatgctagtgacattgcaatatatattgaaatcttcggaggctgccaggttgagcttcaaaactagacttgagaatctttcgtgtatatgcacattcacttgataattgtgtattctatgtagtttaaagtgggatcaagccttttaaaatgtgttattagtacttagaagttgtaaaacagaacttatagaggtttgttactagacactgaaactgcatgacaagtatctggtgtcttaactaattagatagatctgttgtattggttttcttgttggatagaataacagttaatcatttttagaagagttttagattacttgccataaaatttgtatgtctcagctcttgttggtttaggagcagaagtggtgtttagtcccttcccgttaatgttgctgtgctacttcagacagctgaaaacttaatggtattatttcaagttcacataaccctaaaaaaggttttctttgtgtagtaacttgtgcttaaacttttagtcaattaaatgtaggaggttttatttgaaaacataaaatgattctctaaattacatcttgttttaagccaccaaaatgaatgcagtaatttttctttaaaaaaatgatctctgaaaactgtgagacaatgtaaaaagaataagttttaattcccccaaaatcaaaaattgtacttaaaatctcagacaattcactgaacaggaataataaagaacatattttaatata

SEQ ID NO: 187390 - DNA, 2041 bp, Homo sapiens
  Payload ID: 16895
  Gene Symbol: SENP6
  Gene Name: SUMO1/sentrin specific peptidase 6
  ENST ID: ENST00000503501
  CDS Start-End: 1-1166
tacgaagcattccagaagactcagagttaaatacagttacattgccaagaaaagcaagaatgaaagaccagtttggcaattctattatcaacacacctctgaaacgtcgtaaagtgttttctcaagaacctccagatgctttagctttaagctgccaaagttcctttgacagtgtcattttaaactgtcgaagtatacgagtaggaacactcttccggctgttaatagagcctgtaattttttgtttagattttatcaagatacagctagacgaaccagaccatgatcctgtagagattatattaaatacctctgatctaactaaatgtgaatggtgtaatgtccgaaaattacctgtagtgtttcttcaagcaattccagcagtttatcaaaagctgagcatccaactgcaaatgaataaggaggataaagtttggaatgattgtaaaggagtaaataaattaacaaatttagaagaacaatatataattttaatttttcaaaatggccttgatcctccggcaaatatggtatttgaaagtatcattaatgaaattggtataaagaataacatctccaatttttttgcgaaaattccctttgaagaagctaatggcagacttgttgcctgtacaagaacctatgaagagagcatcaaaggaagttgtgggcaaaaggaaaacaaaattaaaactgtatcatttgaatctaaaatacaacttagaagcaaacaagaatttcagttttttgatgaagaagaagaaactggagaaaaccacaccatcttcattggcccagtagaaaagttgatagtatatccaccacctccagctaagggaggcatctctgttaccaatgaggacctgcactgtctaaatgaaggagaatttttaaatgatgttattatagacttttatttgaaatacttggtgcttgaaaaactgaagaaggaagacgctgaccgaattcatatattcagttcttttttctataaacgccttaatcagagagagaggagaaatcatgaaacaactaatctgtcaatacagcaaaaacggcatgggagagtaaaaacatggacccggcacgtagatatttttgagaaggattttatttttgtaccccttaatgaagcatggcttaagcaaaatcagactaaactatagcgatgaatcacctgaagctggtaaaatgcttgaagatgaactcgtcgacttctcagaagatcaggataaccaggatgatagcagtgacgatggattcctcgctgatgacaactgcagttcagaaataggacagtggcatttaaagcctactatctgtaaacaaccttgtatcctacttatggactcactccgaggcccttctcggtcaaatgttgtcaaaattttaagagagtatttagaagtggaatgggaagttaaaaaaggaagcaaaagaagtttttccaaagatgttatgaagggctctaatccaaaagtaccacagcaaaacaacttcagtgactgtggtgtatatgtattgcagtatgtagagagcttttttgagaatccaattctcagttttgaactacctatgaatttggcaaactggtttcctccaccaagaatgagaacaaaaagagaagaaatccgaaacataattctgaagctacaggaagatcagagcaaagagaaaagaaagcataaggacacttactcaacagaagcacctttaggcgaaggaacagaacaatatgtcaatagtatctcagattgaccatttctgttacttgtcatttctactttcagaaactaaatgactttcaaatttgggtatagacaataaagaactgaagtgctcactactcagtgatttggaaattttgatgcttgtataaatgtcagataattaatttccaaaggcgtatgtattaagtaaaagtctgtaaatatgttaatgaggccaatttttccagcatttataattatttttttcacttgttaggaagcttttgttatgtattttctgttaatagtacctaaaattgcaacttctaaac

SEQ ID NO: 187391 - DNA, 867 bp, Homo sapiens
  Payload ID: 16895
  Gene Symbol: SENP6
  Gene Name: SUMO1/sentrin specific peptidase 6
  ENST ID: ENST00000493959
  CDS Start-End: 302-526
gccgagaggaaccgggcccgggaagcgccgtcgtcgtcgtcgccggtcgcgttcccccggagaggcctgagaagctcgggccgcgggcctcgctgcccgccagcccgcggacaggcccgggcgcgcctggcctgcctttgtataggcccgtctgaacgtgggagcgcagcccgcctgacggctgagcccgaggcccgcaaccctgcggcgtctaccctcctccggcgcggcccctcatcccggcgagcacggcggcggtgtgggccatggattaagaaggaggcggcgtgggaggaggaagatggcggccggcaagagcggcggtagcgcaggggagattacttttctggaagctttggctagatcagagtctaagagagatggaggttttaaaaataattggagctttgatcatgaagaagaaagtgaaggagatacagataaagagtgcttcacttctgtctgggcaacagctccgttcatcattaccactttatgtgccttcaccgatgagatgttgatttgaagttttatttgaaggagagctttgaactgtgggacaaatctgctcagtgtggatgaagatgaggattctgaaacctcaaaaggaaaaaagttaaatcgtcgatctgaaattgttgctaatagctctggtgaattcatcttgaagacatatgtaagacgaaacaagtctgaaagttttaaaactttgaaaggcaacccaattggacttaacatgttgagcaacaataagaaattgagtgaaaatacgcaaaatacgtcattatgttctggaactgtagttcatggtagacgttttcatcatgctcatgcacagataccagtagtaaaaacagcagcccaaag

SEQ ID NO: 187392 - DNA, 1013 bp, Homo sapiens
  Payload ID: 16895
  Gene Symbol: SENP6
  Gene Name: SUMO1/sentrin specific peptidase 6
  ENST ID: ENST00000483859
  CDS Start-End: 354-1013
tactttatttgtctttagttcaactcagaaagccagagccaagcttaagacatcagaattatccccactgcctcttcactttggctagatcagagtctaagagagatggaggttttaaaaataattggagctttgatcatgaagaagaaagtgaaggagatacagataaagatgggacaaatctgctcagtgtggatgaagatgaggattctgaaacctcaaaaggaaaaaagttaaatcgtcgatctgaaattgttgctaatagctctggtgaattcatcttgaagacatatgtaagacgaaacaagtctgaaagttttaaaactttgaaaggcaacccaattggacttaacatgttgagcaacaataagaaattgagtgaaaatacgcaaaatacgtcattatgttctggaactgtagttcatggtagacgttttcatcatgctcatgcacagataccagtagtaaaaacagcagcccaaagtctggaccgaaaagaaaggaaagaatacccacctcatgtccaaaaagttgaaattaatcctgtaaggttaagtcggctccaaggtgttgaacgtataatgaagaaaacagaagagtccgaatcacaagtggagcctgaaattaagaggaaagtacaacagaaacgacactgtagtacctatcagcctactcctcctctatctcctgcttcaaaaaaatgtttaacccatttagaggatttgcaaagaaattgcagacaagctattactttgaatgagtctactggaccattattaagaacgtcaattcatcagaattctggaggacagaagtcacaaaacacaggattaacaaccaagaagttttatggcaacaatgtggaaaaggttccaattgatattattgtgaattgtgatgacagtaaacacacttatttacagactaatggaaaagtcattttacctggggcaaaaatacccaaaatcacaaacttgaaagaaaggaaaacaagtttgtcagacctaaatgat

SEQ ID NO: 187393 - DNA, 4736 bp, Homo sapiens
  Payload ID: 16896
  Gene Symbol: SENP7
  Gene Name: SUMO1/sentrin specific peptidase 7
  Uniprot ID: Q9BQF6
  ENST ID: ENST00000314261
  CDS Start-End: 112-3066
ttttttttttttttttttttttttttttcctttcccctccccctccctctccaagccggaggggtcctgaggtgacagcgcctgcaactgaaatttcagcagcgggagaagatggacaagagaaagctcgggcgacggccatcttcatccgaaatcatcacagaaggaaaaaggaaaaagtcatcttctgatttatcggagataagaaagatgttaaatgcaaaaccagaggatgtccatgttcaatcaccactgtccaaattcagaagctcagaacgctggactctccctttgcagtgggaaagaagcctaaggaataaagtcatctctctagaccataaaaataaaaaacatatccgagggtgtcctgttacttccaagtcatcaccagaaaggatacccagagttatattgacgaatgtcctgggaacggagttaggaagaaaatacataaggaccccacctgtaactgagggaagtttgagtgatacagacaacttgcaatcagagcaactttcttcatcatctgatggcagcctagaatcttatcaaaatctaaaccctcacaagagctgttatttatctgaaaggggctcacaacgaagtaagacagtagatgacaattctgcaaagcagactgcgcacaataaagaaaaacgaagaaaggatgatggcatttctcttttaatatctgatactcagcctgaagaccttaacagtggaagtagaggttgtgatcatctcgaacaggaaagcagaaacaaggatgttaaatattctgattcaaaagtggaactcactctgatttccaggaagacaaagagaaggcttagaaataatttacctgattctcaatattgtacttctttggataagtcaacagaacagacaaaaaaacaagaagatgactcaacaatatccactgagtttgaaaagccaagtgaaaactatcatcaggatccaaaactgcctgaagaaattacaactaaacctacaaaaagtgattttactaaactatcctcacttaacagtcaggagttgactttgagtaatgccaccaaaagtgcctctgccggttcaaccactgaaaccgttgagaactctaattccattgatattgtggggatttcttccctggttgagaaggatgagaatgagttgaataccatagaaaagcctattctaagaggacataatgaagggaaccaatcactgatctcagctgaaccaattgttgtttccagtgatgaagaaggacctgttgaacataaaagttcagaaattcttaagttacaatctaagcaagaccgtgagacaactaatgaaaatgagagtacttctgaatcagcattgttagaactaccattgattacatgtgaatctgtacagatgtcatctgaattatgcccatataatcctgtcatggagaacatttccagtattatgcctagtaatgagatggatctacaactggattttatatttacttctgtttatattggtaaaataaaaggagcttctaaaggttgtgttacaatcacaaaaaaatatattaagatcccatttcaagtgtccctgaatgagatttcattgctagtggataccacacatttaaagcggtttgggttatggaaaagtaaggatgataatcacagtaaaaggagtcatgctattcttttcttctgggtctcttcagattatcttcaagagattcagacccaattagaacactctgtattaagccagcaatcaaaatctagtgaattcattttccttgaactacacaatcctgtttcacaaagagaagaattgaagctgaaagatattatgacggaaataagtataatcagtggagaattagagctttcttacccgttgtcttgggttcaggcatttcctttgtttcagaacctctcttcaaaagaaagttcttttattcattattactgtgtttcaacttgttctttccctgctggtgttgctgttgctgaagaaatgaagctgaaatcagtatctcagccctcaaacacagatgcggccaagcctacttacaccttcctgcagaagcaaagtagcggttgctactccctttctattacatctaatccagatgaagaatggcgagaagtcaggcacactggacttgttcagaagttgattgtatatcctccaccacctactaaggggggattaggagtaactaatgaagatctggagtgtttagaagaaggagagtttcttaatgatgtaatcattgatttttaccttaagtatcttatattggagaaggcatcagatgaacttgttgaacgaagtcacatttttagtagctttttctataaatgcttgacaagaaaggaaaataatttaacagaagataatccaaatctttcaatggcacagagaagacataaaagagtaagaacatggactcgtcacataaacatttttaataaagattacatctttgtacctgtaaatgagtcgtctcactggtatctcgcagtcatttgttttccatggttagaagaagctgtgtatgaagattttccacaaactgtatcccagcagtcccaggctcagcagtcccaaaatgacaacaaaacaatagataatgatctacgtactacttcgacactgtctttgagtgcagaggattcccaaagtaccgagtcgaatatgtcagtaccaaagaaaatgtgtaaaaggccatgtattcttatactagactccttgaaagctgcttctgtacaaaacacagttcagaatttacgagagtatttagaggtagagtgggaagttaaactaaaaactcatcgtcaattcagcaaaacaaacatggtggatctatgccctaaagttcctaaacaggacaatagcagtgattgtggagtatatttattgcagtatgtggaaagcttcttcaaggatcctattgttaactttgaacttccaattcatttggagaagtggtttcctcgtcatgtaataaagaccaaacgggaagatattcgagagctcatcttgaaacttcatttacagcaacagaagggcagcagtagctagttaatctgtacaaacatgacacagatgttctctaagattactggaaagcctcttaccagcatttgtgttagccagctcacagagaagaaaataacttgcagtagttttataataagtcattggaacattatttaaaatatgtaggacacattattagaattgttgggatctcatagatggaatgggaatgggggtgatatagataaacttactagatataaattaaaattttataaatatttcatatttttctgagtaaatatgattggattatgcaacagcatatgtaatatgggaatgttttgtagataataaaacttacatgatctgtacttccacgtgactgggtgctgaggggagttaaagcctccctggtgccagccccagtgcttgtcaaatttgctgacaggtcacatcatattgtaattctattctttgcagctcaagcatgcagtatgaatactgtgtattttttaaaaaaataatttagtatcaaggcttcagaaaatgccatttacggcatcccttctgtatgtaacaaaaagacattcataatgttaggaagatgataaaaattcgctcttttaaagtgcagcttattattctcaattgctaaatacgattactctgctttttttttttcatttcttttgatgtcatatgtgagtatcttataatttagttcatttgttcagggtaaaatttgaaacaaaaaattttacctgtgcaaaatagttttttaaaaattatacatgtagctcaacttgaggtactgctatataaatattcactcacattatcacggaatttatgtatagtttctctaatatagaagataaaattggtgtcctcataactttaacaaagaaaaccctcagtcctatttattaatgggtagaattaaatatataattttatagctcagtttacccagtattcatctgcaaagccagattgctctcattgcttttatatttttaaattgtagcttttagagacctatgatcctcatggaacttaattttttattaaatattcaggtaacagttctgaattcatgtgataatggtggcattatatatgattaaacacttcagaactttctaatgttatcaggagtattttgagggagatatgattatattgtattttctcagataagaaaaatgttttttaacaatattattttaatctgttttaagcatctcttagatttacattataactacataaagcagtgaagcaaaggcaaattaagataaagctagaaagtctgaacattttatttcaaaatcatacgaatcggggtcagttaagcctcagtattcttagcttttgttgattttggcactatctttatattattaaatatatttgttgtttggatatttcatataaagatggctataattacatatttcattcccaatttgtgtgtgttggggggtacttttaaaggtgactattgttttgtacatctaattttgggaaagcaagtctataagacatcttgtgatttcttaatgtttttgtttgtatgtttttcaaagatatcactgtcctttatcatgttttgaagattgtttaaaattcattttcctaaattaatgtgcaagtaatgttttgaggatatcagtgttttatattaaacatatttccaattcattaaa

SEQ ID NO: 187394 - DNA, 3272 bp, Homo sapiens
  Payload ID: 16896
  Gene Symbol: SENP7
  Gene Name: SUMO1/sentrin specific peptidase 7
  Uniprot ID: Q9BQF6
  ENST ID: ENST00000348610
  CDS Start-End: 143-3196
ttttttttttcctttcccctccccctccctctccaagccggaggggtcctgaggtgacagcgcctgcaactgaaatttcagcagcgggagaagatggacaagagaaagctcgggcgacggccatcttcatccgataagaaagatgttaaatgcaaaaccagaggatgtccatgttcaatcaccactgtccaaattcagaagctcagaacgctggactctccctttgcagtgggaaagaagcctaaggaataaagtcatctctctagaccataaaaataaaaaacatatccgagggtgtcctgttacttccaagtcatcaccagaaaggcaactcaaagttatgttgacgaatgtcctatggacggatttaggacgaaaattcagaaagaccctacctagaaacgatgctaatttatgtgatgccaacaaggtgcaatcagactcattgccttcgacatctgttgacagcctagagacatgtcaaaaattagaacctcttcgccaaagccttaatttatctgaaaggatacccagagttatattgacgaatgtcctgggaacggagttaggaagaaaatacataaggaccccacctgtaactgagggaagtttgagtgatacagacaacttgcaatcagagcaactttcttcatcatctgatggcagcctagaatcttatcaaaatctaaaccctcacaagagctgttatttatctgaaaggggctcacaacgaagtaagacagtagatgacaattctgcaaagcagactgcgcacaataaagaaaaacgaagaaaggatgatggcatttctcttttaatatctgatactcagcctgaagaccttaacagtggaagtagaggttgtgatcatctcgaacaggaaagcagaaacaaggatgttaaatattctgattcaaaagtggaactcactctgatttccaggaagacaaagagaaggcttagaaataatttacctgattctcaatattgtacttctttggataagtcaacagaacagacaaaaaaacaagaagatgactcaacaatatccactgagtttgaaaagccaagtgaaaactatcatcaggatccaaaactgcctgaagaaattacaactaaacctacaaaaagtgattttactaaactatcctcacttaacagtcaggagttgactttgagtaatgccaccaaaagtgcctctgccggttcaaccactgaaaccgttgagaactctaattccattgatattgtggggatttcttccctggttgagaaggatgagaatgagttgaataccatagaaaagcctattctaagaggacataatgaagggaaccaatcactgatctcagctgaaccaattgttgtttccagtgatgaagaaggacctgttgaacataaaagttcagaaattcttaagttacaatctaagcaagaccgtgagacaactaatgaaaatgagagtacttctgaatcagcattgttagaactaccattgattacatgtgaatctgtacagatgtcatctgaattatgcccatataatcctgtcatggagaacatttccagtattatgcctagtaatgagatggatctacaactggattttatatttacttctgtttatattggtaaaataaaaggagcttctaaaggttgtgttacaatcacaaaaaaatatattaagatcccatttcaagtgtccctgaatgagatttcattgctagtggataccacacatttaaagcggtttgggttatggaaaagtaaggatgataatcacagtaaaaggagtcatgctattcttttcttctgggtctcttcagattatcttcaagagattcagacccaattagaacactctgtattaagccagcaatcaaaatctagtgaattcattttccttgaactacacaatcctgtttcacaaagagaagaattgaagctgaaagatattatgacggaaataagtataatcagtggagaattagagctttcttacccgttgtcttgggttcaggcatttcctttgtttcagaacctctcttcaaaagaaagttcttttattcattattactgtgtttcaacttgttctttccctgctggtgttgctgttgctgaagaaatgaagctgaaatcagtatctcagccctcaaacacagatgcggccaagcctacttacaccttcctgcagaagcaaagtagcggttgctactccctttctattacatctaatccagatgaagaatggcgagaagtcaggcacactggacttgttcagaagttgattgtatatcctccaccacctactaaggggggattaggagtaactaatgaagatctggagtgtttagaagaaggagagtttcttaatgatgtaatcattgatttttaccttaagtatcttatattggagaaggcatcagatgaacttgttgaacgaagtcacatttttagtagctttttctataaatgcttgacaagaaaggaaaataatttaacagaagataatccaaatctttcaatggcacagagaagacataaaagagtaagaacatggactcgtcacataaacatttttaataaagattacatctttgtacctgtaaatgagtcgtctcactggtatctcgcagtcatttgttttccatggttagaagaagctgtgtatgaagattttccacaaactgtatcccagcagtcccaggctcagcagtcccaaaatgacaacaaaacaatagataatgatctacgtactacttcgacactgtctttgagtgcagaggattcccaaagtaccgagtcgaatatgtcagtaccaaagaaaatgtgtaaaaggccatgtattcttatactagactccttgaaagctgcttctgtacaaaacacagttcagaatttacgagagtatttagaggtagagtgggaagttaaactaaaaactcatcgtcaattcagcaaaacaaacatggtggatctatgccctaaagttcctaaacaggacaatagcagtgattgtggagtatatttattgcagtatgtggaaagcttcttcaaggatcctattgttaactttgaacttccaattcatttggagaagtggtttcctcgtcatgtaataaagaccaaacgggaagatattcgagagctcatcttgaaacttcatttacagcaacagaagggcagcagtagctagttaatctgtacaaacatgacacagatgttctctaagattactggaaagcctcttaccagcatttgtgttagccagc

SEQ ID NO: 187395 - DNA, 1483 bp, Homo sapiens
  Payload ID: 16896
  Gene Symbol: SENP7
  Gene Name: SUMO1/sentrin specific peptidase 7
  Uniprot ID: Q9BQF6
  ENST ID: ENST00000394085
  CDS Start-End: 364-1080
actcagcccattgagttttaaaacctccctaatgacagatataacagttggagaattctgttaaggtttaatgacagtattttatatcatgcccagatggagctaagcaaaataagtagatttaactgtgtttatactaagttgcacagccagttttggaatctgaaaagcatttaataaattgctgcctttattctgtccatttcattattgtttatagttattaaatttaagaataaccaggggttactataaggagatatatttataatgtgttaaatatgatatatcttaaagaagatggttaaactaaatttaagatatttcaatatataaaaatggctcttgaagtccctatcttaaatgaaaaaatttttatatatcaaatctgtctttcatactctcagaatggcacagagaagacataaaagagtaagaacatggactcgtcacataaacatttttaataaagattacatctttgtacctgtaaatgagtcgtctcactggtatctcgcagtcatttgttttccatggttagaagaagctgtgtatgaagattttccacaaactgtatcccagcagtcccaggctcagcagtcccaaaatgacaacaaaacaatagataatgatctacgtactacttcgacactgtctttgagtgcagaggattcccaaagtaccgagtcgaatatgtcagtaccaaagaaaatgtgtaaaaggccatgtattcttatactagactccttgaaagctgcttctgtacaaaacacagttcagaatttacgagagtatttagaggtagagtgggaagttaaactaaaaactcatcgtcaattcagcaaaacaaacatggtggatctatgccctaaagttcctaaacaggacaatagcagtgattgtggagtatatttattgcagtatgtggaaagcttcttcaaggatcctattgttaactttgaacttccaattcatttggagaagtggtttcctcgtcatgtaataaagaccaaacgggaagatattcgagagctcatcttgaaacttcatttacagcaacagaagggcagcagtagctagttaatctgtacaaacatgacacagatgttctctaagattactggaaagcctcttaccagcatttgtgttagccagctcacagagaagaaaataacttgcagtagttttataataagtcattggaacattatttaaaatatgtaggacacattattagaattgttgggatctcatagatggaatgggaatgggggtgatatagataaacttactagatataaattaaaattttataaatatttcatatttttctgagtaaatatgattggattatgcaacagcatatgtaatatgggaatgttttgtagataataaaacttacatgatctgtacttccacgtgactgggtgctgaggggagttaaagcctccctggtgccagccccagtgcttgtcaaatttgc

SEQ ID NO: 187396 - DNA, 4434 bp, Homo sapiens
  Payload ID: 16896
  Gene Symbol: SENP7
  Gene Name: SUMO1/sentrin specific peptidase 7
  Uniprot ID: Q9BQF6
  ENST ID: ENST00000394091
  CDS Start-End: 104-2764
ggaggggtcctgaggtgacagcgcctgcaactgaaatttcagcagcgggagaagatggacaagagaaagctcgggcgacggccatcttcatccgataagaaagatgttaaatgcaaaaccagaggatgtccatgttcaatcaccactgtccaaattcagaagctcagaacgctggactctccctttgcagtgggaaagaagcctaaggaataaagtcatctctctagaccataaaaataaaaaacatatccgagggtgtcctgttacttccaagtcatcaccagaaaggggctcacaacgaagtaagacagtagatgacaattctgcaaagcagactgcgcacaataaagaaaaacgaagaaaggatgatggcatttctcttttaatatctgatactcagcctgaagaccttaacagtggaagtagaggttgtgatcatctcgaacaggaaagcagaaacaaggatgttaaatattctgattcaaaagtggaactcactctgatttccaggaagacaaagagaaggcttagaaataatttacctgattctcaatattgtacttctttggataagtcaacagaacagacaaaaaaacaagaagatgactcaacaatatccactgagtttgaaaagccaagtgaaaactatcatcaggatccaaaactgcctgaagaaattacaactaaacctacaaaaagtgattttactaaactatcctcacttaacagtcaggagttgactttgagtaatgccaccaaaagtgcctctgccggttcaaccactgaaaccgttgagaactctaattccattgatattgtggggatttcttccctggttgagaaggatgagaatgagttgaataccatagaaaagcctattctaagaggacataatgaagggaaccaatcactgatctcagctgaaccaattgttgtttccagtgatgaagaaggacctgttgaacataaaagttcagaaattcttaagttacaatctaagcaagaccgtgagacaactaatgaaaatgagagtacttctgaatcagcattgttagaactaccattgattacatgtgaatctgtacagatgtcatctgaattatgcccatataatcctgtcatggagaacatttccagtattatgcctagtaatgagatggatctacaactggattttatatttacttctgtttatattggtaaaataaaaggagcttctaaaggttgtgttacaatcacaaaaaaatatattaagatcccatttcaagtgtccctgaatgagatttcattgctagtggataccacacatttaaagcggtttgggttatggaaaagtaaggatgataatcacagtaaaaggagtcatgctattcttttcttctgggtctcttcagattatcttcaagagattcagacccaattagaacactctgtattaagccagcaatcaaaatctagtgaattcattttccttgaactacacaatcctgtttcacaaagagaagaattgaagctgaaagatattatgacggaaataagtataatcagtggagaattagagctttcttacccgttgtcttgggttcaggcatttcctttgtttcagaacctctcttcaaaagaaagttcttttattcattattactgtgtttcaacttgttctttccctgctggtgttgctgttgctgaagaaatgaagctgaaatcagtatctcagccctcaaacacagatgcggccaagcctacttacaccttcctgcagaagcaaagtagcggttgctactccctttctattacatctaatccagatgaagaatggcgagaagtcaggcacactggacttgttcagaagttgattgtatatcctccaccacctactaaggggggattaggagtaactaatgaagatctggagtgtttagaagaaggagagtttcttaatgatgtaatcattgatttttaccttaagtatcttatattggagaaggcatcagatgaacttgttgaacgaagtcacatttttagtagctttttctataaatgcttgacaagaaaggaaaataatttaacagaagataatccaaatctttcaatggcacagagaagacataaaagagtaagaacatggactcgtcacataaacatttttaataaagattacatctttgtacctgtaaatgagtcgtctcactggtatctcgcagtcatttgttttccatggttagaagaagctgtgtatgaagattttccacaaactgtatcccagcagtcccaggctcagcagtcccaaaatgacaacaaaacaatagataatgatctacgtactacttcgacactgtctttgagtgcagaggattcccaaagtaccgagtcgaatatgtcagtaccaaagaaaatgtgtaaaaggccatgtattcttatactagactccttgaaagctgcttctgtacaaaacacagttcagaatttacgagagtatttagaggtagagtgggaagttaaactaaaaactcatcgtcaattcagcaaaacaaacatggtggatctatgccctaaagttcctaaacaggacaatagcagtgattgtggagtatatttattgcagtatgtggaaagcttcttcaaggatcctattgttaactttgaacttccaattcatttggagaagtggtttcctcgtcatgtaataaagaccaaacgggaagatattcgagagctcatcttgaaacttcatttacagcaacagaagggcagcagtagctagttaatctgtacaaacatgacacagatgttctctaagattactggaaagcctcttaccagcatttgtgttagccagctcacagagaagaaaataacttgcagtagttttataataagtcattggaacattatttaaaatatgtaggacacattattagaattgttgggatctcatagatggaatgggaatgggggtgatatagataaacttactagatataaattaaaattttataaatatttcatatttttctgagtaaatatgattggattatgcaacagcatatgtaatatgggaatgttttgtagataataaaacttacatgatctgtacttccacgtgactgggtgctgaggggagttaaagcctccctggtgccagccccagtgcttgtcaaatttgctgacaggtcacatcatattgtaattctattctttgcagctcaagcatgcagtatgaatactgtgtattttttaaaaaaataatttagtatcaaggcttcagaaaatgccatttacggcatcccttctgtatgtaacaaaaagacattcataatgttaggaagatgataaaaattcgctcttttaaagtgcagcttattattctcaattgctaaatacgattactctgctttttttttttcatttcttttgatgtcatatgtgagtatcttataatttagttcatttgttcagggtaaaatttgaaacaaaaaattttacctgtgcaaaatagttttttaaaaattatacatgtagctcaacttgaggtactgctatataaatattcactcacattatcacggaatttatgtatagtttctctaatatagaagataaaattggtgtcctcataactttaacaaagaaaaccctcagtcctatttattaatgggtagaattaaatatataattttatagctcagtttacccagtattcatctgcaaagccagattgctctcattgcttttatatttttaaattgtagcttttagagacctatgatcctcatggaacttaattttttattaaatattcaggtaacagttctgaattcatgtgataatggtggcattatatatgattaaacacttcagaactttctaatgttatcaggagtattttgagggagatatgattatattgtattttctcagataagaaaaatgttttttaacaatattattttaatctgttttaagcatctcttagatttacattataactacataaagcagtgaagcaaaggcaaattaagataaagctagaaagtctgaacattttatttcaaaatcatacgaatcggggtcagttaagcctcagtattcttagcttttgttgattttggcactatctttatattattaaatatatttgttgtttggatatttcatataaagatggctataattacatatttcattcccaatttgtgtgtgttggggggtacttttaaaggtgactattgttttgtacatctaattttgggaaagcaagtctataagacatcttgtgatttcttaatgtttttgtttgtatgtttttcaaagatatcactgtcctttatcatgttttgaagattgtttaaaattcattttcctaaattaatgtgcaagtaatgttttgaggatatcagtgttttatattaaacatatttccaattcattaaa

SEQ ID NO: 187397 - DNA, 4703 bp, Homo sapiens
  Payload ID: 16896
  Gene Symbol: SENP7
  Gene Name: SUMO1/sentrin specific peptidase 7
  ENST ID: ENST00000394094
  CDS Start-End: 76-3033
ctccccctccctctccaagccggaggggtcctgaggtgacagcgcctgcaactgaaatttcagcagcgggagaagatggacaagagaaagctcgggcgacggccatcttcatccgaaatcatcacagaaggaaaaaggaaaaagtcatcttctgatttatcggagataagaaagatgttaaatgcaaaaccagaggatgtccatgttcaatcaccactgtccaaattcagaagctcagaacgctggactctccctttgcagtgggaaagaagcctaaggaataaagtcatctctctagaccataaaaataaaaaacatatccgagggtgtcctgttacttccaagtcatcaccagaaaggcaactcaaagttatgttgacgaatgtcctatggacggatttaggacgaaaattcagaaagaccctacctagaaacgatgctaatttatgtgatgccaacaaggtgcaatcagactcattgccttcgacatctgttgacagcctagagacatgtcaaaaattagaacctcttcgccaaagccttaatttatctgaaaggggctcacaacgaagtaagacagtagatgacaattctgcaaagcagactgcgcacaataaagaaaaacgaagaaaggatgatggcatttctcttttaatatctgatactcagcctgaagaccttaacagtggaagtagaggttgtgatcatctcgaacaggaaagcagaaacaaggatgttaaatattctgattcaaaagtggaactcactctgatttccaggaagacaaagagaaggcttagaaataatttacctgattctcaatattgtacttctttggataagtcaacagaacagacaaaaaaacaagaagatgactcaacaatatccactgagtttgaaaagccaagtgaaaactatcatcaggatccaaaactgcctgaagaaattacaactaaacctacaaaaagtgattttactaaactatcctcacttaacagtcaggagttgactttgagtaatgccaccaaaagtgcctctgccggttcaaccactgaaaccgttgagaactctaattccattgatattgtggggatttcttccctggttgagaaggatgagaatgagttgaataccatagaaaagcctattctaagaggacataatgaagggaaccaatcactgatctcagctgaaccaattgttgtttccagtgatgaagaaggacctgttgaacataaaagttcagaaattcttaagttacaatctaagcaagaccgtgagacaactaatgaaaatgagagtacttctgaatcagcattgttagaactaccattgattacatgtgaatctgtacagatgtcatctgaattatgcccatataatcctgtcatggagaacatttccagtattatgcctagtaatgagatggatctacaactggattttatatttacttctgtttatattggtaaaataaaaggagcttctaaaggttgtgttacaatcacaaaaaaatatattaagatcccatttcaagtgtccctgaatgagatttcattgctagtggataccacacatttaaagcggtttgggttatggaaaagtaaggatgataatcacagtaaaaggagtcatgctattcttttcttctgggtctcttcagattatcttcaagagattcagacccaattagaacactctgtattaagccagcaatcaaaatctagtgaattcattttccttgaactacacaatcctgtttcacaaagagaagaattgaagctgaaagatattatgacggaaataagtataatcagtggagaattagagctttcttacccgttgtcttgggttcaggcatttcctttgtttcagaacctctcttcaaaagaaagttcttttattcattattactgtgtttcaacttgttctttccctgctggtgttgctgttgctgaagaaatgaagctgaaatcagtatctcagccctcaaacacagatgcggccaagcctacttacaccttcctgcagaagcaaagtagcggttgctactccctttctattacatctaatccagatgaagaatggcgagaagtcaggcacactggacttgttcagaagttgattgtatatcctccaccacctactaaggggggattaggagtaactaatgaagatctggagtgtttagaagaaggagagtttcttaatgatgtaatcattgatttttaccttaagtatcttatattggagaaggcatcagatgaacttgttgaacgaagtcacatttttagtagctttttctataaatgcttgacaagaaaggaaaataatttaacagaagataatccaaatctttcaatggcacagagaagacataaaagagtaagaacatggactcgtcacataaacatttttaataaagattacatctttgtacctgtaaatgagtcgtctcactggtatctcgcagtcatttgttttccatggttagaagaagctgtgtatgaagattttccacaaactgtatcccagcagtcccaggctcagcagtcccaaaatgacaacaaaacaatagataatgatctacgtactacttcgacactgtctttgagtgcagaggattcccaaagtaccgagtcgaatatgtcagtaccaaagaaaatgtgtaaaaggccatgtattcttatactagactccttgaaagctgcttctgtacaaaacacagttcagaatttacgagagtatttagaggtagagtgggaagttaaactaaaaactcatcgtcaattcagcaaaacaaacatggtggatctatgccctaaagttcctaaacaggacaatagcagtgattgtggagtatatttattgcagtatgtggaaagcttcttcaaggatcctattgttaactttgaacttccaattcatttggagaagtggtttcctcgtcatgtaataaagaccaaacgggaagatattcgagagctcatcttgaaacttcatttacagcaacagaagggcagcagtagctagttaatctgtacaaacatgacacagatgttctctaagattactggaaagcctcttaccagcatttgtgttagccagctcacagagaagaaaataacttgcagtagttttataataagtcattggaacattatttaaaatatgtaggacacattattagaattgttgggatctcatagatggaatgggaatgggggtgatatagataaacttactagatataaattaaaattttataaatatttcatatttttctgagtaaatatgattggattatgcaacagcatatgtaatatgggaatgttttgtagataataaaacttacatgatctgtacttccacgtgactgggtgctgaggggagttaaagcctccctggtgccagccccagtgcttgtcaaatttgctgacaggtcacatcatattgtaattctattctttgcagctcaagcatgcagtatgaatactgtgtattttttaaaaaaataatttagtatcaaggcttcagaaaatgccatttacggcatcccttctgtatgtaacaaaaagacattcataatgttaggaagatgataaaaattcgctcttttaaagtgcagcttattattctcaattgctaaatacgattactctgctttttttttttcatttcttttgatgtcatatgtgagtatcttataatttagttcatttgttcagggtaaaatttgaaacaaaaaattttacctgtgcaaaatagttttttaaaaattatacatgtagctcaacttgaggtactgctatataaatattcactcacattatcacggaatttatgtatagtttctctaatatagaagataaaattggtgtcctcataactttaacaaagaaaaccctcagtcctatttattaatgggtagaattaaatatataattttatagctcagtttacccagtattcatctgcaaagccagattgctctcattgcttttatatttttaaattgtagcttttagagacctatgatcctcatggaacttaattttttattaaatattcaggtaacagttctgaattcatgtgataatggtggcattatatatgattaaacacttcagaactttctaatgttatcaggagtattttgagggagatatgattatattgtattttctcagataagaaaaatgttttttaacaatattattttaatctgttttaagcatctcttagatttacattataactacataaagcagtgaagcaaaggcaaattaagataaagctagaaagtctgaacattttatttcaaaatcatacgaatcggggtcagttaagcctcagtattcttagcttttgttgattttggcactatctttatattattaaatatatttgttgtttggatatttcatataaagatggctataattacatatttcattcccaatttgtgtgtgttggggggtacttttaaaggtgactattgttttgtacatctaattttgggaaagcaagtctataagacatcttgtgatttcttaatgtttttgtttgtatgtttttcaaagatatcactgtcctttatcatgttttgaagattgtttaaaattcattttcctaaattaatgtgcaagtaatgttttgaggatatcagtgttttatattaaacatatttccaattcattaaa

SEQ ID NO: 187398 - DNA, 4945 bp, Homo sapiens
  Payload ID: 16896
  Gene Symbol: SENP7
  Gene Name: SUMO1/sentrin specific peptidase 7
  Uniprot ID: Q9BQF6
  ENST ID: ENST00000394095
  CDS Start-End: 55-3207
ggaggggtcctgaggtgacagcgcctgcaactgaaatttcagcagcgggagaagatggacaagagaaagctcgggcgacggccatcttcatccgaaatcatcacagaaggaaaaaggaaaaagtcatcttctgatttatcggagataagaaagatgttaaatgcaaaaccagaggatgtccatgttcaatcaccactgtccaaattcagaagctcagaacgctggactctccctttgcagtgggaaagaagcctaaggaataaagtcatctctctagaccataaaaataaaaaacatatccgagggtgtcctgttacttccaagtcatcaccagaaaggcaactcaaagttatgttgacgaatgtcctatggacggatttaggacgaaaattcagaaagaccctacctagaaacgatgctaatttatgtgatgccaacaaggtgcaatcagactcattgccttcgacatctgttgacagcctagagacatgtcaaaaattagaacctcttcgccaaagccttaatttatctgaaaggatacccagagttatattgacgaatgtcctgggaacggagttaggaagaaaatacataaggaccccacctgtaactgagggaagtttgagtgatacagacaacttgcaatcagagcaactttcttcatcatctgatggcagcctagaatcttatcaaaatctaaaccctcacaagagctgttatttatctgaaaggggctcacaacgaagtaagacagtagatgacaattctgcaaagcagactgcgcacaataaagaaaaacgaagaaaggatgatggcatttctcttttaatatctgatactcagcctgaagaccttaacagtggaagtagaggttgtgatcatctcgaacaggaaagcagaaacaaggatgttaaatattctgattcaaaagtggaactcactctgatttccaggaagacaaagagaaggcttagaaataatttacctgattctcaatattgtacttctttggataagtcaacagaacagacaaaaaaacaagaagatgactcaacaatatccactgagtttgaaaagccaagtgaaaactatcatcaggatccaaaactgcctgaagaaattacaactaaacctacaaaaagtgattttactaaactatcctcacttaacagtcaggagttgactttgagtaatgccaccaaaagtgcctctgccggttcaaccactgaaaccgttgagaactctaattccattgatattgtggggatttcttccctggttgagaaggatgagaatgagttgaataccatagaaaagcctattctaagaggacataatgaagggaaccaatcactgatctcagctgaaccaattgttgtttccagtgatgaagaaggacctgttgaacataaaagttcagaaattcttaagttacaatctaagcaagaccgtgagacaactaatgaaaatgagagtacttctgaatcagcattgttagaactaccattgattacatgtgaatctgtacagatgtcatctgaattatgcccatataatcctgtcatggagaacatttccagtattatgcctagtaatgagatggatctacaactggattttatatttacttctgtttatattggtaaaataaaaggagcttctaaaggttgtgttacaatcacaaaaaaatatattaagatcccatttcaagtgtccctgaatgagatttcattgctagtggataccacacatttaaagcggtttgggttatggaaaagtaaggatgataatcacagtaaaaggagtcatgctattcttttcttctgggtctcttcagattatcttcaagagattcagacccaattagaacactctgtattaagccagcaatcaaaatctagtgaattcattttccttgaactacacaatcctgtttcacaaagagaagaattgaagctgaaagatattatgacggaaataagtataatcagtggagaattagagctttcttacccgttgtcttgggttcaggcatttcctttgtttcagaacctctcttcaaaagaaagttcttttattcattattactgtgtttcaacttgttctttccctgctggtgttgctgttgctgaagaaatgaagctgaaatcagtatctcagccctcaaacacagatgcggccaagcctacttacaccttcctgcagaagcaaagtagcggttgctactccctttctattacatctaatccagatgaagaatggcgagaagtcaggcacactggacttgttcagaagttgattgtatatcctccaccacctactaaggggggattaggagtaactaatgaagatctggagtgtttagaagaaggagagtttcttaatgatgtaatcattgatttttaccttaagtatcttatattggagaaggcatcagatgaacttgttgaacgaagtcacatttttagtagctttttctataaatgcttgacaagaaaggaaaataatttaacagaagataatccaaatctttcaatggcacagagaagacataaaagagtaagaacatggactcgtcacataaacatttttaataaagattacatctttgtacctgtaaatgagtcgtctcactggtatctcgcagtcatttgttttccatggttagaagaagctgtgtatgaagattttccacaaactgtatcccagcagtcccaggctcagcagtcccaaaatgacaacaaaacaatagataatgatctacgtactacttcgacactgtctttgagtgcagaggattcccaaagtaccgagtcgaatatgtcagtaccaaagaaaatgtgtaaaaggccatgtattcttatactagactccttgaaagctgcttctgtacaaaacacagttcagaatttacgagagtatttagaggtagagtgggaagttaaactaaaaactcatcgtcaattcagcaaaacaaacatggtggatctatgccctaaagttcctaaacaggacaatagcagtgattgtggagtatatttattgcagtatgtggaaagcttcttcaaggatcctattgttaactttgaacttccaattcatttggagaagtggtttcctcgtcatgtaataaagaccaaacgggaagatattcgagagctcatcttgaaacttcatttacagcaacagaagggcagcagtagctagttaatctgtacaaacatgacacagatgttctctaagattactggaaagcctcttaccagcatttgtgttagccagctcacagagaagaaaataacttgcagtagttttataataagtcattggaacattatttaaaatatgtaggacacattattagaattgttgggatctcatagatggaatgggaatgggggtgatatagataaacttactagatataaattaaaattttataaatatttcatatttttctgagtaaatatgattggattatgcaacagcatatgtaatatgggaatgttttgtagataataaaacttacatgatctgtacttccacgtgactgggtgctgaggggagttaaagcctccctggtgccagccccagtgcttgtcaaatttgctgacaggtcacatcatattgtaattctattctttgcagctcaagcatgcagtatgaatactgtgtattttttaaaaaaataatttagtatcaaggcttcagaaaatgccatttacggcatcccttctgtatgtaacaaaaagacattcataatgttaggaagatgataaaaattcgctcttttaaagtgcagcttattattctcaattgctaaatacgattactctgctttttttttttcatttcttttgatgtcatatgtgagtatcttataatttagttcatttgttcagggtaaaatttgaaacaaaaaattttacctgtgcaaaatagttttttaaaaattatacatgtagctcaacttgaggtactgctatataaatattcactcacattatcacggaatttatgtatagtttctctaatatagaagataaaattggtgtcctcataactttaacaaagaaaaccctcagtcctatttattaatgggtagaattaaatatataattttatagctcagtttacccagtattcatctgcaaagccagattgctctcattgcttttatatttttaaattgtagcttttagagacctatgatcctcatggaacttaattttttattaaatattcaggtaacagttctgaattcatgtgataatggtggcattatatatgattaaacacttcagaactttctaatgttatcaggagtattttgagggagatatgattatattgtattttctcagataagaaaaatgttttttaacaatattattttaatctgttttaagcatctcttagatttacattataactacataaagcagtgaagcaaaggcaaattaagataaagctagaaagtctgaacattttatttcaaaatcatacgaatcggggtcagttaagcctcagtattcttagcttttgttgattttggcactatctttatattattaaatatatttgttgtttggatatttcatataaagatggctataattacatatttcattcccaatttgtgtgtgttggggggtacttttaaaggtgactattgttttgtacatctaattttgggaaagcaagtctataagacatcttgtgatttcttaatgtttttgtttgtatgtttttcaaagatatcactgtcctttatcatgttttgaagattgtttaaaattcattttcctaaattaatgtgcaagtaatgttttgaggatatcagtgttttatattaaacatatttccaattcattaaattgaggtgtaatttttttccttaagaaacatgagctactgttagaaataaatttccagttgtatgctg

SEQ ID NO: 187399 - DNA, 435 bp, Homo sapiens
  Payload ID: 16896
  Gene Symbol: SENP7
  Gene Name: SUMO1/sentrin specific peptidase 7
  ENST ID: ENST00000366089
  CDS Start-End: 1-152
agattcagacccaattagaacactctgtattaagccagcaatatggagtctcgctttgtcacccaggctggagtgcagtggcactatctctgctcaccgcaagctctgcctcccgggttcacgccattctcctgcctcagcctcctgagtagctgggactacaggtgcccgccaccgtgcccggctaattttttgtatttttagtagagacggggtttcatcgtgttagccaggatggtctcgatctcctgaccttgtgatccgcccgcctcagcctcccaaagtgctgggattacaggcgtgagccactgcgcctggccctaattttgtttcttaattttaggatagattatttaattcacataatttctccttatagttgtattcaaccaattgaaattctcatctaaaataaaaagaatagcttaaaaaatc

SEQ ID NO: 187400 - DNA, 5717 bp, Homo sapiens
  Payload ID: 16897
  Gene Symbol: SENP2
  Gene Name: SUMO1/sentrin/SMT3 specific peptidase 2
  Uniprot ID: Q9HC62
  ENST ID: ENST00000296257
  CDS Start-End: 241-2010
gtgcgcagattgagaatggagctttccggtcgggcgggaggaggtgacgtcaggagtggtggcgggcgggggcctctggtagccctggggacgctgtatctgtgggctcttgaatcgcgtcacaaatcagcgaccgaactctggcggtggtggttaagacggcgaaggcggcagcggcggcgacagctctggggtttgcgtctcggggtgtgtcggccgccgctgctgcttgggcctggtatgtacagatggctggttaggattctcggcaccattttccgtttctgcgaccggtcggtgccccctgcccgggccctcctgaagaggcggcgctcagacagcactctgttttctacagtggacactgatgaaataccagccaaaagaccaagattagattgctttattcaccaagtgaaaaacagtctctacaatgctgccagcttatttggattcccattccagctgaccacaaagcccatggtaacttctgcttgtaatggaacacggaatgtggccccttcaggagaggtattttcgaactcttcatcttgtgaactgacaggttctggatcctggaacaacatgctgaaactgggtaataaatctcctaatggaataagtgactatccaaagatcagagtgacagttacccgagatcagccacgcagagtcctgccttcctttggttttactttgaactcagaaggctgtaatagaagaccaggtggccgtcgccatagcaaaggtaatccagagagttctttaatgtggaaacctcaggaacaggctgtaacagagatgatttctgaagagagtggcaagggtctgaggcgtccccattgtactgtggaggagggtgttcaaaaagaggaaagagagaagtaccgaaagttattggaacgacttaaagaaagtggtcatggaaactctgtctgtcctgtaacttcaaattatcacagttctcaaagaagtcagatggacacattaaagaccaaaggctggggggaagagcaaaatcacggagtcaaaacaactcagtttgttccaaaacaatatagacttgttgaaacaaggggacctctatgttcattgagaagtgaaaagaggtgttcaaaggggaaaattactgatacagagacgatggtcggaatcagatttgaaaatgaaagtaggaggggataccaactggagcctgacctatcagaagaagtgtcggcccgactccgcctgggcagtggaagcaatggcttactcaggaggaaagtgtcaataattgagacaaaggaaaagaattgctcaggcaaagagagggacagaagaacggacgatctccttgaacttacagaggacatggaaaaggaaatcagtaatgccctaggccatggcccacaggatgaaatcctaagtagtgctttcaaattgcgaattactcgaggagatattcagacattaaagaactatcactggctcaatgatgaagtcattaatttttacatgaatcttctggtggaaagaaataaaaagcaaggctatccagcacttcatgtattcagtactttcttctatcctaaattaaagtctgggggttaccaagcagtgaaacgatggaccaaaggggtaaatctctttgaacaagaaattattctggtgcctattcatcggaaggtacattggagcctggtggtgattgacctaagaaaaaagtgtcttaaatatctggattctatgggacaaaagggccacaggatctgtgagattctccttcagtatttacaggatgaaagtaagaccaaaagaaatagtgatctgaatcttttagagtggacccatcacagcatgaaaccacacgagattcctcaacagctgaatgggagtgattgtggaatgtttacttgtaaatatgcagattatatttctagggacaaacctatcacatttactcagcaccagatgcctctcttccggaagaagatggtgtgggaaatccttcatcagcagttgctgtgagaaaactttgcctggtccctctagctgctggtggttctttcacagacatttccatatacctcatgcattgtgggttaaaaagtccctgcatcacttctgttctcacaggtactgagctgtcaaaagtgcatgaaggcctctcactgtactctagtcctgacttggggtgcagagggctgcttgcaatcctgtttgtaaggctgtgcctgctcagagctttggactgttcaacccacacaagaacaaacgctaactaatattttttttaagagattcttttccctatgaatgtgggaaatgcaggatttattctgtgaattgtttgtttctgtgtgtttgttcagcgtattcattcactcactcgtttgcaaacataatgggcagtggtcatttactgctgctcttttacagttagctctaaattacttgtttgaactatttatttctgaaaggaatgttactcaagctgccactccctgctgaagagcaggagggaactctcactgggggcggaaggaagtggagctggagcagtaactgccaacatgaagctggagggtttgggattttttttgtttttgtttttttgaggctcaaaaaatgctgggagaaatgaaaatgctgtgggatagggctcctgttgcctttcagaggaagtctgacactacagcgttggcacagtgccgtgaacagtggaactgtgcccaagggactctgattatccaagcatcttccgaagagtgttgtggtcaccttaaagagacttccccttctggaaatgtggtgacttggcttagtcttcaaactggattcatggatttgaagtaactgtaaaccctaaatcttcattttcatcccagatctggttgagtataaacctcagaattgtaggggctggcctgagctgtttatttcaaaagatactattcaatttaaagctatttttcctcagagtttttgttttctatatattaagtctaaattaagttttctactcattaagactaacatctccccactccatccccactgaaatttgtggaagaaaatttagtacttggctctgaggttgccagttatacaataatctattttgcatatgaaagtttgtatttaacttttttgttcattaaaaaccttactgatatggttataacttcagacagtttagagttggtcagaacatattttgcaagatctagtgcctagtgttgcttttctgatgtaataaaaggtggtctggcagaacctaaaaaagtatatgctgaaatgatttctaaccctctccctacttaaacctcccagacttgttctggttcataaaagcaagaggtaaaactggaaaaattgtgcacgtgttacctatgaatctacacgcctgccatttgcagtgctccggctgctggtcccagaggtatactggttacagctattgcagccagttccctgagacttgtaaaactcctggtttaggacatggggcctgtggtgtggatggaaaatgctgggcctactggatggtcagccagaggccatgtggtgggtgatgactgaagcgggagcaggttgtaccacacctctcccccccccctcccactccccctccctccctctcccctccccctccctccctcccccctccctccctcccccccctccccctccctccccctccctctctccctaacacccaccctccccctttcccccaccctccccccttctcccctttccccaccctccctccccccttccccctcccccccccccccccgcagcccctgctcctttctctgggctcctggcattgtgccagtgagtgctgggaccaggtaatgagcacagccaaaaaggccagaggttcactaggtcagcatcataccaaacgcctggctttcaccaggcatcagtgtgcttcacttgagagtttggtaccatggttaagatcgagtccatgctaggtaagtcctgttaggaatgtcagtttgtattccgcccacgtgaatgatgctgagcttaatgtattattttgaggggcttcttcagagcagttctcactgagctttccattaacctacactcttccggacggctcttaaaacttgcaggacataatgaaattgggaagagcagagtgttgaagtctatagcatggccttctgcttgaccctgagttcctgaattgaatgtgggagaccacaggccatacttctctaggcactcacatgtctcccttggcataaggaaacatgttagtaatatagttttttagatccaaacagtttatttggatctaaaagtttaagtgttcagttgaaaaacagctattgattttattagtagcaaattatcaccattaaagccagtggttttttttttgttttttttttttgttttttttttttttttttgcgacagagtctcttgtcgcccaggctggagtacaatggtgtgatctcagctcactgcaacctccgcctcccaggttcaagcgattctcctgcctcagcctcctgcgtagctgggattacaggtgcccaccaccacaccctgctaatttttgtacttttagtagagatggggtttcgccatgttggccaggctggtcttgaactgctgacctcaggtgatccacccgcctcggcctcccaaagtgctggtattacagtcatgagccacctcacccagcctgtttttgagacggagtttcacttttgtcgcccaggctggagtgcaatggcgctatctcagctcactgcaacccccacctcccaggttcaagcgattctcctgcctcagcctcccgagtagctgggattacaggcatgtgccaccacccctggctaattttgtatttttagtggagacggggtttctccatgttggtcaggctggtcttaaactcccgacctcaagtgatctgcccgcctcggcctcccaaagtgctgggattacaggcgtgagccattgcacctgtccctgccagtgtgtttttaaaatagtttagggggttgagaaaagatgcagtgagccattattctcctttagcaggtagtctcttaaaaattgatgtggattttaaaaatataccattgagaacacgtatctttctcaaacttgaccttgaacagagctggatgggggtgggagggaaacagatttggggcatatggaagatattcttgggagccccatattctacctcagttaccgaaggctattagaacctctgaatttttcctcctctgaaatcctaagcacaacttcagaaaaccatgtctgatagcggatgtcttcctgctgtgaggagctgcttgatgtggggaccaaggtgtgggtgtgggcggaatgtatcctagtagaaacagtgaacctcagatatgaataaataagcaagagaccgaaagttaagtgtgtgacaacctcagtactgtagttaagctacattctttaaattagcttttgtgaactgattgggaacctaatctcttttgtaactgtttgagaaaaactctgaagcacctgatattcaaacaaacttatggtacttactaactcatttgtaaattggcgatgtagctggctgtagtattgctttgataatttttttcttttaatttacctaatatatataaggaaggggtttggatatattaaaataggtgttaattttatctatttaccaataaattcatctctttaattca

SEQ ID NO: 187401 - DNA, 2383 bp, Homo sapiens
  Payload ID: 16897
  Gene Symbol: SENP2
  Gene Name: SUMO1/sentrin/SMT3 specific peptidase 2
  ENST ID: ENST00000413407
  CDS Start-End: 120-434
acaaatcagcgaccgaactctggcggtggtggttaagacggcgaaggcggcagcggcggcgacagctctggggtttgcgtctcggggtgtgtcggccgccgctgctgcttgggcctggtatgtacagatggctggttaggattctcggcaccattttccgtttctgcgaccggtcggtgccccctgcccgggccctcctgaagaggcggcgctcagacagcactctgttttctacagtggacactgatgaaataccagccaaaagaccaagattagattgctttattcaccaagtgaaaaacagtctctacaatgctgccagcttatttggattcccattccagctgaccacaaagcccatggtaacttctgcttgtaatggaacacggaatgtggccccttcaggagaggtaataaatctcctaatggaataagtgactatccaaagatcagagtgacagttacccgagatcagccacgcagagtcctgccttcctttggttttactttgaactcagaaggctgtaatagaagaccaggtggccgtcgccatagcaaaggtaatccagagagttctttaatgtggaaacctcaggaacaggctgtaacagagatgatttctgaagagagtggcaagggtctgaggcgtccccattgtactgtggaggagggtgttcaaaaagaggaaagagagaagtaccgaaagttattggaacgacttaaagaaagtggtcatggaaactctgtctgtcctgtaacttcaaattatcacagttctcaaagaagtcagatggacacattaaagaccaaaggctggggggaagagcaaaatcacggagtcaaaacaactcagtttgttccaaaacaatatagacttgttgaaacaaggggacctctatgttcattgagaagtgaaaagaggtgttcaaaggggaaaattactgatacagagacgatggtcggaatcagatttgaaaatgaaagtaggaggggataccaactggagcctgacctatcagaagaagtgtcggcccgactccgcctgggcagtggaagcaatggcttactcaggaggaaagtgtcaataattgagacaaaggaaaagaattgctcaggcaaagagagggacagaagaacggacgatctccttgaacttacagaggacatggaaaaggaaatcagtaatgccctaggccatggcccacaggatgaaatcctaagtagtgctttcaaattgcgaattactcgaggagatattcagacattaaagaactatcactggctcaatgatgaagtcattaatttttacatgaatcttctggtggaaagaaataaaaagcaaggctatccagcacttcatgtattcagtactttcttctatcctaaattaaagtctgggggttaccaagcagtgaaacgatggaccaaaggggtaaatctctttgaacaagaaattattctggtgcctattcatcggaaggtacattggagcctggtggtgattgacctaagaaaaaagtgtcttaaatatctggattctatgggacaaaagggccacaggatctgtgagattctccttcagtatttacaggatgaaagtaagaccaaaagaaatagtgatctgaatcttttagagtggacccatcacagcatgaaaccacacgagattcctcaacagctgaatgggagtgattgtggaatgtttacttgtaaatatgcagattatatttctagggacaaacctatcacatttactcagcaccagatgcctctcttccggaagaagatggtgtgggaaatccttcatcagcagttgctgtgagaaaactttgcctggtccctctagctgctggtggttctttcacagacatttccatatacctcatgcattgtgggttaaaaagtccctgcatcacttctgttctcacaggtactgagctgtcaaaagtgcatgaaggcctctcactgtactctagtcctgacttggggtgcagagggctgcttgcaatcctgtttgtaaggctgtgcctgctcagagctttggactgttcaacccacacaagaacaaacgctaactaatattttttttaagagattcttttccctatgaatgtgggaaatgcaggatttattctgtgaattgtttgtttctgtgtgtttgttcagcgtattcattcactcactcgtttgcaaacataatgggcagtggtcatttactgctgctcttttacagttagctctaaattacttgtttgaactatttatttctgaaaggaatgttactcaagctgccactccctgctgaagagcaggagggaactctcactgggggcggaaggaagtggagctggagcagtaactgccaacatgaagctggagggtt

SEQ ID NO: 187402 - DNA, 596 bp, Homo sapiens
  Payload ID: 16897
  Gene Symbol: SENP2
  Gene Name: SUMO1/sentrin/SMT3 specific peptidase 2
  ENST ID: ENST00000439684
  CDS Start-End: 120-302
acaaatcagcgaccgaactctggcggtggtggttaagacggcgaaggcggcagcggcggcgacagctctggggtttgcgtctcggggtgtgtcggccgccgctgctgcttgggcctggtatgtacagatggctggttaggattctcggcaccattttccgtttctgcgaccggtcggtgccccctgcccgggccctcctgaagaggcggcgctcagacagcactctgttttctacagtggacactgatgaaataccagccaaaagaccaagattaggtattttcgaactcttcatcttgtgaactgacaggttctggatcctggaacaacatgctgaaactgggtaataaatctcctaatggaataagtgactatccaaagatcagagtgacagttacccgagatcagccacgcagagtcctgccttcctttggttttactttgaactcagaaggctgtaatagaagaccaggtggccgtcgccatagcaaaggtaatccagagagttctttaatgtggaaacctcaggaacaggctgtaacagagatgatttctgaagagagtggcaagggtctgaggcgtccccattgtactgt

SEQ ID NO: 187403 - DNA, 829 bp, Homo sapiens
  Payload ID: 16897
  Gene Symbol: SENP2
  Gene Name: SUMO1/sentrin/SMT3 specific peptidase 2
  ENST ID: ENST00000453532
  CDS Start-End: 174-491
gggggcctctggtagccctggggacgctgtatctgtgggctcttgaatcgcgtcacaaatcagcgaccgaactctggcggtggtggttaagacggcgaaggcggcagcggcggcgacagctctggggtttgcgtctcggggtgtgtcggccgccgctgctgcttgggcctggtatgtacagatggctggttaggattctcggcaccattttccgtttctgcgaccggtcggtgccccctgcccgggccctcctgaagaggcggcgctcagacagcactctgttttctacagtggacactgatgaaataccagccaaaagaccaagattagattgctttattcaccaagtgaaaaacagtctctacaatgctgccagcttatttggattcccattccagctgaccacaaagcccatggtaacttctgcttgtaatggaacacggaatgtggccccttcaggagaggttctggatcctggaacaacatgctgaaactgggtaataaatctcctaatggaataagtgactatccaaagatcagagtgacagttacccgagatcagccacgcagagtcctgccttcctttggttttactttgaactcagaaggctgtaatagaagaccaggtggccgtcgccatagcaaaggtaatccagagagttctttaatgtggaaacctcaggaacaggctgtaacagagatgatttctgaagagagtggcaagggtctgaggcgtccccattgtactgtggaggagggtgttcaaaaagaggaaagagagaagtaccgaaagttattggaacgacttaaagaaagtggtcatggaaac

SEQ ID NO: 187404 - DNA, 878 bp, Homo sapiens
  Payload ID: 16897
  Gene Symbol: SENP2
  Gene Name: SUMO1/sentrin/SMT3 specific peptidase 2
  ENST ID: ENST00000430355
  CDS Start-End: 60-878
ataaggatcttcttggagaactggggcatctgattggaacacctgcgaaagcttaagcgatgaggttgtgcccctcttgcagtacaaggctgcaaattatccaagccaagggcagaaatctcaatgtccttgttactccatatggccttgggattctcccatggccctccagtaaagcgctgctaggtcccggaaaggctgtggcagtggtggggttggggttaaggataatcccactccttggccagtggatggacagtcacccatgtctctactgtggaccacaggacagcgaaggcaccaactggcagacaagtcccagcactctgttttctacagtggacactgatgaaataccagccaaaagaccaagattagattgctttattcaccaagtgaaaaacagtctctacaatgctgccagcttatttggattcccattccagctgaccacaaagcccatggtaacttctgcttgtaatggaacacggaatgtggccccttcaggagaggtattttcgaactcttcatcttgtgaactgacaggttctggatcctggaacaacatgctgaaactgggtaataaatctcctaatggaataagtgactatccaaagatcagagtgacagttacccgagatcagccacgcagagtcctgccttcctttggttttactttgaactcagaaggctgtaatagaagaccaggtggccgtcgccatagcaaaggtaatccagagagttctttaatgtggaaacctcaggaacaggctgtaacagagatgatttctgaagagagtggcaagggtctgaggcgtccccattgtactgtggaggagggtgttcaaaaagaggaaagagagaagtaccgaaagtta

SEQ ID NO: 187405 - DNA, 610 bp, Homo sapiens
  Payload ID: 16897
  Gene Symbol: SENP2
  Gene Name: SUMO1/sentrin/SMT3 specific peptidase 2
  ENST ID: ENST00000444509
  CDS Start-End: 1-610
gggaaaattactgatacagagacgatggtcggaatcagatttgaaaatgaaagtaggaggggataccaactggagcctgacctatcagaagaagtgtcggcccgactccgcctgggcagtggaagcaatggcttactcaggaggaaagtgtcaataattgagacaaaggaaaagaattgctcaggcaaagagagggacagaagaacggacgatctccttgaacttacagaggtcattaatttttacatgaatcttctggtggaaagaaataaaaagcaaggctatccagcacttcatgtattcagtactttcttctatcctaaattaaagtctgggggttaccaagcagtgaaacgatggaccaaaggggtaaatctctttgaacaagaaattattctggtgcctattcatcggaaggtacattggagcctggtggtgattgacctaagaaaaaagtgtcttaaatatctggattctatgggacaaaagggccacaggatctgtgagattctccttcagtatttacaggatgaaagtaagaccaaaagaaatagtgatctgaatcttttagagtggacccatcacagcatgaaaccacacgagattcctc

SEQ ID NO: 187406 - DNA, 553 bp, Homo sapiens
  Payload ID: 16897
  Gene Symbol: SENP2
  Gene Name: SUMO1/sentrin/SMT3 specific peptidase 2
  ENST ID: ENST00000458551
  CDS Start-End: 117-281
aatcagcgaccgaactctggcggtggtggttaagacggcgaaggcggcagcggcggcgacagctctggggtttgcgtctcggggtgtgtcggccgccgctgctgcttgggcctggtatgtacagatggctggttaggattctcggcaccattttccgtttctgcgaccggtcggtgccccctgcccgggccctcctgaagaggcggcgctcagacagcactctgttttctacagtggacactgatgaaataccagccaaaagaccaagattagtttgttgacactttctagattgctttattcaccaagtgaaaaacagtctctacaatgctgccagcttatttggattcccattccagctgaccacaaagcccatggtaacttctgcttgtaatggaacacggaatgtggccccttcaggagaggtattttcgaactcttcatcttgtgaactgacaggttctggatcctggaacaacatgctgaaactgggtaataaatctcctaatggaataagtgactatccaaagatcagagtgacagttacccgaga

SEQ ID NO: 187407 - DNA, 2611 bp, Homo sapiens
  Payload ID: 16898
  Gene Symbol: SENP3
  Gene Name: SUMO1/sentrin/SMT3 specific peptidase 3
  Uniprot ID: Q9H4L4
  ENST ID: ENST00000321337
  CDS Start-End: 401-2125
cgggaccgcgcgcttggtggccgcgccggcgctcttcgccgggtgtgacgtactaatcgtgcgccaccgctgccggtgggcccggggctcgcgggaggggaaggaggagggggggaggagtggcggcggcggcggtggcgctggtggcggcggtggcggaggtggaggtggaggtggaagctgaagctgaagcagagccagaggcggcgcggcggggtgctcggcggcgcggcacgcggcccagaagcgttggaatcctgaattgagacggctgcgcctaaagacagcaggagtggcggggccgccgccgtcgccggagagatgagccgggaagcttgaggccggagacgcccgccttcgggcccgtccgcccggcttccccgctcccgggtactggaagatgaaagagactatacaagggaccgggtcctgggggcctgagcctcctggacccggcatacccccagcttactcaagtcccaggcgggagcgtcttcgttggcccccacctcccaaaccccgactcaagtcaggtggagggtttgggccagatcctgggtcagggaccacagtgccagccagacgcctccctgtcccccgaccctcttttgatgcctcagcaagtgaagaggaggaagaagaggaggaggaggaggatgaagatgaagaggaggaagtggcagcttggaggctgcccccaagatggagtcagctgggaacctcccagcggccccgcccttcccgccccactcatcgaaaaacctgctcacagcgccgccgccgagccatgagagccttccggatgctgctctactcaaaaagcacctcgctgacattccactggaagctttgggggcgccaccggggccggcggcggggcctcgcacaccccaagaaccatctttcaccccagcaagggggtgcgacgccacaggtgccatccccctgttgtcgttttgactccccccgggggccacctccaccccggctgggtctgctaggtgctctcatggctgaggatggggtgagagggtctccaccagtgccctctgggccccccatggaggaagatggactcaggtggactccaaagtctcctctggaccctgactcgggcctcctttcatgtactctgcccaacggttttgggggacaatctgggccagaaggggagcgcagcttggcaccccctgatgccagcatcctcatcagcaatgtgtgcagcatcggggaccatgtggcccaggagctttttcagggctcagatttgggcatggcagaagaggcagagaggcctggggagaaagccggccagcacagccccctgcgagaggagcatgtgacctgcgtacagagcatcttggacgaattccttcaaacgtatggcagcctcatacccctcagcactgatgaggtagtagagaagctggaggacattttccagcaggagttttccaccccttccaggaagggcctggtgttgcagctgatccagtcttaccagcggatgccaggcaatgccatggtgaggggcttccgagtggcttataagcggcacgtgctgaccatggatgacttggggaccttgtatggacagaactggctcaatgaccaggtgatgaacatgtatggagacctggtcatggacacagtccctgaaaaggtgcatttcttcaatagtttcttctatgataaactccgtaccaagggttatgatggggtgaaaaggtggaccaaaaacgtggacatcttcaataaggagctactgctaatccccatccacctggaggtgcattggtccctcatctctgttgatgtgaggcgacgcaccatcacctattttgactcgcagcgtaccctaaaccgccgctgccctaagcatattgccaagtatctacaggcagaggcggtaaagaaagaccgactggatttccaccagggctggaaaggttacttcaaaatgaatgtggccaggcagaataatgacagtgactgtggtgcttttgtgttgcagtactgcaagcatctggccctgtctcagccattcagcttcacccagcaggacatgcccaaacttcgtcggcagatctacaaggagctgtgtcactgcaaactcactgtgtgagcctcgtaccccagaccccaagcccataaatgggaagggagacatgggagtcccttcccaagaaactccagttcctttcctctcttgcctcttcccactcacttccctttggtttttcatatttaaatgtttcaatttctgtatttttttttctttgagagaatacttgttgatttctgatgtgcagggggtggctacagaaaagcccctttcttcctctgtttgcaggggagtgtggccctgtggcctgggtggagcagtcatcctcccccttccccgtgcagggagcaggaaatcagtgctgggggtggtgggcggacaataggatcactgcctgccagatcttcaaacttttatatatatatatatatatatatatatatatatatatatatatatatatatatatatatatatatatatataaaaatatataaatgccacggtcctgctctggtcaataaaggatcctttgttgatacgtaa

SEQ ID NO: 187408 - DNA, 2222 bp, Homo sapiens
  Payload ID: 16898
  Gene Symbol: SENP3
  Gene Name: SUMO1/sentrin/SMT3 specific peptidase 3
  Uniprot ID: Q9H4L4
  ENST ID: ENST00000429205
  CDS Start-End: 50-1774
ccgccttcgggcccgtccgcccggcttccccgctcccgggtactggaagatgaaagagactatacaagggaccgggtcctgggggcctgagcctcctggacccggcatacccccagcttactcaagtcccaggcgggagcgtcttcgttggcccccacctcccaaaccccgactcaagtcaggtggagggtttgggccagatcctgggtcagggaccacagtgccagccagacgcctccctgtcccccgaccctcttttgatgcctcagcaagtgaagaggaggaagaagaggaggaggaggaggatgaagatgaagaggaggaagtggcagcttggaggctgcccccaagatggagtcagctgggaacctcccagcggccccgcccttcccgccccactcatcgaaaaacctgctcacagcgccgccgccgagccatgagagccttccggatgctgctctactcaaaaagcacctcgctgacattccactggaagctttgggggcgccaccggggccggcggcggggcctcgcacaccccaagaaccatctttcaccccagcaagggggtgcgacgccacaggtgccatccccctgttgtcgttttgactccccccgggggccacctccaccccggctgggtctgctaggtgctctcatggctgaggatggggtgagagggtctccaccagtgccctctgggccccccatggaggaagatggactcaggtggactccaaagtctcctctggaccctgactcgggcctcctttcatgtactctgcccaacggttttgggggacaatctgggccagaaggggagcgcagcttggcaccccctgatgccagcatcctcatcagcaatgtgtgcagcatcggggaccatgtggcccaggagctttttcagggctcagatttgggcatggcagaagaggcagagaggcctggggagaaagccggccagcacagccccctgcgagaggagcatgtgacctgcgtacagagcatcttggacgaattccttcaaacgtatggcagcctcatacccctcagcactgatgaggtagtagagaagctggaggacattttccagcaggagttttccaccccttccaggaagggcctggtgttgcagctgatccagtcttaccagcggatgccaggcaatgccatggtgaggggcttccgagtggcttataagcggcacgtgctgaccatggatgacttggggaccttgtatggacagaactggctcaatgaccaggtgatgaacatgtatggagacctggtcatggacacagtccctgaaaaggtgcatttcttcaatagtttcttctatgataaactccgtaccaagggttatgatggggtgaaaaggtggaccaaaaacgtggacatcttcaataaggagctactgctaatccccatccacctggaggtgcattggtccctcatctctgttgatgtgaggcgacgcaccatcacctattttgactcgcagcgtaccctaaaccgccgctgccctaagcatattgccaagtatctacaggcagaggcggtaaagaaagaccgactggatttccaccagggctggaaaggttacttcaaaatgaatgtggccaggcagaataatgacagtgactgtggtgcttttgtgttgcagtactgcaagcatctggccctgtctcagccattcagcttcacccagcaggacatgcccaaacttcgtcggcagatctacaaggagctgtgtcactgcaaactcactgtgtgagcctcgtaccccagaccccaagcccataaatgggaagggagacatgggagtcccttcccaagaaactccagttcctttcctctcttgcctcttcccactcacttccctttggtttttcatatttaaatgtttcaatttctgtatttttttttctttgagagaatacttgttgatttctgatgtgcagggggtggctacagaaaagcccctttcttcctctgtttgcaggggagtgtggccctgtggcctgggtggagcagtcatcctcccccttccccgtgcagggagcaggaaatcagtgctgggggtggtgggcggacaataggatcactgcctgccagatcttcaaacttttatatatatatatatatatatatatatatatataaaaatatataaatgccacggtcctgctctggtcaataaaggatcctttgttgatacgtaa

SEQ ID NO: 187409 - DNA, 493 bp, Homo sapiens
  Payload ID: 16898
  Gene Symbol: SENP3
  Gene Name: SUMO1/sentrin/SMT3 specific peptidase 3
  ENST ID: ENST00000581093
  CDS Start-End: 1-249
gtggacatcttcaataaggagctactgctaatccccatccacctggaggtgcattggtccctcatctctgttgatgtgaggcgacgcaccatcacctattttgactcgcagcgtaccctaaaccgccgctgccctaagtactgcaagcatctggccctgtctcagccattcagcttcacccagcaggacatgcccaaacttcgtcggcagatctacaaggagctgtgtcactgcaaactcactgtgtgagcctcgtaccccagaccccaagcccataaatgggaagggagacatgggagtcccttcccaagaaactccagttcctttcctctcttgcctcttcccactcacttccctttggtttttcatatttaaatgtttcaatttctgtatttttttttctttgagagaatacttgttgatttctgatgtgcagggggtggctacagaaaagcccctttcttcctctgtttgcaggggagtgtggccctgt

SEQ ID NO: 187410 - DNA, 901 bp, Homo sapiens
  Payload ID: 16898
  Gene Symbol: SENP3
  Gene Name: SUMO1/sentrin/SMT3 specific peptidase 3
  ENST ID: ENST00000580231
  CDS Start-End: 1-714
gagcatgtgacctgcgtacagagcatcttggacgaattccttcaaacgtatggcagcctcatacccctcagcactgatgaggtagtagagaagctggaggacattttccagcaggagttttccaccccttccaggaagggcctggtgttgcagctgatccagtcttaccagcggatgccaggcaatgccatggtgaggggcttccgagtggcttataagcggcacgtgctgaccatggatgacttggggaccttgtatggacagaactggctcaatgaccaggtgatgaacatgtatggagacctggtcatggacacagtccctgaaaaggtggacatcttcaataaggagctactgctaatccccatccacctggaggtgcattggtccctcatctctgttgatgtgaggcgacgcaccatcacctattttgactcgcagcgtaccctaaaccgccgctgccctaagcatattgccaagtatctacaggcagaggcggtaaagaaagaccgactggatttccaccagggctggaaaggttacttcaaaatgaatgtggccaggcagaataatgacagtgactgtggtgcttttgtgttgcagtactgcaagcatctggccctgtctcagccattcagcttcacccagcaggacatgcccaaacttcgtcggcagatctacaaggagctgtgtcactgcaaactcactgtgtgagcctcgtaccccagaccccaagcccataaatgggaagggagacatgggagtcccttcccaagaaactccagttcctttcctctcttgcctcttcccactcacttccctttggtttttcatatttaaatgtttcaatttctgtatttttttttctttgagagaatacttgttgatttctgatgtgcag

SEQ ID NO: 187411 - DNA, 536 bp, Homo sapiens
  Payload ID: 16898
  Gene Symbol: SENP3
  Gene Name: SUMO1/sentrin/SMT3 specific peptidase 3
  ENST ID: ENST00000582789
  CDS Start-End: 1-333
gtggacatcttcaataaggagctactgctaatccccatccacctggaggtgcattggtccctcatctctgttgatgtgaggcgacgcaccatcacctattttgactcgcagcgtaccctaaaccgccgctgccctaagcatattgccaagtatctacaggcagaggcggtaaagaaagaccgactggatttccaccagggctggaaaggttacttcaaaatgtactgcaagcatctggccctgtctcagccattcagcttcacccagcaggacatgcccaaacttcgtcggcagatctacaaggagctgtgtcactgcaaactcactgtgtgagcctcgtaccccagaccccaagcccataaatgggaagggagacatgggagtcccttcccaagaaactccagttcctttcctctcttgcctcttcccactcacttccctttggtttttcatatttaaatgtttcaatttctgtatttttttttctttgagagaatacttgttgatttctgatgtgcagggggtggctacagaaa

SEQ ID NO: 187412 - DNA, 606 bp, Homo sapiens
  Payload ID: 16898
  Gene Symbol: SENP3
  Gene Name: SUMO1/sentrin/SMT3 specific peptidase 3
  ENST ID: ENST00000610454
  CDS Start-End: 1-534
ttctatgataaactccgtaccaagggttatgatggggtgaaaaggtggaccaaaaacgtggacatcttcaataaggagctactgctaatccccatccacctggaggtgcattggtccctcatctctgttgatgtgaggcgacgcaccatcacctattttgactcgcagcgtaccctaaaccgccgctgccctaagcatattgccaagtatctacaggcagaggcggtaaagaaagaccgactggatttccaccagggctggaaaggttacttcaaaatgaatgtggccaggcagaataatgacagtgactgtggtgcttttgtgttgcagtactgcaagcatctggccctgtctcagccattcagcttcacccagcaggacatgcccaaacttcgtcggcagatctacaaggagctgtgtcactgcaaactcactgtgggagtgtggccctgtggcctgggtggagcagtcatcctcccccttccccgtgcagggagcaggaaatcagtgctgggggtggtgggcggacaataggatcactgcctgccagatcttcaaacttttatatatatatatatatatatatatatatatatatatatatat

SEQ ID NO: 187413 - DNA, 634 bp, Homo sapiens
  Payload ID: 16898
  Gene Symbol: SENP3
  Gene Name: SUMO1/sentrin/SMT3 specific peptidase 3
  ENST ID: ENST00000619785
  CDS Start-End: 1-190
ccagtcttaccagcggatgccaggcaatgccatggtgaggggcttccgagtggcttataagcggcacgtgctgaccatggatgacttggggaccttgtatggacagaactggctcaatgaccagctgcctcccatcttctccccaggtgatgaacatgtatggagacctggtcatggacacagtccctgaaaaggtgcatttcttcaatagtttcttctatgataaactccgtaccaagggttatgatggggtgaaaaggtggaccaaaaacgtggacatcttcaataaggagctactgctaatccccatccacctggaggtgcattggtccctcatctctgttgatgtgaggcgacgcaccatcacctattttgactcgcagcgtaccctaaaccgccgctgccctaagcatattgccaagtatctacaggcagaggcggtaaagaaagaccgactggatttccaccagggctggaaaggttacttcaaaatgaatgtggccaggcagaataatgacagtgactgtggtgcttttgtgttgcagtactgcaagcatctggccctgtctcagccattcagcttcacccagcaggacatgcccaaacttcgtcggcagatctacaaggagctgtg

SEQ ID NO: 187414 - DNA, 1891 bp, Homo sapiens
  Payload ID: 16899
  Gene Symbol: SIMC1
  Gene Name: SUMO-interacting motifs containing 1
  Uniprot ID: Q8NDZ2
  ENST ID: ENST00000332772
  CDS Start-End: 346-1347
ggatcatttcacctgtaacagaatacccaactcaggcttggcccaacagtcaagttgagccaagccaacagacttggctcaatcagctcgcatgactggaagttcatcagtagagtggacatcatggcggtttgatctagcagcacaggagtcattaaagaaccagtttctctttctctgttttgccatctgtagttttgggtatatcctgaggttgataggttcagtgagagggagagattgacttcccatggctgcctcttaaatcaaatgatctacaatcctagagattccagtagatatctgattgcagcttaggtgttagaaaattataattatctgcagatgcctagatcctttgaacaagtaataatacttaaaaaatggtttctgaaaccttataagggacaaactctgcctgggcgagtccttttcctgcgttatgtcgttcagaccctagaagatgactttcagcagaccctgaggaggcaacggcagcacctgcagcaatccattgcaaacatggtgctttcctgtgacaagcagccccacaatgtcagggatgttatcaagtggctggtcaaagcagtaactgaagatggattgactcagcccccaaatggaaatcaaacgtcttcaggaacaggaatcttgaaagccagcagtagccacccttcttcccagcccaacctgacaaagaacaccaatcagctgattgtgtgccagcttcagaggatgctctccatagccgtagaggtggacaggacccccacctgcagctccaataaaattgccgagatgatgtttgggtttgtgctggacattcctgagaggagccagagagaaatgttctttactaccatggaaagccaccttctgcgctgcaaagtgttagaaatcatattcctccacagctgtgagacacccacccgcctgcctctgtctctggcccaggccctctactttctgaataattctacgtcactgctcaagtgtcagtcagataaaagccagtggcagacttgggacgaattggttgagcatctgcagtttctgctgtccagttatcaacatgttttaagagaacacttaaggagttccgtgatcgaccgaaaggacttaataatcaaaaggattaagcccaaaccccagcaaggagatgacatcacagtggtagacgtagagaagcagattgaggccttccgcagccgcctgatccagatgctgggggagcctcttgtcccccaactccaagacaaagtgcacttgttgaagctcctgctcttctatgctgcggacttgaaccctgatgcagagccctttcaaaagggctggagcggctcctgagggcctgccaagcactgaatgccaagaatacctcctgaactctctctccaactgctcagaagctctaaaagcatgaaaagtggttaaaatcttacaggaccaaacctgcattatttaatcagtaggttgtaatttctaactctagtaaatatctttttttaaataatcctatcctagcctgttctcaaatatggcttaaatatacaaggtatatatattttttaataaattatttatctatacttttttgaaacaggttaatactctgtgcatcacatgtttaacattttcattcaagatgtggaaaaaatccctctgctgaacctagtctatacaccaatattatgtcattcaaggtaccgacaacctgtttcaggagagagacgttcatttttccctaatgaaatgcaagcattctgttagacctattatattgcctgttaatttgactgtaatgaatagggggtagaaacaaaaggatcaagtgtgttataaaacatttgatgttaaaaggagacaataaaaaggcaatggtttttcaaaa

SEQ ID NO: 187415 - DNA, 2056 bp, Homo sapiens
  Payload ID: 16899
  Gene Symbol: SIMC1
  Gene Name: SUMO-interacting motifs containing 1
  Uniprot ID: Q8NDZ2
  ENST ID: ENST00000341199
  CDS Start-End: 143-1516
gctcggggcggggccggcgtggcggtggcccgggttgtagccgccgccgctgccgccgccccgccgccgccacctcagaagcaggaaccgaagtcgtcgccgccgccgccactgcctgggtcttcggtcggggcccgcagccatggaggatttcatcgtgatctcggacgacagcggctctgagagctccgggggcgcccgcccgggccggtcgcggaggccgcgccgggccctgtcgcgaacctccggcgcgctgccccgccggaccgtgaacaagggtcaaaaattagaacccatccctcatcgaagactaagaatggtaacaaataccattgaagagaattttcctctggggactgtgcagtttttgatggactttgtgtcaccccagcattacccaccaagagaaatcgtggctcacatcatccagaaaatcttgctcagtggctctgagactgtggatgtcctaaaggaggcctacatgcttctcatgaaaattcaacagctacatccagccaatgccaagacagtggagtgggactggaaactgctcacctatgtcatggaggaagagggacaaactctgcctgggcgagtccttttcctgcgttatgtcgttcagaccctagaagatgactttcagcagaccctgaggaggcaacggcagcacctgcagcaatccattgcaaacatggtgctttcctgtgacaagcagccccacaatgtcagggatgttatcaagtggctggtcaaagcagtaactgaagatggattgactcagcccccaaatggaaatcaaacgtcttcaggaacaggaatcttgaaagccagcagtagccacccttcttcccagcccaacctgacaaagaacaccaatcagctgattgtgtgccagcttcagaggatgctctccatagccgtagaggtggacaggacccccacctgcagctccaataaaattgccgagatgatgtttgggtttgtgctggacattcctgagaggagccagagagaaatgttctttactaccatggaaagccaccttctgcgctgcaaagtgttagaaatcatattcctccacagctgtgagacacccacccgcctgcctctgtctctggcccaggccctctactttctgaataattctacgtcactgctcaagtgtcagtcagataaaagccagtggcagacttgggacgaattggttgagcatctgcagtttctgctgtccagttatcaacatgttttaagagaacacttaaggagttccgtgatcgaccgaaaggacttaataatcaaaaggattaagcccaaaccccagcaaggagatgacatcacagtggtagacgtagagaagcagattgaggccttccgcagccgcctgatccagatgctgggggagcctcttgtcccccaactccaagacaaagtgcacttgttgaagctcctgctcttctatgctgcggacttgaaccctgatgcagagccctttcaaaagggctggagcggctcctgagggcctgccaagcactgaatgccaagaatacctcctgaactctctctccaactgctcagaagctctaaaagcatgaaaagtggttaaaatcttacaggaccaaacctgcattatttaatcagtaggttgtaatttctaactctagtaaatatctttttttaaataatcctatcctagcctgttctcaaatatggcttaaatatacaaggtatatatattttttaataaattatttatctatacttttttgaaacaggttaatactctgtgcatcacatgtttaacattttcattcaagatgtggaaaaaatccctctgctgaacctagtctatacaccaatattatgtcattcaaggtaccgacaacctgtttcaggagagagacgttcatttttccctaatgaaatgcaagcattctgttagacctattatattgcctgttaatttgactgtaatgaatagggggtagaaacaaaaggatcaagtgtgttataaaacatttgatgttaaaaggagacaataaaaaggcaatggtttttc

SEQ ID NO: 187416 - DNA, 3572 bp, Homo sapiens
  Payload ID: 16899
  Gene Symbol: SIMC1
  Gene Name: SUMO-interacting motifs containing 1
  Uniprot ID: Q8NDZ2
  ENST ID: ENST00000443967
  CDS Start-End: 408-3026
gctcggggcggggccggcgtggcggtggcccgggttgtagccgccgccgctgccgccgccccgccgccgccacctcagaagcaggaaccgaagtcgtcgccgccgccgccactgcctgggtcttcggtcggggcccgcagccatggaggatttcatcgtgatctcggacgacagcggctctgagagctccgggggcgcccgcccgggccggtcgcggaggccgcgccgggccctgtcgcgaacctccggcgcgctgccccgccggaccgtgacggtgtcttgctgtgtcactcaggctggagtgcagtcgcacaacctcagctcactgcaacctctgcctcccgggttcaagtgattctcctgcctcagcttcctgagtagctgggattacaggctgaacaagaagcatggcaccagcatctgcttctggtgaggacctcaggaagcttccaaccatggcagaggtgaatggggagcaggacttcattgacttaactagagagaccagaccaaggacaaaagatcgcagtggactgtatgtgattgacctgacaagagctgagggagaaaatagacctattgccactcttgacttaactttagaacctgtcactccttcccagaaggagccaaccagtcttcagacatgtgccagcctctctggcaaagcggtgatggaagggcacgtggacagaagctctcagcctacagcacggagaatcattaacagtgatcctgtagatttggacctagtggaagaaaacacctttgtaggtcccccacccgctacatccatcagtggaggctctgtttatccaacagagcctaattgtagctcagccacattcacaggtaacctcagcttcttggcaagtctacagctgtcttcagatgttagctccctctccccaacaagcaataatagtaggagcagcagcagcagcagcaatcaaaaagcacccttgccatgcccacagcaagatgtatctcgcccaccacaggccttgccgtgccccctgcgacctttgccatgcccaccgagagcctcaccatgtccaccacgagcctcctcatgcccaccacgagccttgtcatgcccatcacaaaccatgcagtgccaactaccagctctaactcacccacctcaagaagtgccatgccctcggcagaatatcccaggcccacctcaagactctctgggcctacctcaagatgtgccagggctgcctcaaagcatattacatccacaagatgtggcatacctgcaagacatgccacggtcaccaggagatgtgccacagtcaccaagtgatgtttcaccgtcaccagatgcaccacagtcaccagggggcatgccacacttaccgggagatgtgttacattcacctggagacatgccacactcatcaggggacgtgacacactcacctagagacatccctcacttaccaggagacaggcctgactttacccagaatgatgtacagaaccgtgacatgcctatggatatctcagctctgtcctctccaagctgctctcccagcccacagtctgaaactcccttagagaaagttccttggctctctgtcatggaaaccccagccagaaaagaaatatcactgtcagagcctgccaaacctgggtctgcccacgtacaatcacgaacaccacaaggtgggttgtacaacagaccatgcctgcatagactgaagtacttcttacgtcctccggttcatcacctcttctttcagacgctaataccggataaagacacaagagagaacaagggtcaaaaattagaacccatccctcatcgaagactaagaatggtaacaaataccattgaagagaattttcctctggggactgtgcagtttttgatggactttgtgtcaccccagcattacccaccaagagaaatcgtggctcacatcatccagaaaatcttgctcagtggctctgagactgtggatgtcctaaaggaggcctacatgcttctcatgaaaattcaacagctacatccagccaatgccaagacagtggagtgggactggaaactgctcacctatgtcatggaggaagagggacaaactctgcctgggcgagtccttttcctgcgttatgtcgttcagaccctagaagatgactttcagcagaccctgaggaggcaacggcagcacctgcagcaatccattgcaaacatggtgctttcctgtgacaagcagccccacaatgtcagggatgttatcaagtggctggtcaaagcagtaactgaagatggattgactcagcccccaaatggaaatcaaacgtcttcaggaacaggaatcttgaaagccagcagtagccacccttcttcccagcccaacctgacaaagaacaccaatcagctgattgtgtgccagcttcagaggatgctctccatagccgtagaggtggacaggacccccacctgcagctccaataaaattgccgagatgatgtttgggtttgtgctggacattcctgagaggagccagagagaaatgttctttactaccatggaaagccaccttctgcgctgcaaagtgttagaaatcatattcctccacagctgtgagacacccacccgcctgcctctgtctctggcccaggccctctactttctgaataattctacgtcactgctcaagtgtcagtcagataaaagccagtggcagacttgggacgaattggttgagcatctgcagtttctgctgtccagttatcaacatgttttaagagaacacttaaggagttccgtgatcgaccgaaaggacttaataatcaaaaggattaagcccaaaccccagcaaggagatgacatcacagtggtagacgtagagaagcagattgaggccttccgcagccgcctgatccagatgctgggggagcctcttgtcccccaactccaagacaaagtgcacttgttgaagctcctgctcttctatgctgcggacttgaaccctgatgcagagccctttcaaaagggctggagcggctcctgagggcctgccaagcactgaatgccaagaatacctcctgaactctctctccaactgctcagaagctctaaaagcatgaaaagtggttaaaatcttacaggaccaaacctgcattatttaatcagtaggttgtaatttctaactctagtaaatatctttttttaaataatcctatcctagcctgttctcaaatatggcttaaatatacaaggtatatatattttttaataaattatttatctatacttttttgaaacaggttaatactctgtgcatcacatgtttaacattttcattcaagatgtggaaaaaatccctctgctgaacctagtctatacaccaatattatgtcattcaaggtaccgacaacctgtttcaggagagagacgttcatttttccctaatgaaatgcaagcattctgttagacctattatattgcctgttaatttgactgtaatgaatagggggtagaaacaaaaggatcaagtgtgttataaaacatttgatgttaaaaggagacaataaaaaggcaatggtttttcaaaata

SEQ ID NO: 187417 - DNA, 1925 bp, Homo sapiens
  Payload ID: 16899
  Gene Symbol: SIMC1
  Gene Name: SUMO-interacting motifs containing 1
  Uniprot ID: Q8NDZ2
  ENST ID: ENST00000430704
  CDS Start-End: 143-1516
gctcggggcggggccggcgtggcggtggcccgggttgtagccgccgccgctgccgccgccccgccgccgccacctcagaagcaggaaccgaagtcgtcgccgccgccgccactgcctgggtcttcggtcggggcccgcagccatggaggatttcatcgtgatctcggacgacagcggctctgagagctccgggggcgcccgcccgggccggtcgcggaggccgcgccgggccctgtcgcgaacctccggcgcgctgccccgccggaccgtgaacaagggtcaaaaattagaacccatccctcatcgaagactaagaatggtaacaaataccattgaagagaattttcctctggggactgtgcagtttttgatggactttgtgtcaccccagcattacccaccaagagaaatcgtggctcacatcatccagaaaatcttgctcagtggctctgagactgtggatgtcctaaaggaggcctacatgcttctcatgaaaattcaacagctacatccagccaatgccaagacagtggagtgggactggaaactgctcacctatgtcatggaggaagagggacaaactctgcctgggcgagtccttttcctgcgttatgtcgttcagaccctagaagatgactttcagcagaccctgaggaggcaacggcagcacctgcagcaatccattgcaaacatggtgctttcctgtgacaagcagccccacaatgtcagggatgttatcaagtggctggtcaaagcagtaactgaagatggattgactcagcccccaaatggaaatcaaacgtcttcaggaacaggaatcttgaaagccagcagtagccacccttcttcccagcccaacctgacaaagaacaccaatcagctgattgtgtgccagcttcagaggatgctctccatagccgtagaggtggacaggacccccacctgcagctccaataaaattgccgagatgatgtttgggtttgtgctggacattcctgagaggagccagagagaaatgttctttactaccatggaaagccaccttctgcgctgcaaagtgttagaaatcatattcctccacagctgtgagacacccacccgcctgcctctgtctctggcccaggccctctactttctgaataattctacgtcactgctcaagtgtcagtcagataaaagccagtggcagacttgggacgaattggttgagcatctgcagtttctgctgtccagttatcaacatgttttaagagaacacttaaggagttccgtgatcgaccgaaaggacttaataatcaaaaggattaagcccaaaccccagcaaggagatgacatcacagtggtagacgtagagaagcagattgaggccttccgcagccgcctgatccagatgctgggggagcctcttgtcccccaactccaagacaaagtgcacttgttgaagctcctgctcttctatgctgcggacttgaaccctgatgcagagccctttcaaaagggctggagcggctcctgagggcctgccaagcactgaatgccaagaatacctcctgaactctctctccaactgctcagaagctctaaaagcatgaaaagtggttaaaatcttacaggaccaaacctgcattatttaatcagttaatactctgtgcatcacatgtttaacattttcattcaagatgtggaaaaaatccctctgctgaacctagtctatacaccaatattatgtcattcaaggtaccgacaacctgtttcaggagagagacgttcatttttccctaatgaaatgcaagcattctgttagacctattatattgcctgttaatttgactgtaatgaatagggggtagaaacaaaaggatcaagtgtgttataaaacatttgatgttaaaaggagacaataaaaaggcaatggtttttcaaaa

SEQ ID NO: 187418 - DNA, 2694 bp, Homo sapiens
  Payload ID: 16899
  Gene Symbol: SIMC1
  Gene Name: SUMO-interacting motifs containing 1
  ENST ID: ENST00000429602
  CDS Start-End: 19-2694
cggtcggggcccgcagccatggaggatttcatcgtgatctcggacgacagcggctctgagagctccgggggcgcccgcccgggccggtcgcggaggccgcgccgggccctgtcgcgaacctccggcgcgctgccccgccggaccgtggacttcattgacttaactagagagaccagaccaaggacaaaagatcgcagtggactgtatgtgattgacctgacaagagctgagggagaaaatagacctattgccactcttgacttaactttagaacctgtcactccttcccagaaggagccaaccagtcttcagacatgtgccagcctctctggcaaagcggtgatggaagggcacgtggacagaagctctcagcctacagcacggagaatcattaacagtgatcctgtagatttggacctagtggaagaaaacacctttgtaggtcccccacccgctacatccatcagtggaggctctgtttatccaacagagcctaattgtagctcagccacattcacaggtaacctcagcttcttggcaagtctacagctgtcttcagatgttagctccctctccccaacaagcaataatagtaggagcagcagcagcagcagcaatcaaaaagcacccttgccatgcccacagcaagatgtatctcgcccaccacaggccttgccgtgccccctgcgacctttgccatgcccaccgagagcctcaccatgtccaccacgagcctcctcatgcccaccacgagccttgtcatgcccatcacaaaccatgcagtgccaactaccagctctaactcacccacctcaagaagtgccatgccctcggcagaatatcccaggcccacctcaagactctctgggcctacctcaagatgtgccagggctgcctcaaagcatattacatccacaagatgtggcatacctgcaagacatgccacggtcaccaggagatgtgccacagtcaccaagtgatgtttcaccgtcaccagatgcaccacagtcaccagggggcatgccacacttaccgggagatgtgttacattcacctggagacatgccacactcatcaggggacgtgacacactcacctagagacatccctcacttaccaggagacaggcctgactttacccagaatgatgtacagaaccgtgacatgcctatggatatctcagctctgtcctctccaagctgctctcccagcccacagtctgaaactcccttagagaaagttccttggctctctgtcatggaaaccccagccagaaaagaaatatcactgtcagagcctgccaaacctgggtctgcccacgtacaatcacgaacaccacaaggtgggttgtacaacagaccatgcctgcatagactgaagtacttcttacgtcctccggttcatcacctcttctttcagacgctaataccggataaagacacaagagagaacaagggtcaaaaattagaacccatccctcatcgaagactaagaatggtaacaaataccattgaagagaattttcctctggggactgtgcagtttttgatggactttgtgtcaccccagcattacccaccaagagaaatcgtggctcacatcatccagaaaatcttgctcagtggctctgagactgtggatgtcctaaaggaggcctacatgcttctcatgaaaattcaacagctacatccagccaatgccaagacagtggagtgggactggaaactgctcacctatgtcatggaggaagagggacaaactctgcctgggcgagtccttttcctgcgttatgtcgttcagaccctagaagatgactttcagcagaccctgaggaggcaacggcagcacctgcagcaatccattgcaaacatggtgctttcctgtgacaagcagccccacaatgtcagggatgttatcaagtggctggtcaaagcagtaactgaagatggattgactcagcccccaaatggaaatcaaacgtcttcaggaacaggaatcttgaaagccagcagtagccacccttcttcccagcccaacctgacaaagaacaccaatcagctgattgtgtgccagcttcagaggatgctctccatagccgtagaggtggacaggacccccacctgcagctccaataaaattgccgagatgatgtttgggtttgtgctggacattcctgagaggagccagagagaaatgttctttactaccatggaaagccaccttctgcgctgcaaagtgttagaaatcatattcctccacagctgtgagacacccacccgcctgcctctgtctctggcccaggccctctactttctgaataattctacgtcactgctcaagtgtcagtcagataaaagccagtggcagacttgggacgaattggttgagcatctgcagtttctgctgtccagttatcaacatgttttaagagaacacttaaggagttccgtgatcgaccgaaaggacttaataatcaaaaggattaagcccaaaccccagcaaggagatgacatcacagtggtagacgtagagaagcagattgaggccttccgcagccgcctgatccagatgctgggggagcctcttgtcccccaactccaagacaaagtgcacttgttgaagctcctgctcttctatgctgcggacttgaaccctgatgcagagccctttcaaaagggctggagcggctcctga

SEQ ID NO: 187419 - DNA, 5556 bp, Homo sapiens
  Payload ID: 16900
  Gene Symbol: SUCO
  Gene Name: SUN domain containing ossification factor
  Uniprot ID: Q9UBS9
  ENST ID: ENST00000263688
  CDS Start-End: 220-3984
ccggagtcctgtgaagcgcccctgtccgcgcctctgtggggccctcagagagggctgccaggacgcgagccactgaggagccgctcagccagcgccatagcccttaggactatcggtcacattctcgcgctcctgctccggctcctccatcttggcctcggcagtggcggctgccgggaggatgtgccgccttctggcagggggaagaaggaggagaagatgaagaagcaccggcgggccttggccctggtctcctgcctctttctgtgctctctggtctggcttcccagctggcgtgtatgttgtaaagagagttcttcagcttcagcgtcatcatattactctcaagatgacaactgcgcactagaaaatgaagatgtacaattccagaaaaaggatgaaagagagggacctatcaatgccgaatcattgggaaaatcaggttcaaatttacctatttctccaaaagaacataaattaaaagatgattctattgtggatgtacaaaatacagagtcaaaaaagttaagtccaccggtggtggagacactccctacagttgatttgcatgaagagtcttccaatgcagttgtggacagtgaaactgttgaaaatatttccagctcatctacctcagaaatcactccaatctcaaagcttgatgaaatagaaaaatctggtactattccgatagccaaaccaagtgaaactgagcagtctgaaactgattgtgatgttggtgaggcccttgatgctagtgctccaattgaacaaccttcctttgtcagtccacctgacagccttgttggccagcatatagaaaatgtatcatcttcacatggtaaaggaaagataacaaaatcagaatttgaatcaaaagtttcagcaagtgaacagggcggtggtgatccaaaatctgcattgaatgcttcagataatttaaaaaatgagagctctgattatacaaaaccaggagacattgaccctacatcagtagcaagtcccaaagatccagaagatataccaacatttgatgaatggaagaagaaagttatggaagtagaaaaagaaaaaagtcagtcgatgcatgcatcttctaatggaggttcacatgccaccaaaaaggtccagaaaaatcgaaataattatgcctcagtagaatgtggtgccaaaattctagcagctaatccagaagccaagagcacatctgctattcttatagaaaatatggatctttacatgttgaatccttgcagcactaaaatttggtttgttattgaactttgtgaaccaattcaagtaaaacagcttgatattgcaaattatgaattattttcttctactcctaaagattttctggtttctatcagtgacagatatccaacaaataagtggattaagctgggtacttttcatggtagagatgagcggaatgtacagagtttccctttagatgaacagatgtatgcaaaatatgtcaagatgttcatcaagtacataaaggttgagttgctatcacattttggatcagagcacttttgtccattaagccttataagggtatttggcactagcatggtggaagaatatgaagaaattgctgattcccagtatcactcagaacgccaggaactatttgatgaggactatgattatccactggattataatactggagaggataaatcctcaaaaaatcttcttggttctgctacaaatgccattctaaatatggtgaatattgctgctaatattctgggagcaaaaactgaagacctgacagaaggaaataaaagtatatctgagaatgccactgccacagctgcacctaaaatgcctgaatcaactcctgtttcaactcctgttccatctcctgagtatgtaaccactgaagtacacacacatgacatggagccgtcaacaccagatactccaaaagagagtcccattgtacagttagttcaagaggaggaagaggaggcaagtccatctacagtgacccttctgggcagcggtgaacaggaagatgaatcatcaccctggtttgagtcagagacacaaatattttgcagtgaactgaccacaatttgttgtatttctagtttttcagaatacatatataaatggtgttcagttagagttgctctttatcggcagcgcagccgaactgctttgagtaaaggaaaagattatcttgtgttagctcaaccacccttactacttcctgcggaatcagtagatgtttcagtattgcaacctctgagtggagaattggaaaatacgaatatagaaagggaagctgaaactgttgttctgggtgatttaagtagtagtatgcaccaggatgacttggtgaatcacactgtagatgcagttgaacttgaaccaagccattctcaaactctttctcagtctcttcttttagatattaccccagaaatcaatcccttgcctaaaatagaagtatctgagtctgttgaatatgaggcaggacatataccatcaccagtgattccccaagagagttctgttgagatcgataatgaaacagaacaaaagtctgagagctttagttctatagagaaaccatctattacctatgaaacaaataaagttaatgagttaatggataatattataaaagaagatgtgaactccatgcaaattttcacaaagctgtctgaaacaatagtgccaccaataaatacagccactgtacccgacaatgaagatggggaagccaaaatgaatatagctgacacagcaaagcaaactttgatttctgttgtggattcttcttcattacctgaagtaaaagaagaagaacagtctccagaagatgcccttttgagagggttacagaggacagctacagatttttatgctgaattgcaaaattctacagatctaggatatgctaatggaaatcttgtacatggatcaaaccaaaaggagtcagtatttatgagacttaataatcgtattaaagccttagaagttaacatgtctctcagtggtcgctatctggaggagcttagccaaaggtaccgaaaacaaatggaagaaatgcaaaaggctttcaataaaacaatcgtgaaacttcagaatacttcaagaatagcagaggagcaggatcagcggcaaactgaagccatccagttgctacaggcacagctgaccaacatgacacagcttgtttcaaatttatcagcaacagtagcagaattgaaacgggaggtttcagatcgacaaagctatcttgtcatatctttggttctttgtgttgtcttgggactgatgctttgtatgcagcgttgtcgaaatacttctcaatttgatggagattatatttcaaaacttcctaaaagtaatcagtatccaagccctaaaaggtgtttctcttcctatgatgatatgaatttgaaaagaagaacttcattcccactcatgagatccaagtctctacagttaactggcaaagaagtagacccaaatgatttgtacattgtagaacccctcaagttttctccagaaaagaagaagaagcgctgcaagtacaaaattgaaaaaattgagaccataaagcctgaagaaccattgcaccccatagccaatggcgacataaaaggaagaaagccctttacgaaccagagagatttttctaatatgggagaagtttatcactcttcttataaaggtcctccatctgaaggaagctcagaaacttcatcacagtcagaagagtcctatttttgtggcatttcagcttgcacaagtctgtgcaatggacagtctcaaaagacaaaaactgagaagagggctttaaaacgaagacgatctaaagtccaagaccaaggaaaattgataaaaactctaatacagactaagtcgggatcattgccgagcctgcatgacataatcaaaggaaacaaagagatcaccgtgggaacatttggtgttacagcagtctcgggacatatctaaaattaattgaacttttcatacagaagacttttttgttgttgttctttgaagaacagtctgtagtatttgaagggtttgggggagggagaaaatattaatgggaaaggcattcagaaattatggtttctacctttttaaaaagtagatgggattgtgtcaatcttggttaatgagctacagttttacaaagctgatcacttcctataaggacaatggtagacattttataaagatgttttttcacaagattaattactgggacaaaagtaatttggaagcccagttccttaggtgggataggaatgaaagcctaaacctcttcctttagctttgttcctatttcttgcaccttcccatatttatgtgccttttgtctatttataatgccactggaagaggagggataactttttctgttatttgatttcttttataactttgttaggtttttgaagctgcaaacactacaatgctttgagggggtctgtgcctgaagctcaggagtgtggatcagacagtctaaagatcctaaaaacttgccaactggatctttgtttagcaaactcactggaaatgaacacttaatggaatttttaagtctgttctgttaggtagatggtgatgctcttgttattttcacttattcagactggattacttcttacttagttactaactcaatgaggaaaaatccctacaggatctttttttgcaaacaactgatatatgcagacaaatttttgacaaattcaccttttaaacacacttaaccatttgtgaaggttttctttagcttacattttaaacatacacaataaacactaatcctccaaactttcactgtttttattagtatgaatataaaatttgaaggtttggccaattagtacaagtctcatgatataatcactgcctgcatacatatgcacagatccagttagtgagtttgtcaagcttaatctaattggttaagtctaaagagattattattccttgatgtttgctttgtattggctacaaatgtgcagaggtaatacatatgtgatgtcgatgtctctgtctttttttttgtctttaaaaaataattggcagcaactgtatttgaataaaatgatttcttagtatgattgtacagtaatgaatgaaagtggaacatgtttctttttgaaagggagagaattgaccatttattgttgtgatgtttaagttataacttattgagcacttttagtagtgataactgtttttaaacttgcctaatacctttcttgggtattgtttgtaatgtgacttatttaacgccttttttgtttgtttaagttgctgctttaggttaacagcgtgttttagaagatttaaatttctttcctgtctgcacaattagctattcagagcaagagggcctgattttatagaagccccttgaaaagaggtccagatgagagcagagatacagtgagaaattatgtgatctgtgtgttgtgggaagagaattttcaatatgtaactacggagctgtagtgccattagaaactgtgaatttccaaataaatctgaacacttgtctttatt

SEQ ID NO: 187420 - DNA, 5916 bp, Homo sapiens
  Payload ID: 16900
  Gene Symbol: SUCO
  Gene Name: SUN domain containing ossification factor
  Uniprot ID: Q9UBS9
  ENST ID: ENST00000367723
  CDS Start-End: 125-4342
cccaaagttcgaaaccaacagaacgaaaagcaacgaagcacacttaaagtgaggaacccggcaagcggcgaaattcttgctgaagagaagaaaaagcgaaaggttttccgctgcaaccaatcagatgagaggattcttggcacgcccctttctatctaccaatcaacatctagctcaatggggcagtccattgccacagggaaagggcttggtgcagcttccctcacaacacacacgtcattctaggccattccacgaactgtgctcaaaagaggaaaacagtgcaacagttccaaagctgatcagtctcgtggtgagcagcgaaactatagacttctctaacaaaaccatggattctaggagggactgggaaagagaaaaacgaattctggaaggcaaactacaactcccaaaggcccttgcgcggactcagcgcgcgagggacgaagggcgggcgtggacgagccggtggctgcagcggcggcggtccccggagtcctgtgaagcgcccctgtccgcgcctctgtggggccctcagagagggctgccaggacgcgagccactgaggagccgctcagccagcgccatagcccttaggactatcggtcacattctcgcgctcctgctccggctcctccatcttggcctcggcagtggcggctgccgggaggatgtgccgccttctggcagggggaagaaggaggagaagatgaagaagcaccggcgggccttggccctggtctcctgcctctttctgtgctctctggtctggcttcccagctggcgtgtatgttgtaaagagagttcttcagcttcagcgtcatcatattactctcaagatgacaactgcgcactagaaaatgaagatgtacaattccagaaaaagaatacagagtcaaaaaagttaagtccaccggtggtggagacactccctacagttgatttgcatgaagagtcttccaatgcagttgtggacagtgaaactgttgaaaatatttccagctcatctacctcagaaatcactccaatctcaaagcttgatgaaatagaaaaatctggtactattccgatagccaaaccaagtgaaactgagcagtctgaaactgattgtgatgttggtgaggcccttgatgctagtgctccaattgaacaaccttcctttgtcagtccacctgacagccttgttggccagcatatagaaaatgtatcatcttcacatggtaaaggaaagataacaaaatcagaatttgaatcaaaagtttcagcaagtgaacagggcggtggtgatccaaaatctgcattgaatgcttcagataatttaaaaaatgagagctctgattatacaaaaccaggagacattgaccctacatcagtagcaagtcccaaagatccagaagatataccaacatttgatgaatggaagaagaaagttatggaagtagaaaaagaaaaaagtcagtcgatgcatgcatcttctaatggaggttcacatgccaccaaaaaggtccagaaaaatcgaaataattatgcctcagtagaatgtggtgccaaaattctagcagctaatccagaagccaagagcacatctgctattcttatagaaaatatggatctttacatgttgaatccttgcagcactaaaatttggtttgttattgaactttgtgaaccaattcaagtaaaacagcttgatattgcaaattatgaattattttcttctactcctaaagattttctggtttctatcagtgacagatatccaacaaataagtggattaagctgggtacttttcatggtagagatgagcggaatgtacagagtttccctttagatgaacagatgtatgcaaaatatgtcaaggttgagttgctatcacattttggatcagagcacttttgtccattaagccttataagggtatttggcactagcatggtggaagaatatgaagaaattgctgattcccagtatcactcagaacgccaggaactatttgatgaggactatgattatccactggattataatactggagaggataaatcctcaaaaaatcttcttggttctgctacaaatgccattctaaatatggtgaatattgctgctaatattctgggagcaaaaactgaagacctgacagaaggaaataaaagtatatctgagaatgccactgccacagctgcacctaaaatgcctgaatcaactcctgtttcaactcctgttccatctcctgagtatgtaaccactgaagtacacacacatgacatggagccgtcaacaccagatactccaaaagagagtcccattgtacagttagttcaagaggaggaagaggaggcaagtccatctacagtgacccttctgggcagcggtgaacaggaagatgaatcatcaccctggtttgagtcagagacacaaatattttgcagtgaactgaccacaatttgttgtatttctagtttttcagaatacatatataaatggtgttcagttagagttgctctttatcggcagcgcagccgaactgctttgagtaaaggaaaagattatcttgtgttagctcaaccacccttactacttcctgcggaatcagtagatgtttcagtattgcaacctctgagtggagaattggaaaatacgaatatagaaagggaagctgaaactgttgttctgggtgatttaagtagtagtatgcaccaggatgacttggtgaatcacactgtagatgcagttgaacttgaaccaagccattctcaaactctttctcagtctcttcttttagatattaccccagaaatcaatcccttgcctaaaatagaagtatctgagtctgttgaatatgaggcaggacatataccatcaccagtgattccccaagagagttctgttgagatcgataatgaaacagaacaaaagtctgagagctttagttctatagagaaaccatctattacctatgaaacaaataaagttaatgagttaatggataatattataaaagaagatgtgaactccatgcaaattttcacaaagctgtctgaaacaatagtgccaccaataaatacagccactgtacccgacaatgaagatggggaagccaaaatgaatatagctgacacagcaaagcaaactttgatttctgttgtggattcttcttcattacctgaagtaaaagaagaagaacagtctccagaagatgcccttttgagagggttacagaggacagctacagatttttatgctgaattgcaaaattctacagatctaggatatgctaatggaaatcttgtacatggatcaaaccaaaaggagtcagtatttatgagacttaataatcgtattaaagccttagaagttaacatgtctctcagtggtcgctatctggaggagcttagccaaaggtaccgaaaacaaatggaagaaatgcaaaaggctttcaataaaacaatcgtgaaacttcagaatacttcaagaatagcagaggagcaggatcagcggcaaactgaagccatccagttgctacaggcacagctgaccaacatgacacagcttgtttcaaatttatcagcaacagtagcagaattgaaacgggaggtttcagatcgacaaagctatcttgtcatatctttggttctttgtgttgtcttgggactgatgctttgtatgcagcgttgtcgaaatacttctcaatttgatggagattatatttcaaaacttcctaaaagtaatcagtatccaagccctaaaaggtgtttctcttcctatgatgatatgaatttgaaaagaagaacttcattcccactcatgagatccaagtctctacagttaactggcaaagaagtagacccaaatgatttgtacattgtagaacccctcaagttttctccagaaaagaagaagaagcgctgcaagtacaaaattgaaaaaattgagaccataaagcctgaagaaccattgcaccccatagccaatggcgacataaaaggaagaaagccctttacgaaccagagagatttttctaatatgggagaagtttatcactcttcttataaaggtcctccatctgaaggaagctcagaaacttcatcacagtcagaagagtcctatttttgtggcatttcagcttgcacaagtctgtgcaatggacagtctcaaaagacaaaaactgagaagagggctttaaaacgaagacgatctaaagtccaagaccaaggaaaattgataaaaactctaatacagactaagtcgggatcattgccgagcctgcatgacataatcaaaggaaacaaagagatcaccgtgggaacatttggtgttacagcagtctcgggacatatctaaaattaattgaacttttcatacagaagacttttttgttgttgttctttgaagaacagtctgtagtatttgaagggtttgggggagggagaaaatattaatgggaaaggcattcagaaattatggtttctacctttttaaaaagtagatgggattgtgtcaatcttggttaatgagctacagttttacaaagctgatcacttcctataaggacaatggtagacattttataaagatgttttttcacaagattaattactgggacaaaagtaatttggaagcccagttccttaggtgggataggaatgaaagcctaaacctcttcctttagctttgttcctatttcttgcaccttcccatatttatgtgccttttgtctatttataatgccactggaagaggagggataactttttctgttatttgatttcttttataactttgttaggtttttgaagctgcaaacactacaatgctttgagggggtctgtgcctgaagctcaggagtgtggatcagacagtctaaagatcctaaaaacttgccaactggatctttgtttagcaaactcactggaaatgaacacttaatggaatttttaagtctgttctgttaggtagatggtgatgctcttgttattttcacttattcagactggattacttcttacttagttactaactcaatgaggaaaaatccctacaggatctttttttgcaaacaactgatatatgcagacaaatttttgacaaattcaccttttaaacacacttaaccatttgtgaaggttttctttagcttacattttaaacatacacaataaacactaatcctccaaactttcactgtttttattagtatgaatataaaatttgaaggtttggccaattagtacaagtctcatgatataatcactgcctgcatacatatgcacagatccagttagtgagtttgtcaagcttaatctaattggttaagtctaaagagattattattccttgatgtttgctttgtattggctacaaatgtgcagaggtaatacatatgtgatgtcgatgtctctgtctttttttttgtctttaaaaaataattggcagcaactgtatttgaataaaatgatttcttagtatgattgtacagtaatgaatgaaagtggaacatgtttctttttgaaagggagagaattgaccatttattgttgtgatgtttaagttataacttattgagcacttttagtagtgataactgtttttaaacttgcctaatacctttcttgggtattgtttgtaatgtgacttatttaacgccttttttgtttgtttaagttgctgctttaggttaacagcgtgttttagaagatttaaatttctttcctgtctgcacaattagctattcagagcaagagggcctgattttatagaagccccttgaaaagaggtccagatgagagcagagatacagtgagaaattatgtgatctgtgtgttgtgggaagagaattttcaatatgtaactacggagctgtagtgccattagaaactgtgaatttccaaataaatctgaacacttgtctttattaa

SEQ ID NO: 187421 - DNA, 2925 bp, Homo sapiens
  Payload ID: 16900
  Gene Symbol: SUCO
  Gene Name: SUN domain containing ossification factor
  ENST ID: ENST00000610051
  CDS Start-End: 254-2905
gtggacgagccggtggctgcagcggcggcggtccccggagtcctgtgaagcgcccctgtccgcgcctctgtggggccctcagagagggctgccaggacgcgagccactgaggagccgctcagccagcgccatagcccttaggactatcggtcacattctcgcgctcctgctccggctcctccatcttggcctcggcagtggcggctgccgggaggatgtgccgccttctggcagggggaagaaggaggagaagatgaagaagcaccggcgggccttggccctggtctcctgcctctttctgtgctctctggtctggcttcccagctggcgtgtatgttgtaaagagagttcttcagcttcagcgtcatcatattactctcaagatgacaactgcgcactagaaaatgaagatgtacaattccagaaaaagaatacagagtcaaaaaagttaagtccaccggtggtggagacactccctacagttgatttgcatgaagagtcttccaatgcagttgtggacagtgaaactgttgaaaatatttccagctcatctacctcagaaatcactccaatctcaaagcttgatgaaatagaaaaatctggtactattccgatagccaaaccaagtgaaactgagcagtctgaaactgattgtgatgttggtgaggcccttgatgctagtgctccaattgaacaaccttcctttgtcagtccacctgacagccttgttggccagcatatagaaaatgtatcatcttcacatggtaaaggaaagataacaaaatcagaatttgaatcaaaagtttcagcaagtgaacagggcggtggtgatccaaaatctgcattgaatgcttcagataatttaaaaaatgagagctctgattatacaaaaccaggagacattgaccctacatcagtagcaagtcccaaagatccagaagatataccaacatttgatgaatggaagaagaaagttatggaagtagaaaaagaaaaaagtcagtcgatgcatgcatcttctaatggaggttcacatgccaccaaaaaggtccagaaaaatcgaaataattatgcctcagtagaatgtggtgccaaaattctagcagctaatccagaagccaagagcacatctgctattcttatagaaaatatggatctttacatgttgaatccttgcagcactaaaatttggtttgttattgaactttgtgaaccaattcaagtaaaacagcttgatattgcaaattatgaattattttcttctactcctaaagattttctggtttctatcagtgacagatatccaacaaataagtggattaagctgggtacttttcatggtagagatgagcggaatgtacagagtttccctttagatgaacagatgtatgcaaaatatgtcaagatgttcatcaagtacataaaggttgagttgctatcacattttggatcagagcacttttgtccattaagccttataagggtatttggcactagcatggtggaagaatatgaagaaattgctgattcccagtatcactcagaacgccaggaactatttgatgaggactatgattatccactggattataatactggagaggataaatcctcaaaaaatcttcttggttctgctacaaatgccattctaaatatggtgaatattgctgctaatattctgggagcaaaaactgaagacctgacagaaggaaataaaagtatatctgagaatgccactgccacagctgcacctaaaatgcctgaatcaactcctgtttcaactcctgttccatctcctgagtatgtaaccactgaagtacacacacatgacatggagccgtcaacaccagatactccaaaagagagtcccattgtacagttagttcaagaggaggaagaggaggcaagtccatctacagtgacccttctgggcagcggtgaacaggaagatgaatcatcaccctggtaccgaaaacaaatggaagaaatgcaaaaggctttcaataaaacaatcgtgaaacttcagaatacttcaagaatagcagaggagcaggatcagcggcaaactgaagccatccagttgctacaggcacagctgaccaacatgacacagcttgtttcaaatttatcagcaacagtagcagaattgaaacgggaggtttcagatcgacaaagctatcttgtcatatctttggttctttgtgttgtcttgggactgatgctttgtatgcagcgttgtcgaaatacttctcaatttgatggagattatatttcaaaacttcctaaaagtaatcagtatccaagccctaaaaggtgtttctcttcctatgatgatatgaatttgaaaagaagaacttcattcccactcatgagatccaagtctctacagttaactggcaaagaagtagacccaaatgatttgtacattgtagaacccctcaagttttctccagaaaagaagaagaagcgctgcaagtacaaaattgaaaaaattgagaccataaagcctgaagaaccattgcaccccatagccaatggcgacataaaaggaagaaagccctttacgaaccagagagatttttctaatatgggagaagtttatcactcttcttataaaggtcctccatctgaaggaagctcagaaacttcatcacagtcagaagagtcctatttttgtggcatttcagcttgcacaagtctgtgcaatggacagtctcaaaagacaaaaactgagaagagggctttaaaacgaagacgatctaaagtccaagaccaaggaaaattgataaaaactctaatacagactaagtcgggatcattgccgagcctgcatgacataatcaaaggaaacaaagagatcaccgtgggaacatttggtgttacagcagtctcgggacatatctaaaattaattgaacttttcata

SEQ ID NO: 187422 - DNA, 5790 bp, Homo sapiens
  Payload ID: 16900
  Gene Symbol: SUCO
  Gene Name: SUN domain containing ossification factor
  Uniprot ID: Q9UBS9
  ENST ID: ENST00000608151
  CDS Start-End: 1-4218
atgagaggattcttggcacgcccctttctatctaccaatcaacatctagctcaatggggcagtccattgccacagggaaagggcttggtgcagcttccctcacaacacacacgtcattctaggccattccacgaactgtgctcaaaagaggaaaacagtgcaacagttccaaagctgatcagtctcgtggtgagcagcgaaactatagacttctctaacaaaaccatggattctaggagggactgggaaagagaaaaacgaattctggaaggcaaactacaactcccaaaggcccttgcgcggactcagcgcgcgagggacgaagggcgggcgtggacgagccggtggctgcagcggcggcggtccccggagtcctgtgaagcgcccctgtccgcgcctctgtggggccctcagagagggctgccaggacgcgagccactgaggagccgctcagccagcgccatagcccttaggactatcggtcacattctcgcgctcctgctccggctcctccatcttggcctcggcagtggcggctgccgggaggatgtgccgccttctggcagggggaagaaggaggagaagatgaagaagcaccggcgggccttggccctggtctcctgcctctttctgtgctctctggtctggcttcccagctggcgtgtatgttgtaaagagagttcttcagcttcagcgtcatcatattactctcaagatgacaactgcgcactagaaaatgaagatgtacaattccagaaaaagaatacagagtcaaaaaagttaagtccaccggtggtggagacactccctacagttgatttgcatgaagagtcttccaatgcagttgtggacagtgaaactgttgaaaatatttccagctcatctacctcagaaatcactccaatctcaaagcttgatgaaatagaaaaatctggtactattccgatagccaaaccaagtgaaactgagcagtctgaaactgattgtgatgttggtgaggcccttgatgctagtgctccaattgaacaaccttcctttgtcagtccacctgacagccttgttggccagcatatagaaaatgtatcatcttcacatggtaaaggaaagataacaaaatcagaatttgaatcaaaagtttcagcaagtgaacagggcggtggtgatccaaaatctgcattgaatgcttcagataatttaaaaaatgagagctctgattatacaaaaccaggagacattgaccctacatcagtagcaagtcccaaagatccagaagatataccaacatttgatgaatggaagaagaaagttatggaagtagaaaaagaaaaaagtcagtcgatgcatgcatcttctaatggaggttcacatgccaccaaaaaggtccagaaaaatcgaaataattatgcctcagtagaatgtggtgccaaaattctagcagctaatccagaagccaagagcacatctgctattcttatagaaaatatggatctttacatgttgaatccttgcagcactaaaatttggtttgttattgaactttgtgaaccaattcaagtaaaacagcttgatattgcaaattatgaattattttcttctactcctaaagattttctggtttctatcagtgacagatatccaacaaataagtggattaagctgggtacttttcatggtagagatgagcggaatgtacagagtttccctttagatgaacagatgtatgcaaaatatgtcaaggttgagttgctatcacattttggatcagagcacttttgtccattaagccttataagggtatttggcactagcatggtggaagaatatgaagaaattgctgattcccagtatcactcagaacgccaggaactatttgatgaggactatgattatccactggattataatactggagaggataaatcctcaaaaaatcttcttggttctgctacaaatgccattctaaatatggtgaatattgctgctaatattctgggagcaaaaactgaagacctgacagaaggaaataaaagtatatctgagaatgccactgccacagctgcacctaaaatgcctgaatcaactcctgtttcaactcctgttccatctcctgagtatgtaaccactgaagtacacacacatgacatggagccgtcaacaccagatactccaaaagagagtcccattgtacagttagttcaagaggaggaagaggaggcaagtccatctacagtgacccttctgggcagcggtgaacaggaagatgaatcatcaccctggtttgagtcagagacacaaatattttgcagtgaactgaccacaatttgttgtatttctagtttttcagaatacatatataaatggtgttcagttagagttgctctttatcggcagcgcagccgaactgctttgagtaaaggaaaagattatcttgtgttagctcaaccacccttactacttcctgcggaatcagtagatgtttcagtattgcaacctctgagtggagaattggaaaatacgaatatagaaagggaagctgaaactgttgttctgggtgatttaagtagtagtatgcaccaggatgacttggtgaatcacactgtagatgcagttgaacttgaaccaagccattctcaaactctttctcagtctcttcttttagatattaccccagaaatcaatcccttgcctaaaatagaagtatctgagtctgttgaatatgaggcaggacatataccatcaccagtgattccccaagagagttctgttgagatcgataatgaaacagaacaaaagtctgagagctttagttctatagagaaaccatctattacctatgaaacaaataaagttaatgagttaatggataatattataaaagaagatgtgaactccatgcaaattttcacaaagctgtctgaaacaatagtgccaccaataaatacagccactgtacccgacaatgaagatggggaagccaaaatgaatatagctgacacagcaaagcaaactttgatttctgttgtggattcttcttcattacctgaagtaaaagaagaagaacagtctccagaagatgcccttttgagagggttacagaggacagctacagatttttatgctgaattgcaaaattctacagatctaggatatgctaatggaaatcttgtacatggatcaaaccaaaaggagtcagtatttatgagacttaataatcgtattaaagccttagaagttaacatgtctctcagtggtcgctatctggaggagcttagccaaaggtaccgaaaacaaatggaagaaatgcaaaaggctttcaataaaacaatcgtgaaacttcagaatacttcaagaatagcagaggagcaggatcagcggcaaactgaagccatccagttgctacaggcacagctgaccaacatgacacagcttgtttcaaatttatcagcaacagtagcagaattgaaacgggaggtttcagatcgacaaagctatcttgtcatatctttggttctttgtgttgtcttgggactgatgctttgtatgcagcgttgtcgaaatacttctcaatttgatggagattatatttcaaaacttcctaaaagtaatcagtatccaagccctaaaaggtgtttctcttcctatgatgatatgaatttgaaaagaagaacttcattcccactcatgagatccaagtctctacagttaactggcaaagaagtagacccaaatgatttgtacattgtagaacccctcaagttttctccagaaaagaagaagaagcgctgcaagtacaaaattgaaaaaattgagaccataaagcctgaagaaccattgcaccccatagccaatggcgacataaaaggaagaaagccctttacgaaccagagagatttttctaatatgggagaagtttatcactcttcttataaaggtcctccatctgaaggaagctcagaaacttcatcacagtcagaagagtcctatttttgtggcatttcagcttgcacaagtctgtgcaatggacagtctcaaaagacaaaaactgagaagagggctttaaaacgaagacgatctaaagtccaagaccaaggaaaattgataaaaactctaatacagactaagtcgggatcattgccgagcctgcatgacataatcaaaggaaacaaagagatcaccgtgggaacatttggtgttacagcagtctcgggacatatctaaaattaattgaacttttcatacagaagacttttttgttgttgttctttgaagaacagtctgtagtatttgaagggtttgggggagggagaaaatattaatgggaaaggcattcagaaattatggtttctacctttttaaaaagtagatgggattgtgtcaatcttggttaatgagctacagttttacaaagctgatcacttcctataaggacaatggtagacattttataaagatgttttttcacaagattaattactgggacaaaagtaatttggaagcccagttccttaggtgggataggaatgaaagcctaaacctcttcctttagctttgttcctatttcttgcaccttcccatatttatgtgccttttgtctatttataatgccactggaagaggagggataactttttctgttatttgatttcttttataactttgttaggtttttgaagctgcaaacactacaatgctttgagggggtctgtgcctgaagctcaggagtgtggatcagacagtctaaagatcctaaaaacttgccaactggatctttgtttagcaaactcactggaaatgaacacttaatggaatttttaagtctgttctgttaggtagatggtgatgctcttgttattttcacttattcagactggattacttcttacttagttactaactcaatgaggaaaaatccctacaggatctttttttgcaaacaactgatatatgcagacaaatttttgacaaattcaccttttaaacacacttaaccatttgtgaaggttttctttagcttacattttaaacatacacaataaacactaatcctccaaactttcactgtttttattagtatgaatataaaatttgaaggtttggccaattagtacaagtctcatgatataatcactgcctgcatacatatgcacagatccagttagtgagtttgtcaagcttaatctaattggttaagtctaaagagattattattccttgatgtttgctttgtattggctacaaatgtgcagaggtaatacatatgtgatgtcgatgtctctgtctttttttttgtctttaaaaaataattggcagcaactgtatttgaataaaatgatttcttagtatgattgtacagtaatgaatgaaagtggaacatgtttctttttgaaagggagagaattgaccatttattgttgtgatgtttaagttataacttattgagcacttttagtagtgataactgtttttaaacttgcctaatacctttcttgggtattgtttgtaatgtgacttatttaacgccttttttgtttgtttaagttgctgctttaggttaacagcgtgttttagaagatttaaatttctttcctgtctgcacaattagctattcagagcaagagggcctgattttatagaagccccttgaaaagaggtccagatgagagcagagatacagtgagaaattatgtgatctgtgtgttgtgggaagagaattttcaatatgtaactacggagctgtagtgccattagaaactgtgaatttccaaataaatctgaacacttgtctttatt

SEQ ID NO: 187423 - DNA, 5495 bp, Homo sapiens
  Payload ID: 16900
  Gene Symbol: SUCO
  Gene Name: SUN domain containing ossification factor
  ENST ID: ENST00000616058
  CDS Start-End: 1848-3923
acggagcaaggcccccggcgggcggggaggatatggggcggcagtggcggctgcaggaggcgggcgtggacgagccggtggctgcagcggcggcggtccccggagtcctgtgaagcgcccctgtccgcgcctctgtggggccctcagagagggctgccaggacgcgagccactgaggagccgctcagccagcgccatagcccttaggactatcggtcacattctcgcgctcctgctccggctcctccatcttggcctcggcagtggcggctgccgggaggatgtgccgccttctggcagggggaagaaggaggagaagatgaagaagcaccggcgggccttggccctggtctcctgcctctttctgtgctctctggtctggcttcccagctggcgtgtatgttgtaaagagagttcttcagcttcagcgtcatcatattactctcaagatgacaactgcgcactagaaaatgaagatgtacaattccagaaaaaggatgaaagagagggacctatcaatgccgaatcattgggaaaatcaggttcaaatttacctatttctccaaaagaacataaattaaaagatgattctattgtggatgtacaaaatacagagtcaaaaaagttaagtccaccggtggtggagacactccctacagttgatttgcatgaagagtcttccaatgcagttgtggacagtgaaactgttgaaaatatttccagctcatctacctcagaaatcactccaatctcaaagcttgatgaaatagaaaaatctggtactattccgatagccaaaccaagtgaaactgagcagtctgaaactgattgtgatgttggtgaggcccttgatgctagtgctccaattgaacaaccttcctttgtcagtccacctgacagccttgttggccagcatatagaaaatgtatcatcttcacatggtaaaggaaagataacaaaatcagaatttgaatcaaaagtttcagcaagtgaacagggcggtggtgatccaaaatctgcattgaatgcttcagataatttaaaaaatgagagctctgattatacaaaaccaggagacattgaccctacatcagtagcaagtcccaaagatccagaagatataccaacatttgatgaatggaagaagaaagttatggaagtagaaaaagaaaaaagtcagtcgatgcatgcatcttctaatggaggttcacatgccaccaaaaaggtccagaaaaatcgaaataattatgcctcagtagaatgtggtgccaaaattctagcagctaatccagaagccaagagcacatctgctattcttatagaaaatatggatctttacatgttgaatccttgcagcactaaaatttggtttgttattgaactttgtgaaccaattcaagtaaaacagcttgatattgcaaattatgaattattttcttctactcctaaagattttctggtttctatcagtgacagatatccaacaaataagtggattaagctgggtacttttcatggtagagatgagcggaatgtacagagtttccctttagatgaacagatgtatgcaaaatatgtcaagatgttcatcaagtacataaaggttgagttgctatcacattttggatcagagcacttttgtccattaagccttataagggtatttggcactagcatggtggaagaatatgaagaaattgctgattcccagtatcactcagaacgccaggaactatttgatgaggactatgattatccactggattataatactggagaggataaatcctcaaaaaatcttcttggttctgctacaagtatgtaaccactgaagtacacacacatgacatggagccgtcaacaccagatactccaaaagagagtcccattgtacagttagttcaagaggaggaagaggaggcaagtccatctacagtgacccttctgggcagcggtgaacaggaagatgaatcatcaccctggtttgagtcagagacacaaatattttgcagtgaactgaccacaatttgttgtatttctagtttttcagaatacatatataaatggtgttcagttagagttgctctttatcggcagcgcagccgaactgctttgagtaaaggaaaagattatcttgtgttagctcaaccacccttactacttcctgcggaatcagtagatgtttcagtattgcaacctctgagtggagaattggaaaatacgaatatagaaagggaagctgaaactgttgttctgggtgatttaagtagtagtatgcaccaggatgacttggtgaatcacactgtagatgcagttgaacttgaaccaagccattctcaaactctttctcagtctcttcttttagatattaccccagaaatcaatcccttgcctaaaatagaagtatctgagtctgttgaatatgaggcaggacatataccatcaccagtgattccccaagagagttctgttgagatcgataatgaaacagaacaaaagtctgagagctttagttctatagagaaaccatctattacctatgaaacaaataaagttaatgagttaatggataatattataaaagaagatgtgaactccatgcaaattttcacaaagctgtctgaaacaatagtgccaccaataaatacagccactgtacccgacaatgaagatggggaagccaaaatgaatatagctgacacagcaaagcaaactttgatttctgttgtggattcttcttcattacctgaagtaaaagaagaagaacagtctccagaagatgcccttttgagagggttacagaggacagctacagatttttatgctgaattgcaaaattctacagatctaggatatgctaatggaaatcttgtacatggatcaaaccaaaaggagtcagtatttatgagacttaataatcgtattaaagccttagaagttaacatgtctctcagtggtcgctatctggaggagcttagccaaaggtaccgaaaacaaatggaagaaatgcaaaaggctttcaataaaacaatcgtgaaacttcagaatacttcaagaatagcagaggagcaggatcagcggcaaactgaagccatccagttgctacaggcacagctgaccaacatgacacagcttgtttcaaatttatcagcaacagtagcagaattgaaacgggaggtttcagatcgacaaagctatcttgtcatatctttggttctttgtgttgtcttgggactgatgctttgtatgcagcgttgtcgaaatacttctcaatttgatggagattatatttcaaaacttcctaaaagtaatcagtatccaagccctaaaaggtgtttctcttcctatgatgatatgaatttgaaaagaagaacttcattcccactcatgagatccaagtctctacagttaactggcaaagaagtagacccaaatgatttgtacattgtagaacccctcaagttttctccagaaaagaagaagaagcgctgcaagtacaaaattgaaaaaattgagaccataaagcctgaagaaccattgcaccccatagccaatggcgacataaaaggaagaaagccctttacgaaccagagagatttttctaatatgggagaagtttatcactcttcttataaaggtcctccatctgaaggaagctcagaaacttcatcacagtcagaagagtcctatttttgtggcatttcagcttgcacaagtctgtgcaatggacagtctcaaaagacaaaaactgagaagagggctttaaaacgaagacgatctaaagtccaagaccaaggaaaattgataaaaactctaatacagactaagtcgggatcattgccgagcctgcatgacataatcaaaggaaacaaagagatcaccgtgggaacatttggtgttacagcagtctcgggacatatctaaaattaattgaacttttcatacagaagacttttttgttgttgttctttgaagaacagtctgtagtatttgaagggtttgggggagggagaaaatattaatgggaaaggcattcagaaattatggtttctacctttttaaaaagtagatgggattgtgtcaatcttggttaatgagctacagttttacaaagctgatcacttcctataaggacaatggtagacattttataaagatgttttttcacaagattaattactgggacaaaagtaatttggaagcccagttccttaggtgggataggaatgaaagcctaaacctcttcctttagctttgttcctatttcttgcaccttcccatatttatgtgccttttgtctatttataatgccactggaagaggagggataactttttctgttatttgatttcttttataactttgttaggtttttgaagctgcaaacactacaatgctttgagggggtctgtgcctgaagctcaggagtgtggatcagacagtctaaagatcctaaaaacttgccaactggatctttgtttagcaaactcactggaaatgaacacttaatggaatttttaagtctgttctgttaggtagatggtgatgctcttgttattttcacttattcagactggattacttcttacttagttactaactcaatgaggaaaaatccctacaggatctttttttgcaaacaactgatatatgcagacaaatttttgacaaattcaccttttaaacacacttaaccatttgtgaaggttttctttagcttacattttaaacatacacaataaacactaatcctccaaactttcactgtttttattagtatgaatataaaatttgaaggtttggccaattagtacaagtctcatgatataatcactgcctgcatacatatgcacagatccagttagtgagtttgtcaagcttaatctaattggttaagtctaaagagattattattccttgatgtttgctttgtattggctacaaatgtgcagaggtaatacatatgtgatgtcgatgtctctgtctttttttttgtctttaaaaaataattggcagcaactgtatttgaataaaatgatttcttagtatgattgtacagtaatgaatgaaagtggaacatgtttctttttgaaagggagagaattgaccatttattgttgtgatgtttaagttataacttattgagcacttttagtagtgataactgtttttaaacttgcctaatacctttcttgggtattgtttgtaatgtgacttatttaacgccttttttgtttgtttaagttgctgctttaggttaacagcgtgttttagaagatttaaatttctttcctgtctgcacaattagctattcagagcaagagggcctgattttatagaagccccttgaaaagaggtccagatgagagcagagatacagtgagaaattatgtgatctgtgtgttgtgggaagagaattttcaatatgtaactacggagctgtagtgccattagaaactgtgaatttccaaataaatctgaacacttgtctttatt

SEQ ID NO: 187424 - DNA, 4192 bp, Homo sapiens
  Payload ID: 16901
  Gene Symbol: SKIV2L2
  Gene Name: superkiller viralicidic activity 2-like 2 (S. cerevisiae)
  Uniprot ID: P42285
  ENST ID: ENST00000230640
  CDS Start-End: 255-3383
gctgcctgccacacgccaggcgccacgcgccgccctcgctctttatccactgagcagcttatccactttaggtcggaaaggaaaggaaagaaaagcaggaaaaaaaaaaaaagtcaggggaacatttttgtcggctgcgcgactcgactacttttgtctcctgcgggccactgttgagccttcacgagacgtcactgtcttcggtcgcggggcatcgtgggtaggagggagatttgctctcactgctcccaaaaatggcggacgcattcggagatgagctgttcagcgtgttcgagggcgactcgaccactgcggcgggaaccaaaaaagacaaggaaaaggacaaggggaaatggaaggggcctccagggtctgcagacaaggcagggaaacgttttgatggtaaattacaatcagaatcaactaataatggaaaaaataagagagatgtagatttcgaaggtacagatgaacccatttttggaaagaagcccaggatagaagagtcaataactgaagacttaagtttggcagacctgatgcccagagtcaaggtacaatcagttgaaactgttgaagggtgtacacatgaggttgcacttcctgcagaagaggattatttaccacttaaaccacgagttggaaaagctgctaaggaatacccgttcattcttgatgcttttcaaagagaggccattcagtgtgttgacaataatcagtctgttctagtatctgcacatacctcagcgggaaaaacagtatgcgccgagtatgccattgcattggccttaagggaaaagcagcgtgtaatatttaccagcccaattaaggctctgagtaaccaaaaataccgtgaaatgtatgaagaatttcaagatgttggtttgatgactggtgatgttactattaatcctacggcatcttgtcttgttatgaccacagagattttgagaagtatgctttacagaggttccgaagttatgagagaagttgcttgggttatatttgatgaaattcattatatgagagattcagaacgtggtgtagtatgggaagaaactattattttgcttcctgataacgtccactatgtctttctttcggctactattccaaatgcccgacagtttgctgaatggatttgccatttacataaacagccttgtcatgttatttacacagattatcggcccactccattgcaacactacatttttccagcagggggagatggcctgcatcttgtggttgatgaaaatggtgacttcagagaagataattttaatactgcaatgcaagtgcttcgagatgcaggtgatttggccaaaggagaccagaaagggcggaaaggaggaacaaaaggaccatcaaatgttttcaaaattgtgaagatgattatggaaagaaatttccaacctgtgattattttcagttttagtaagaaagattgtgaagcctatgcacttcaaatgaccaaattagatttcaacacagatgaagaaaagaagatggttgaagaagtattcagtaatgcaattgattgcttatccgatgaagataaaaaactccctcaggtagaacatgtacttcctcttttgaagaggggaattggtattcaccatggtggtttacttcctattttgaaagaaactatagaaattctcttttctgaaggattgataaaggccttatttgccacggagacctttgctatgggaattaacatgccagctagaactgttttatttacaaatgcccgcaaatttgatgggaaggatttccgatggatttcttctggtgaatacattcagatgtctggtcgtgctggaaggagaggaatggatgatagaggaattgtaattcttatggtagatgaaaagatgagcccaacaattggaaaacaattacttaagggctccgctgatcctctaaatagtgctttccatttgacctacaacatggttttgaacttactacgtgtagaagaaattaatcctgagtacatgttggaaaaatccttctaccagtttcagcattatagagcaattccaggagtagtagagaaggtaaagaattcagaagaacagtataataaaatagtaattcccaatgaagaaagtgtggttatctattataagattagacagcagcttgccaaattgggtaaagaaattgaagaatatattcacaaaccaaaatactgcttaccttttctacaaccaggtcgtttggtaaaggtaaagaatgaaggagatgactttggctggggagtagtggtgaatttctcaaaaaagtcaaatgttaagcctaactctggtgaactggatcctttgtatgtagtagaagtacttctgcgctgtagcaaagagagcttgaaaaattcagctacagaagctgcaaaaccagctaaacctgatgagaaaggagagatgcaggttgtcccagttttggtgcatctcctgtctgctatcagcagtgttaggctttacattcctaaagaccttcggccggtggacaatagacagagtgttttaaaatcaatacaggaagttcagaaacgttttcctgacggcatccccttattagaccctattgatgatatgggcattcaagatcaagggctgaaaaaagtcattcagaaagtagaagcttttgagcatcgaatgtattctcatccacttcacaatgatccaaatttggaaactgtgtatacgctttgtgaaaaaaaagcacagattgcaatagatattaaatctgcaaagcgagaactgaagaaagcaagaacagtcctacaaatggatgaactcaaatgtcgcaaacgtgttttaagaaggttgggatttgctacttcttctgatgtaatagagatgaaaggacgagtggcttgtgagataagcagtgctgatgagctccttctaactgagatgatgtttaatggccttttcaatgacctttctgcagaacaggcaacagcattattaagctgctttgtgtttcaagagaattctagtgagatgcccaaattaacagaacaattagcaggaccacttcgtcaaatgcaggaatgtgctaaaagaattgcaaaagtttcagcagaagccaaattggaaattgatgaggaaacttatctaagctcatttaaacctcacttaatggatgtagtatatacctgggcaactggagctacatttgcccatatctgcaaaatgacagatgtctttgaaggcagcataattcgttgtatgaggcgcctggaagaattgcttcgacaaatgtgtcaagcagcaaaagccattggaaacactgagctggaaaataaatttgcagaaggaatcaccaaaatcaagagagatattgtgtttgctgccagcctctacttgtagagtcagctaaaggaatgtgagattttaaattattgaccacctgtttgattacagttgactacaaatgcctgcaagtgtggatttggttctcccatacattttaatatgtattatatttaaatcaaacatcattcatagaaagcatattacatacatgtttatacataagcattacatttttttaataaaaatgtatacaggtggggcactgttttggtggaaggcttggagtttttttaatgagtttagagctattagataaccactgagttaaaggtaactatgtacacacaaagtgtgcatccaagaggcatagcagcagcagaagtctttaaaggcttgtacaccaggaagaaagatgcatcctcttgccttgtggcaatcattttcctttagaaaacaggccagcttcacctgggcaccctgctgcctttcaaggctggtgattgctcggatagtgattcccagttgttggtgtttcatgcagagttgtatgagagtcctcctcttttctttctttaaaagaagttctttctttgaagaaatccgatacatatacagcctacagtgcaaaatatttaatggtataatttagatcaagttaaaaactacatacaaagttgtgatcaacagcatcctaagataaatataaacaaaaggatatactttgaggtgtacagattaagcatataaaaaattagagactaactgggattttttaaagattattccaaattaagagttgctttgttatgccttcagcaaatagcttcattttgccaatactgaataaaagagttatttctaca

SEQ ID NO: 187425 - DNA, 695 bp, Homo sapiens
  Payload ID: 16901
  Gene Symbol: SKIV2L2
  Gene Name: superkiller viralicidic activity 2-like 2 (S. cerevisiae)
  ENST ID: ENST00000505565
  CDS Start-End: 1-265
gaaacgttttgatggtaaattacaatcagaatcaactaataatggaaaaaataagagagatgtagatttcgaaggtacagatgaacccatttttggaaagaagcccaggatagaagagtcaataactgaagacttaagtttggcagacctgatgcccagagtcaaggtacaatcagttgaaactgttgaagggtgtacacatgaggtatgccattgcattggccttaagggaaaagcagcgtgtaatatttaccagcccaattaaggctctgagtaaccaaaaataccgtgaaatgtatgaagaatttcaagatgttggtttgatgactggtgatgttactattaatcctacggcatcttgtcttgttatgaccacagagattttgagaagtatgctttacagaggttccgaagttatgagagaagttgcttgggttatatttgatgaaattcattatatgagagattcagaacgtggtgtagtatgggaagaaactattattttgcttcctgataacgtccactatgtctttctttcggctactattccaaatgcccgacagtttgctgaatggatttgccatttacataaacagccttgtcatgttatttacacagattatcggcccactccattgcaacactacatttttccagcagggggagatggcctgcatcttgtggttgatgaaaat

SEQ ID NO: 187426 - DNA, 3271 bp, Homo sapiens
  Payload ID: 16901
  Gene Symbol: SKIV2L2
  Gene Name: superkiller viralicidic activity 2-like 2 (S. cerevisiae)
  ENST ID: ENST00000506750
  CDS Start-End: 14-283
actgctcccaaaaatggcggacgcattcggagatgagctgttcagcgtgttcgagggcgactcgaccactgcggcgggaaccaaaaaagacaaggaaaaggacaaggggaaatggaaggggcctccagggtctgcagacaaggcagggttgcacttcctgcagaagaggattatttaccacttaaaccacgagttggaaaagctgctaaggaatacccgttcattcttgatgcttttcaaagagaggccattcagtgtgttgacaataatcagtctgttctagtatctgcacatacctcagcgggaaaaacagtatgcgccgagtatgccattgcattggccttaagggaaaagcagcgtgtaatatttaccagcccaattaaggctctgagtaaccaaaaataccgtgaaatgtatgaagaatttcaagatgttggtttgatgactggtgatgttactattaatcctacggcatcttgtcttgttatgaccacagagattttgagaagtatgctttacagaggttccgaagttatgagagaagttgcttgggttatatttgatgaaattcattatatgagagattcagaacgtggtgtagtatgggaagaaactattattttgcttcctgataacgtccactatgtctttctttcggctactattccaaatgcccgacagtttgctgaatggatttgccatttacataaacagccttgtcatgttatttacacagattatcggcccactccattgcaacactacatttttccagcagggggagatggcctgcatcttgtggttgatgaaaatggtgacttcagagaagataattttaatactgcaatgcaagtgcttcgagatgcaggtgatttggccaaaggagaccagaaagggcggaaaggaggaacaaaaggaccatcaaatgttttcaaaattgtgaagatgattatggaaagaaatttccaacctgtgattattttcagttttagtaagaaagattgtgaagcctatgcacttcaaatgaccaaattagatttcaacacagatgaagaaaagaagatggttgaagaagtattcagtaatgcaattgattgcttatccgatgaagataaaaaactccctcaggtagaacatgtacttcctcttttgaagaggggaattggtattcaccatggtggtttacttcctattttgaaagaaactatagaaattctcttttctgaaggattgataaaggccttatttgccacggagacctttgctatgggaattaacatgccagctagaactgttttatttacaaatgcccgcaaatttgatgggaaggatttccgatggatttcttctggtgaatacattcagatgtctggtcgtgctggaaggagaggaatggatgatagaggaattgtaattcttatggtagatgaaaagatgagcccaacaattggaaaacaattacttaagggctccgctgatcctctaaatagtgctttccatttgacctacaacatggttttgaacttactacgtgtagaagaaattaatcctgagtacatgttggaaaaatccttctaccagtttcagcattatagagcaattccaggagtagtagagaaggtaaagaattcagaagaacagtataataaaatagtaattcccaatgaagaaagtgtggttatctattataagattagacagcagcttgccaaattgggtaaagaaattgaagaatatattcacaaaccaaaatactgcttaccttttctacaaccaggtcgtttggtaaaggtaaagaatgaaggagatgactttggctggggagtagtggtgaatttctcaaaaaagtcaaatgttaagcctaactctggtgaactggatcctttgtatgtagtagaagtacttctgcgctgtagcaaagagagcttgaaaaattcagctacagaagctgcaaaaccagctaaacctgatgagaaaggagagatgcaggttgtcccagttttggtgcatctcctgtctgctatcagcagtgttaggctttacattcctaaagaccttcggccggtggacaatagacagagtgttttaaaatcaatacaggaagttcagaaacgttttcctgacggcatccccttattagaccctattgatgatatgggcattcaagatcaagggctgaaaaaagtcattcagaaagtagaagcttttgagcatcgaatgtattctcatccacttcacaatgatccaaatttggaaactgtgtatacgctttgtgaaaaaaaagcacagattgcaatagatattaaatctgcaaagcgagaactgaagaaagcaagaacagtcctacaaatggatgaactcaaatgtcgcaaacgtgttttaagaaggttgggatttgctacttcttctgatgtaatagagatgaaaggacgagtggcttgtgagataagcagtgctgatgagctccttctaactgagatgatgtttaatggccttttcaatgacctttctgcagaacaggcaacagcattattaagctgctttgtgtttcaagagaattctagtgagatgcccaaattaacagaacaattagcaggaccacttcgtcaaatgcaggaatgtgctaaaagaattgcaaaagtttcagcagaagccaaattggaaattgatgaggaaacttatctaagctcatttaaacctcacttaatggatgtagtatatacctgggcaactggagctacatttgcccatatctgcaaaatgacagatgtctttgaaggcagcataattcgttgtatgaggcgcctggaagaattgcttcgacaaatgtgtcaagcagcaaaagccattggaaacactgagctggaaaataaatttgcagaaggaatcaccaaaatcaagagagatattgtgtttgctgccagcctctacttgtagagtcagctaaaggaatgtgagattttaaattattgaccacctgtttgattacagttgactacaaatgcctgcaagtgtggatttggttctcccatacattttaatatgtattatatttaaatcaaacatcattcatagaaagcatattacatacatgtttatacataagcattacatttttttaataaaaatgtatacaggtggggcactgttttggtggaaggcttggagtttttttaatgagtttagagctattagataaccactgagttaaaggtaactatgtacacacaaagtgtgcatccaagaggcatagcagcagcagaagtcttta

SEQ ID NO: 187427 - DNA, 2185 bp, Homo sapiens
  Payload ID: 16901
  Gene Symbol: SKIV2L2
  Gene Name: superkiller viralicidic activity 2-like 2 (S. cerevisiae)
  ENST ID: ENST00000508716
  CDS Start-End: 1-217
cttaatggatgtagtatatacctgggcaactggagctacatttgcccatatctgcaaaatgacagatgtctttgaaggcagcataattcgttgtatgaggcgcctggaagaattgcttcgacaaatgtgtcaagcagcaaaagccattggaaacactgagctggaaaataaatttgcagaaggtcagtatcaaatggataagctgtttctaatttagacaaatttggtgaagcaaatcttgagccctggaccacaacctaggaggacgttttgagatgttcttcactgcattgtcatggagagctatctactagtgtttctataaaatttagtgtgttgggggaaaagttgagattttatatatacatgcatttacgtatattaattgtacgctaactacatgccaggcattgttttaagcactaggggatatagtgaacaaaaagacacccctgccttcatggagtttacattctagtgtggggagatagacaataagtcaacaattaaatttatcagatggtgataagtctgtaagataaaaacaaagcagaaaagacaatagaattggcagatggatatgatggtctagggcctccacagggaaggtggcagttaaggcctttggtgtatgcttgatgtacgtgaacaccagcaagaggccagtgtggctggagcagaatgggcagtgagtagaggagtaggggttgaagtgagaaaggaaatgattccatagttcccagccccaggcttctcaactctgcagtgactggaggtgtggagtttgggagtgacctgccccaacttggactttacaaggtaattgttgctcttacattcagggcaagtctgtagagtagcacagtagaagtggggagaacagatcaagaaaggatggctaaaccaaggtggtagtaatggagtggtggtgggggggcaaggggcataagcttcagtcctgtctactgactcttgaccaagaaaaaggactaagttaatcaaagaatataaccacattgttgctgagtcagtcaatgctagtgatttctgcaaacaacttagtgtcctaagaagaggtttgcaaaaactggctgatatttccacagttgataaatgtaggcctgtttaatgactcagaatttaagtgtaggtgtcaaagttttaaaaataatttgtaatcaaaatttgtatttgtccttccttggcctagaaagaatttcacatgggaactgaaaaaaaagtgtcttctgatataggttgaaaatccaagtctttggattttacatttctttagacagtttagtccttccctataattttttttatttttatttttatttatttatttagtgtgtggagacagagtttcgctcttgttgccccaggctggagtgcaatggcgcaatctcggctcactgcaacctccacatccacctcccaggttcaagcgattctcctgcctcagcctcctgagtagctgaactacaggcatgcgccaccacgcccggctgattttgtatttctagtagagacggggtttctccatgttggtcgggctgctcttgaactcctgacctcaggtgatccgctcgccttggcctcccagagtgctgggattacaggcatgagctactgcgcccgacctagcatttatctttttaaacagttctagacacctctttcctggccagcccccatggagtatttcagagtcaaaagaacaggggtctggcttgtatgttttccacctcacagaggtggctgcaaattcctctaggtgttcagcaaggtgtttgactttctaggctgctcgcttaccagttgaatcagggttggtatactggctttaaaatttcggtagaggcaagttaggtgttttgtggtcttgaaagtttaaaccttactttcttttctcttaggaatcaccaaaatcaagagagatattgtgtttgctgccagcctctacttgtagagtcagctaaaggaatgtgagattttaaattattgaccacctgtttgattacagttgactacaaatgcctgcaagtgtggatttggttctcccatacattttaatatgtattatatttaaatcaaacatcattcatagaaagcatattacatacatgtttatacataagcattacatttttttaataaaaatgtatacaggtggggcactgtt

SEQ ID NO: 187428 - DNA, 966 bp, Homo sapiens
  Payload ID: 16902
  Gene Symbol: SOD1
  Gene Name: superoxide dismutase 1, soluble
  Uniprot ID: P00441
  ENST ID: ENST00000270142
  CDS Start-End: 149-613
gtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaa

SEQ ID NO: 187429 - DNA, 865 bp, Homo sapiens
  Payload ID: 16902
  Gene Symbol: SOD1
  Gene Name: superoxide dismutase 1, soluble
  ENST ID: ENST00000389995
  CDS Start-End: 105-512
gtagtcgcggagacggggtgctggtttgcgtcgtagtctcctgcagcgtctggggtttccgttgcagtcctcggaaccaggacctcggcgtggcctagcgagttatggcgacgaaggccgaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaa

SEQ ID NO: 187430 - DNA, 991 bp, Homo sapiens
  Payload ID: 16903
  Gene Symbol: SOD2
  Gene Name: superoxide dismutase 2, mitochondrial
  ENST ID: ENST00000337404
  CDS Start-End: 112-663
gcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctat

SEQ ID NO: 187431 - DNA, 815 bp, Homo sapiens
  Payload ID: 16903
  Gene Symbol: SOD2
  Gene Name: superoxide dismutase 2, mitochondrial
  ENST ID: ENST00000367054
  CDS Start-End: 62-613
gtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgatcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaa

SEQ ID NO: 187432 - DNA, 990 bp, Homo sapiens
  Payload ID: 16903
  Gene Symbol: SOD2
  Gene Name: superoxide dismutase 2, mitochondrial
  ENST ID: ENST00000367055
  CDS Start-End: 68-736
gctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgatcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaagaggtctgcattatgcttgcatgtcaaaaactttaaaaatcctataatcttc

SEQ ID NO: 187433 - DNA, 523 bp, Homo sapiens
  Payload ID: 16903
  Gene Symbol: SOD2
  Gene Name: superoxide dismutase 2, mitochondrial
  ENST ID: ENST00000401980
  CDS Start-End: 341-523
tcgccttctggcccactcacaggagagtcgcctttcaggcgtggccgcagtcactcgcccgccgccgaaccccgccaggagaggaaaggtgaagggagggaggccgtcggcctagcccgatcggggcctcgaggcacaatggagcagctgctccccggtaacactccccgtcctttcccaggagcctggcgcgagctccgcgggccccggagctcagcaagctcacaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggggagttgctggaagccatcaaacgtgactttggttcctttgacaagtttaaggagaagctgacggctgcatctgttggtgtccaaggctcaggt

SEQ ID NO: 187434 - DNA, 917 bp, Homo sapiens
  Payload ID: 16903
  Gene Symbol: SOD2
  Gene Name: superoxide dismutase 2, mitochondrial
  ENST ID: ENST00000444946
  CDS Start-End: 75-563
actcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagt

SEQ ID NO: 187435 - DNA, 2045 bp, Homo sapiens
  Payload ID: 16903
  Gene Symbol: SOD2
  Gene Name: superoxide dismutase 2, mitochondrial
  ENST ID: ENST00000452684
  CDS Start-End: 78-500
ggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggtaggttccaggctgagcggcgggaggcagtccccggcagaggcgaccccagggagccaggccccatacggacgggcctctccgtggaggagaactcgcttcgtatttgtaccggttccgagttttccaggcacgatagtctctcttttaaacacatggtctacctcattgtagaaggagtgcctcgatgggtttgaacacacttctgtcatctcagggaacttggggtcctgcgaaggagcttgccttactgttgtgagccacattccgttacacatattgccagcactggtgaattgtagggcctgaaaagaaagctctactgtgtcactcgttttttttgcaaattgaaattgttcttgttgtataatgtgctttggggaaatgtttggtctctcaggtaggtgtgccagccgtttgcaggagggctgagagcgcctgtccactggtggccagacatcatcgggtccgcaggtgtctctgagtgtcagggtcacctcctgatagaagtgggagtggtgtcttactgccaggtcacactgaaggtgggagacaggaggacactactccgtgctaggaaccatggtccttgtcatcttcctgagagcaaacggggtcgggactccagcctaggacttggagactccctgcatccccagctaccctgcaggtgaaacttcactgagcccacttgacttcaggtgggagaggaggaggcacaccgttgtggtgtgcgttaccaaaaaagcagtaacctaactgtggaacagttcaggatctttagacttgatacttttcttgatttcccttaggggtcaaagttcacaaggaaaatagccctttagtgggaaactgaaacaggcttgtttttatttactatttactcatatttgtaatgcaattaaaatatatgttgttaactttttttttttttctcaagagctcggttgataaaaccaggggtatgtggactttttgagtctgtgccttttgggggtgtgtatgggaatgttatgttttaacgttttttacaaaatagtattgtctttttaatttattcgttagtggtttgcacaaggaagataatcgatagtcatgttttttagactctctgtattgcttggtaagctacgtagtaaaaaatgtttacttttccttaaatgttttgaatttcggggttatgaaatttgttgagtaatttttagacagtcacatcttgttgactggaggcatctagtggaaaaatgcagtatttcagcctgattgtgtttgaagtaaatgattaaaagaggaggaagttaccacattctggaagatttacttgagacagacgaaccttgaattacgggaaaaggccccgtgatttaggaaataacaaatttgggaaacatgtaatggggagagactggggaataccccagttgtgaaagtacttcctgtaaggcaacatctgacaccaggaacctttctcttcagtattttaaaaacaacttaatttcagtcctttacttgtggaatcagagccttacttatgtaatacaacccactggaaaaaagctttttattgtattgtactatattgtttataagtgattgagtacctgcagagctttcttttacttaaacatattttaaaaattattaaaaagattttcatgtttgaaaacttggggaaaaaagataaaacaatgtcataatctcatcacatttaactgactaatatgaatatttttcaacaaaaa

SEQ ID NO: 187436 - DNA, 507 bp, Homo sapiens
  Payload ID: 16903
  Gene Symbol: SOD2
  Gene Name: superoxide dismutase 2, mitochondrial
  ENST ID: ENST00000537657
  CDS Start-End: 173-507
tattaccatcaacaccttctattcacactctatctcccaagtgctagcagtctaaagcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggaca

SEQ ID NO: 187437 - DNA, 4302 bp, Homo sapiens
  Payload ID: 16903
  Gene Symbol: SOD2
  Gene Name: superoxide dismutase 2, mitochondrial
  ENST ID: ENST00000546260
  CDS Start-End: 75-500
actcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggtaggttccaggctgagcggcgggaggcagtccccggcagaggcgaccccagggagccaggccccatacggacgggcctctccgtggaggagaactcgcttcgtatttgtaccggttccgagttttccaggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgccaagcaaggagaattgggcagctcatgcttgagacccaatctccatgatgacctacaagctagagtatttaaaggcagtggtaaatttcaggaaagcagaagttaaaggcaaaattgtaaatcagtcgagatcgggtgccttcagggtggtatggctgtataccaaaattgtaaatcactacatgaagcttatatattggtttggcctgaaaggtgaagtggggtaggcagggggcgggcttacaggttatggtggattcaaagactccctgatttgtgattggttaaggaagcaaagctttgtctaaaaacttggggtccgcagaaaggaacattaaggtctggccaggcccctcaggaagaaactgagagcaaagaatggaggtcagagtttagtccctggtgttcccccttatctgacgtctgtgtgaatccatttggtgggggtctgggtttctgaaaagtagctcaggggcacgtgttaaggatgtctctaggtgactctaacttccctggctattgtttgaaactgttatgaccttcttgcttatcagcttgctggtttccttctcggggcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgaatatttcatttgtttctaattgttactacagataatgctggggtgagcaactctgtgtacataggtttatctcctattggaatattttctttatataggcgttttttttttttctttttttttggagacagagtcttgctctgttgcccaggctggagtgcagtggcgcgaccggagctcactgcaacctccacttcccgggttcaagtgattgtcccacctcagcctcctgaatagctgggattacaggtgcatgctaccatgcctggctactttttgtatttttagcagagacagggtttcaccatgttggccagggtggtctcgaactcctgacctcaagtgatccgtctggctcagcctcccaaagtgctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaaaaaatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggtttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaagaggtctgcattatgcttgcatgtcaaaaactttaaaaatcctataatcttc

SEQ ID NO: 187438 - DNA, 571 bp, Homo sapiens
  Payload ID: 16903
  Gene Symbol: SOD2
  Gene Name: superoxide dismutase 2, mitochondrial
  ENST ID: ENST00000545162
  CDS Start-End: 1-571
atgttcgccttctggcccactcacaggagagtcgcctttcaggcgtggccgcagtcactcgcccgccgccgaaccccgccaggagaggaaagcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcagg

SEQ ID NO: 187439 - DNA, 2558 bp, Homo sapiens
  Payload ID: 16903
  Gene Symbol: SOD2
  Gene Name: superoxide dismutase 2, mitochondrial
  Uniprot ID: P04179
  ENST ID: ENST00000546087
  CDS Start-End: 1829-2359
aaagccgggctcagaccacctagcagttccgcccctgccgcaggcattaccgatggcgcctcccggagccggccaatcaggggccccggaggagaacacctccctacgccaaccaatgggagaggcaggccacgcgatggctctaccccgggagccaatccaagcacgagggacggagtgcgcacatcgggagaggagagggtggggctgtagcaccaggtcagggaacgcgggagccgcagggttccagggatcccgcggctcctcgcggcttggcctgaccggcttcctccacatacgcccctctcctacacaagtccggccctcggcgctcctgccgaagcagcaggcgcctcggactctgcgcggctcccgccggccactcacctatgatggtccgcgccgccgagacgatgaccacaggatctgagcctgcattcatcttgcttctcctgccgccgtctgccctgcgctgcctgcaagctaggcaaagctcctcctcgcagcccacaggcctgccgcgggcgggacctgaggtagccccgcccctcgccctccacctccccgcgcaccacctccccgcgcatcccactgtgcgcaggcgcaaggccggagcaggggcgggcggaggcgcgcggggcgcggggcgcggggcgcggggcggaagtgaggccggggcgcggggcgcggggcggaagtgaggccggggtctgggcttgcgggcagaaccgcggacctcggacgcatttacagagcgcctgaaaccccagtgtttctggacaccccaatgttggagttccccgacttgacgtcttgggcttttttttaaaaaatcttagggtttctcgaaacagtaaagactggggggtgacaaagacttatctctcgttcagctcaggactggaatcccacgggcgagaatctcgagtgcgagcccggcccgcggcgggtctcagcacagctctgatgggtccttttgctctcggcggcttcgggaggtcctatgcgtttctcctggcgccagtcattcgctcgcgtgaggggcttgctaggagcgtctcggtgcgagccccctgccttctaagatcaactctggctgtgaacgggtgaggacgccgggagcgtcttagcgtcacaaaagttcctttggttgacgtttggacagtgaaaggagcatgtaacaagtggggtcagttttgtttaaaaccctttctgacttcccagcctcttactgggcaaagttcataatttttctgagctttctagggtttccaggcaagcttatgaggggccaccgttacagcaacttgttgggaacacctggatagtggaacaagaaagctttgtcacaaagtcatgaaggggaaaactgttgacggacctggagaatcttcctgaagaactttaaagttgattgaaagaatcattaaatcctggaaacctacattaagactttgcagagatatgcggatgggtcagataaatcagagaagaaacatttctcaagtgtctacatgttctagaaggggaatttttcggaggtggccacttcttcggaatagtccgacgccatcaggcctctgaagcaaggggaaggggaaaagaaaaaagctgaaacacaaggttcatctgtagagacagcgtttcactatgttggccaggctggtctccaactcctgacattggcttatgttctttttaaaaagtttgatgcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgatcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatc

SEQ ID NO: 187440 - DNA, 551 bp, Homo sapiens
  Payload ID: 16903
  Gene Symbol: SOD2
  Gene Name: superoxide dismutase 2, mitochondrial
  ENST ID: ENST00000535561
  CDS Start-End: 2-551
gatgcttccgcgtgtcggaggaccaggtgccacctcaagagagaggccgtgggcggcgagccgcgggcgtttactcttagcagaagctcacctcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaa

SEQ ID NO: 187441 - DNA, 14266 bp, Homo sapiens
  Payload ID: 16903
  Gene Symbol: SOD2
  Gene Name: superoxide dismutase 2, mitochondrial
  ENST ID: ENST00000538183
  CDS Start-End: 162-830
cggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgccaagcaaggagaattgggcagctcatgcttgagacccaatctccatgatgacctacaagctagagtatttaaaggcagtggtaaatttcaggaaagcagaagttaaaggcaaaattgtaaatcagtcgagatcgggtgccttcagggtggtatggctgtataccaaaattgtaaatcactacatgaagcttatatattggtttggcctgaaaggtgaagtggggtaggcagggggcgggcttacaggttatggtggattcaaagactccctgatttgtgattggttaaggaagcaaagctttgtctaaaaacttggggtccgcagaaaggaacattaaggtctggccaggcccctcaggaagaaactgagagcaaagaatggaggtcagagtttagtccctggtgttcccccttatctgacgtctgtgtgaatccatttggtgggggtctgggtttctgaaaagtagctcaggggcacgtgttaaggatgtctctaggtgactctaacttccctggctattgtttgaaactgttatgaccttcttgcttatcagcttgctggtttccttctcggggcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgaatatttcatttgtttctaattgttactacagataatgctggggtgagcaactctgtgtacataggtttatctcctattggaatattttctttatataggcgttttttttttttctttttttttggagacagagtcttgctctgttgcccaggctggagtgcagtggcgcgaccggagctcactgcaacctccacttcccgggttcaagtgattgtcccacctcagcctcctgaatagctgggattacaggtgcatgctaccatgcctggctactttttgtatttttagcagagacagggtttcaccatgttggccagggtggtctcgaactcctgacctcaagtgatccgtctggctcagcctcccaaagtgctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaaaaaatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggtttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaagaggtctgcattatgcttgcatgtcaaaaactttaaaaatcctataatcttctgtcattttcactgagtttccatgggaaaggaatagtaaataatgggtagttgaaatattactcttaagaccaagacctgtatctccagtcatatctgtaataacatcatctgataacctaaaagcatagtattagggatatacgacaaaaccaaagtgtttttgctgttgtcacataccactcaatacttttacaccaggttgtccagtggacaccagctggatgtcctataattcaattctgacactgtctacctggaattggagtcagatcccacaggtggagggctcagcccacaagactgcccccactccagataccaatcgcaagtccctatacttctgactggctataaagtggggttcccgtgaccctttccttggttttgatttatttgctagagcagctcccagaacacagagaaacactctacttatgtttacccatttttaattttattactttattaaaactacatattggttacaatactaatttattgtaaaggatatttcatttatttatttttttatttagagatggagtctcactgtgtcacccaggctggagtgcggtggcacagtctcaactcactgcaacctccacctcctgagttcaagcgattctcatgcctcagcctcccaagtagctgggattacaagtgtgcaccaccatgcccagctaatttttgtatttttagtagagatggggtttcactctgttggccaggctggtctcaaactcctgacctcaagtcatccacccacctcagcctcccaaagtgctgagattacaggtgtgagccattgcctctggcttgtaaaggatatttcaaagaatacagatgaacagccagatggaagagatgcacagggcaaggcatgtgggaaggggtatggagctttcatgctctctccacgtcatcagctacccagaagctcatctggaccccgaccctttggggttttacggaggcttcattatgtcagcattaccattggcaattggcgattaactcaaccttcagcctctctcccctttctggaggttgggggttgaggctgggagtccaaaccctccaatcttgccttggtctttctggtaagcagccccccgtcctgaagctacctagaggctcccagccaccaatcatttcattggcaaaccaaagatacttcaaggggtttaggagccaagagaccaagcaaggattgagacaatatatatatttcttataaataacatgatcacaaatagtattttatatatttctcataatagctggttgtggttactcacacctatcatcccagctactaagaagctaaggcaggaggatcacaggcccaggagtttgcagctgtagtgagctatgattgtgctactgcactccagcctgggtgacagtgtgagaccctgtctcttaaagttcttgtaacatcttagaacattaaccaaccacagattattgccttaactctgaaaaataaagtaatcatacttttacaagatgtattttacataaagttctggtgatattttactctggtcattggaatataggagcttaccacctggtaccactcttcctaaagtggtatactatttggtatagtactggcatactatttggaaagggatgtgaagttggcatgacctgtctagggtgaagtcatgctgtctgctattcattgtgggctttacagtaatgagagtgcttctgttgtcaagatgcttctgggacacgttaaaaaaaatttaagatttctcagtttgtgaaaaggaaggagcacgaatgctttcaagttcctatgacatgctagtcatctttcagtgtgtcccattgttgcacccagtagtctcgatgcccagcgtcacggtgattccaagtttgcctctctgcccactataatttgtgctccatgaagtcccaggacatgaggttcttgttcatttgtgcgtctgggcccatatccaaatattaaacaatgtgacttaatgtatttatcatattgtaaatatgggtatccccaaggctcagaagttaacacagcatatccacagagaggtttgacagcatggctgtggtgactgggaaggccttatgcttgctcctccttctgctgcttgcctttgtgtgggcatggaaagaacattgaattaggtactggaagacctgggtcctggtcttggagattttaccagagcacctgtgggatattggtcaagatgcctggttttagtcctgctcctttgctgtgaaagaggatcttaaggtgccaactctggcattttattttttacttatttatttttaaattatactttaagttctagggtacatgtgtacaacatgcaggtttgttacatgtatacatgtgccatgttggtgtgctgcacctattaactcgtcatttacattaggtatatctcctaatgctatccctcccccttctccccacccctcgacaggccccggtgtgtgatgttccccttcctgtgtccaagtgttctcattgttcaattcccatctatgagtgagaacatgcggtgtttgtttttttgtccttggaatagtttgctgagaaggatggtttccagcttcatccatgtccctataaaggacatgaactcttccttttttatggctgcatagtattccatggtgtatatgtgccacatcttcttaaaccaatctatcattgatggacatttgggttggttccaagtctttgctattgtgaacagtgccacaataaatatacgtgtgcatgtgtctttatagcagcatgatttataatcctttgggtatatacccagtaatgggatggctgggtcaaatggtatttctagttctagatccctgaggaatcgccacactgtcttccacaatggttgaactagtttacagtcccaccaccagtgtaaaagtgttcctatttctccacatcctctccagcacctgttgtttcctgactttttaatgattgacattctaactggtgtgagatggtatctcattgtggttttgatttgcatttctctgatggcccatgatgatgagcatttttttcatgtgtctgttggatgcatggatgtcttcttttgagaagtgtctcttcatatccttcacctactttttgatggggtttgtttttttcttgtaagtttgtttgagttccttgtagattctggatattagccctttgtcagatgagtagattgcaaaaattttctcccattttgtaggttgcctgttcactctgatggtagtttcttttgctgtgcagaagctcttgagtttaatgagatcccatttgtcaattttggcttctgttgccattgcttttggtgttttagacatgaagtccttgcccatgcctgtgtcctgaatggtactgcataggttttcttctagggtttttatggttttaggtctaacatttaagtctttaatccatcttgaattaatttttgtataaggtgtaaggaagggatccagtttcagctttctacatgtggctagccagttttcccagcaccatttattaaatagggaatcctttccccatttcttgtttttgtcaggtttctcaaagatcagatagttgtagatgtgtggtattatttctgagggctctgttctgttccattggtctatatctctgttttggtactagtaccatgctgttttggttactgcagccttgtagtatagtttgaaatcaggtagcgtgatgcctccagctttgttcttttggcttaggatcgttttggcagtgcaggctcttttttggttccacatgaactttaaagtagttttttccaattctatgaagaaagtcatgggtagcttgatggggatggcattgaatctataaattaccttgggcagtatagccattttcacgatattgattcttcctatccatgagcatggaatgttcttccatttgtttgtgtcctcttttatttccttgagcagtggtttgtagttctccttgaagaggtccttcacatcccttgtaagttggattcctaggtattttattctctttgaggcagttgtgaatgggagttcactcatgatttggctctctgtttgtctgttgttggtgtataagaatgcttgtgatttttgcacattgattttgtatcctgagattttgctgaagttgcttatcaaattaaggagattttgggctgagatgatggggttttctaaatataaaatcatgtcatctgcaaacagggacaatttgacttcctcttttccttattgaataccctttatttctttctcctgcctgatggccctggccagaacttccaacactatgttgaataggagtggtgagagagggcatccctgtcttgtgccagttttcaaagggaatgcttccagtttttgcccattcagtctgatattggctgtgggtttgtcatagatagctcttattattttgagatatgtcccatcaatacctaattcattgagagtttttagcatgaagggctgttgaattttgtccaaggccttttctgcatctgttgagataatcatgtggtttttgtctttggttctgtttatatgctggattacttttattgatttgtgtatgttgaaccagccttgcatcccagggatgaagcccacttgatcatggtggataagctttttgatatgctgctggattcagtttgccagtattttattgaggatttttgcattgattttcatcagggatattggtctaaagttctctttttttgttatgtctctgccaggctttggtatcaggatgatgctggcttcataaaatgagttagggaggattccctctttttctattgattggaatagtttcagaaggaatggtaccagctcttccttgtacctctggtagaattcggctgtgaatccatcttgtcctggactttttttggttggtaggctattaattattgcctcaatttcagagcctgttattggtctattcagggattaaacttcttcctggtttagttttgagagggtgtatgtgtccaggaatttatctatttcttctagattttctagtttatttgcatagaggtgtttatagtattctctgtgtactctgtatttctgtgggattggtggtgatatccactttatcattttttattgcatttatttgattcttctctcttttcttgtttattagtcttgctagcggtctatcaattgtgtttatcttttcaaaaaaccagctcctggattcattcattttttgaaggtttttttgtgtctctgtctccttcagttctgctctgatcttagttatttcttgtcttctgctagctgttgaatgtgtttgctcttgcttctctaatatttttaattgtgatgttagagtgtcaattttagatctttcctgctttctcttgtgggcacttagtgctgtaaatttccctctacacactgctttaaatgtgtcccagagattctggtatgttgtgtctttgttctcgttggtttcaaagaacatctttatttctgccttcattttgttatgtacccagtagtcattcaggagcaggttgttcagtttccatgtagctgagtggttttgagtgagtttcttaatcctgagttctagtttgattgcactgtggtctgagacagtatgttataatttctgttcttttacatttgctgaggagtgctttacttccaactatgtggtcaattttggaataggtgcgatgtggtgctgagaagaatgtatattctgttgatttggggtggagagttctgtagatgtctattaggtctgcttggtgcagagctgaattcaattcctggatatccttgttaactttctgtctcgttgatctgtctaatattgacagtggggtgttagagtctcccattgttattgtgtgggagtctaaatctctttgtaggtctctaaggacttggtttatgaatctgggtgctcctgtattgggtgcatatatatttaagatagttagctcttcttgttgaattgatccctttactatcatgtaatggccttctttgtctcttttgatctttgttggtttaaagtctgttttatcagagactaggattgcaaccccggcctttttttttgttttccgtttgcttggtagatcttcctccatccttttattttgagcctatgtgtgtgtgtctctgtacgtgagatgggtttcctgaatacagcaccctgatgggtcttgactctttatccagtgtgccagtctgtgtcttttaattggagcatttagcccatttacatttaaggttaatattgttatgtgtgaatttgatcctgtcactaggatgttcactggttattttgctcgttagttgatgcagtttcttcctagcctcaatggtctttacaatttggcatgtttttgcagtggctgatactggttgttccattccatgtttagtgcttccttcaggagctcttgtaaggcaggcctggtggtgacaaaatctctcagcatttgcttgtttgtaaaggattttatttctccttcacttatgaagcttagtttggctggatatgaaattctgggttgaaaattcttttcttcaagaacgttgaatattgacccccactctcttctggcttgtagagtttctgctgagagatcagctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatttgaatgttgtcctcccttgctagattggggaagttctcctggataatatcctgcagagtgttttccagcttggttccattctccccgtcactttcaggtacaccaatcagacgtagatttggtcttttcacatagtcccatatttcttggaagctttgttcgtttctttttactcttttttctcttaacttctcttctcacttcatttcattcatctgatcttcaatcactgataacctttcttccagttgatcgaattggctactgaagcttgtgcattcgtcacgtagttctcatgccatggttttcagctccatcaggtcatttaaggacttctctatgctggttattctagttagccatttgtctaatcttttttcaaggtttttaggttctttgtgatgggttcgaacttcctcttttagcttggagaagtttgatcatctgaagccttcttctctcaactcgtcaaagtcattctccgtccagctttgttctgttgctggcaaggagctatgttcctttggagggggagaggcgctctgatttttagaattttcagcttttctgctctgttttttccccatctttgtggttttatctacctttggtctttggtgatggtgatgtgcagatggggttttggtgtggatgtcctttctgtttgttagttttccttctaacagtcaggaccgccagctgcaggtctgttggagtttgctggacgtccacgccagaccctgtttgcctgggtatcacagtggaggctgtagaacagcgaatattgctgaacagcaaatgttgctgcctgatcattcctctggaagcttcatctcagaggggtacccggccatgtggggtgtcagtctgcccctacttgggggtgcctcccagttaggctactcgggggtcagggactcacttgaggaggcagtctctccgttctcagatctcaaactctgtgctgggagaaccactggtctcttcaaagctgtcagacagggacattgaagtctgcagagatttctgctgccttttgttcggctatgccatgcccccagaggtggagtctacagaggcaggcaggcaggcctccttgagctgcagtgggctccacctagttcgagcttcccggctgctttatttacctactgaagcctcagcaatggtgggctcccctcccctagcctcactgccaccttgcagttcgatctcagactgctgtgctagcaatgagcaaggctccatgggcgtgggaccctccgagctaggcacaggatataatctcctggtgtgccgtttgctaagaccattggaaaaacgcagtattagggtgggagtgacccaattttccaggtgccgtctgtcacagcttcccttggctaggaaagggaattccctgaccccttgccttcccgggtgaggccatgccttgccctgcttcagctcatgctcagtgggctgcacccaccgtcctacacccactgtccaacaagccccagtgagatgaacctggtacctcagttggaagtgcagaaatcacctgtcttctgcgtcgctcacgctgggagctgtagactggagctgttcctattcggccatcttggaacccaacccaagtctggcattttttggttttctctgtgtattgactatgattatagaggataaatggatattgatattattaaatcgtcatttacagaaggcacacaacttatatcctttaaacaaagttctccaaccagtagggtatacttgctggtagtgcttacagctgccaccattcttcactggggctcagagtggatgcctggaggaaaaaaacaaatgaatcttttagctcctagttactgttagcatttttaccagaaaacaatttaaaaaatgacacaagtaagtcttcacctatcaaggctgagtgtggtggcctatacttgtaatctctgtgctttgggaggccaacgcaggaggatctcttgagtccaggagtttgagaccagcctgggcaacaaagcaagaccccatctctacagaaagttaaaatttagctgggcatgctggcacatccctatagtcccagctacttgagaggctgagttgggaggatcccttgaggtcatgagttggagtctacagtgagctgtgattacagtgtgagtctacactgcactccagtctgggtgaaagagatcctgtctctcaaaaaacaagtgattctcctgggaagagatttgtttaaaaagtctgcacctctattgatgataactttgaatgtaaatggattaaattctcccacttaaaagatatagattgactgaatggattaaaaaccaccatcatgactcgactgtatgctgcctacaagaaacctcacctgtaaagacaggccaaaagtgaaggtatggagaaagatattgcatacaaatggaagccaaaaaagagcagaaataactatacttacatgagataaaatagactttaagtcaaaaactgtaaaaagaaaagtcattatgtaatgaaacaaggatcaattcatgcaagatataatcatatttttttattaagaaaatttttttgtagagatggggttatgctatgttgcctggctagtctcaaactctgggtctcaaagcagtcctcctgctttggcctcctaaggtgctgggattataggcatgagccactgtgccaggcctgaggatattatcattataaatatatatgtaccccacactggatgacccagatataaagcaaatattattagatttaaagggagaaatagactctaatacaatagtagttgaggacttcactctactctcagcattggacagattttctagacataaaaccaataaatattggatttaaattgcactttacaccaaatggacctgacatttacagaacattctaataggtgcagaacactctaatagctgcagaacacacgttcttttcatcagcacatggaacattcaccagactagttctggaacccacttcctgccttagtgttctttccaccacagtgcatgataattccgacagaacgccttttatttgtaccttattagttgtagggggaaagctttttcatgtacaaaaatgctgtaattttctgatttaataaagtaattccactgatgtttttattta

SEQ ID NO: 187442 - DNA, 1526 bp, Homo sapiens
  Payload ID: 16904
  Gene Symbol: SOD3
  Gene Name: superoxide dismutase 3, extracellular
  Uniprot ID: P08294
  ENST ID: ENST00000382120
  CDS Start-End: 206-928
ggggaggtctggcctgcttttcctccctgaactggcccaatgactggctccctcacgctgaccactcctctgggctggcctcctgcactcgcgctaacagcccaggctccagggacagcctgcgttcctgggctggctgggtgcagctctcttttcaggagagaaagctctcttggaggagctggaaaggtgcccgactccagccatgctggcgctactgtgttcctgcctgctcctggcagccggtgcctcggacgcctggacgggcgaggactcggcggagcccaactctgactcggcggagtggatccgagacatgtacgccaaggtcacggagatctggcaggaggtcatgcagcggcgggacgacgacggcgcgctccacgccgcctgccaggtgcagccgtcggccacgctggacgccgcgcagccccgggtgaccggcgtcgtcctcttccggcagcttgcgccccgcgccaagctcgacgccttcttcgccctggagggcttcccgaccgagccgaacagctccagccgcgccatccacgtgcaccagttcggggacctgagccagggctgcgagtccaccgggccccactacaacccgctggccgtgccgcacccgcagcacccgggcgacttcggcaacttcgcggtccgcgacggcagcctctggaggtaccgcgccggcctggccgcctcgctcgcgggcccgcactccatcgtgggccgggccgtggtcgtccacgctggcgaggacgacctgggccgcggcggcaaccaggccagcgtggagaacgggaacgcgggccggcggctggcctgctgcgtggtgggcgtgtgcgggcccgggctctgggagcgccaggcgcgggagcactcagagcgcaagaagcggcggcgcgagagcgagtgcaaggccgcctgagcgcggcccccacccggcggcggccagggacccccgaggcccccctctgcctttgagcttctcctctgctccaacagacaccctccactctgaggtctcaccttcgcctttgctgaagtctccccgcagccctctccacccagaggtctccctataccgagacccaccatccttccatcctgaggaccgccccaaccctcggagccccccactcagtaggtctgaaggcctccatttgtaccgaaacaccccgctcacgctgacagcctcctaggctccctgaggtacctttccacccagaccctccttccccaccccataagccctgagactcccgcctttgacctgacgatcttcccccttcccgccttcaggttcctcctaggcgctcagaggccgctctggggggttgcctcgagtccccccacccctccccacccaccaccgctcccgcgggaagccagcccgtgcaacggaagccaggccaactgccccgcgtcttcagctgtttcgcatccaccgccaccccactgagagctgctcctttgggggaatgtttggcaacctttgtgttacagattaaaaattcagcaattca

SEQ ID NO: 187443 - DNA, 276 bp, Homo sapiens
  Payload ID: 16904
  Gene Symbol: SOD3
  Gene Name: superoxide dismutase 3, extracellular
  ENST ID: ENST00000598411
  CDS Start-End: 115-276
agaagggcaagatggagtctgcacagctgggccatgacccaggaacactatgaggagatgctggttctcctgtagctgctcctctttaggtgaccctggtgcccgactccagccatgctggcgctactgtgttcctgcctgctcctggcagccggtgcctcggacgcctggacgggcgaggactcggcggagcccaactctgactcggcggagtggatccgagacatgtacgccaaggtcacggagatctggcaggaggtcatgcagcggcgggac

SEQ ID NO: 187444 - DNA, 7586 bp, Homo sapiens
  Payload ID: 16905
  Gene Symbol: SVIL
  Gene Name: supervillin
  Uniprot ID: O95425
  ENST ID: ENST00000355867
  CDS Start-End: 754-7398
cactgctctgactgcgtcctccccaggctgaagtgtcctcaggtttcatgtggatttgcccagtaatggatggctccaccgaggccaggttggggaagttcagcctcgaggacactaggggacgaaaaacttcaaaaagaagactctttttattaatattttggcgttctttttggagaggaacttttgggatgtagcctttacctgtttcctgaatttgacatccaaaaagccttttggaaaacaccattctaaatttatcctgttctgaatcatcatcgcttctgatagatgcagttgcttgctgacatcgtgatctttgattttgtacaacgctatttgggctaacttttgggattttactttgtgcttagaatttgaaagtagtattcattggaaagagactccaagaaaatactcgaagacatcaaaagctggattcgagggtataacgtgttttgttttgttttttaaattagaaaaataaggaattgcagtgtgattttctttccccctttaacttagaggaacgaggattatacagaaatttgaaatttcaacaagaaaaacttaagcttccttggattcccacgtcaaaggaaagtttcaagctttcagaaggagttctcactcgaagataaagaacagctcgctaaccacgaaagaggaatcgatgctcagcttttagttgcacttcctaaagttgcagaattaagacaaatctttgaaccaaagaagaaagaattcttagaaatgaaaagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgctagttctctgtaccccgggaccgagacgatggggctcaggacctgtgccggtgaatccaaggactatgccctccatgtgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccagtacagggaaacccaaacatgagtggtttctccagaaagattccgaaggggacacaccttcacttatcaactggccttccagagttaaagttagagaaaaattggtgaaagaggaaagtgctcgaaacagccctgaactcgcctcagagtccgtaactcagaggagacaccagccagcgccagtccattacgtgtcatttcagtctgagcactcagcctttgatagggtccccagcaaggcagcaggctctacacgacagccaatccgtggctatgtccaacccgcagataccggtcacaccgccaagctagtgacgccagaaaccccagaaaatgcatctgagtgtagctgggtagcatcagccacccagaatgtccccaaacctcccagcttgacggttctagaaggtgacggaagggatagcccagttctccatgtctgcgagtcaaaagcagaagaagaagaaggggaaggagaaggagaagaaaaagaagaagatgtgtgcttcactgaagctctcgagcaaagcaagaaaaccctactggctttggagggtgatgggctagtgagaagcccagaagatccctctagaaatgaggactttggtaagcctgctgtgagcacagtcaccttagagcatcagaaggaactggaaaacgtggcacaaccccctcaagctccgcaccagcccactgagaggacaggcaggagcgagatggttctctacattcaaagtgagcctgtgtcccaagacgccaaaccaactggtcacaacagggaagcctcgaaaaagcgcaaggtccgtacccgctctctgtcagatttcacaggcccccctcagctccaggccttgaagtataaggacccagcttccaggagagagctggagctgcccagctccaagaccgaagggccttatggggagatcagcatgctggacacaaaagtctctgtcgcccagctccgaagtgcgttcctggcatctgccaacgcctgcaggagacctgaactcaaatcacgggtggagaggtcggctgaaggacctggcttgcccaccggtgtggaacgggagagagggtcccggaaaccaagacgctatttttctcctggtgaaagtagaaaaacttccgagagatttagaacccaacctataacttcagcagaacgaaaggaatcggataggtgcacttcacattcagaaacgccaactgtcgatgatgaagaaaaggtggatgaacgagccaagctgagcgtcgccgccaagaggttgcttttcagggagatggaaaaatcttttgatgaacaaaatgttccaaagcgacgctcaagaaacacagctgtggagcagaggctacgccgtctgcaggacaggtccctcacccagcccatcaccactgaagaggtggtcatcgcagccactgaacctatccccgcttcgtgttctgggggcacccaccctgtaatggcgagacttcctagccccactgtagctaggagcgctgtgcagcctgccagattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaaggaagttttcactaagagcggcagagttcggggagcccacttccgagcagacggggacagctgctgggaaaactattgctcaaaccacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaagcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcacccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtccaggttctccagggaaaggagcccccctgtttcctgcagtgtttccagggggggatggtggtgcactcggggaggcgggaagaggaagaagaaaatgtgcaaagtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacaatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtt

SEQ ID NO: 187445 - DNA, 8201 bp, Homo sapiens
  Payload ID: 16905
  Gene Symbol: SVIL
  Gene Name: supervillin
  Uniprot ID: O95425
  ENST ID: ENST00000375398
  CDS Start-End: 754-7302
cactgctctgactgcgtcctccccaggctgaagtgtcctcaggtttcatgtggatttgcccagtaatggatggctccaccgaggccaggttggggaagttcagcctcgaggacactaggggacgaaaaacttcaaaaagaagactctttttattaatattttggcgttctttttggagaggaacttttgggatgtagcctttacctgtttcctgaatttgacatccaaaaagccttttggaaaacaccattctaaatttatcctgttctgaatcatcatcgcttctgatagatgcagttgcttgctgacatcgtgatctttgattttgtacaacgctatttgggctaacttttgggattttactttgtgcttagaatttgaaagtagtattcattggaaagagactccaagaaaatactcgaagacatcaaaagctggattcgagggtataacgtgttttgttttgttttttaaattagaaaaataaggaattgcagtgtgattttctttccccctttaacttagaggaacgaggattatacagaaatttgaaatttcaacaagaaaaacttaagcttccttggattcccacgtcaaaggaaagtttcaagctttcagaaggagttctcactcgaagataaagaacagctcgctaaccacgaaagaggaatcgatgctcagcttttagttgcacttcctaaagttgcagaattaagacaaatctttgaaccaaagaagaaagaattcttagaaatgaaaagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgctagttctctgtaccccgggaccgagacgatggggctcaggacctgtgccggtgaatccaaggactatgccctccatgtgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccagtacagggaaacccaaacatgagtggtttctccagaaagattccgaaggggacacaccttcacttatcaactggccttccagagttaaagttagagaaaaattggtgaaagaggaaagtgctcgaaacagccctgaactcgcctcagagtccgtaactcagaggagacaccagccagcgccagtccattacgtgtcatttcagtctgagcactcagcctttgatagggtccccagcaaggcagcaggctctacacgacagccaatccgtggctatgtccaacccgcagataccggtcacaccgccaagctagtgacgccagaaaccccagaaaatgcatctgagtgtagctgggtagcatcagccacccagaatgtccccaaacctcccagcttgacggttctagaaggtgacggaagggatagcccagttctccatgtctgcgagtcaaaagcagaagaagaagaaggggaaggagaaggagaagaaaaagaagaagatgtgtgcttcactgaagctctcgagcaaagcaagaaaaccctactggctttggagggtgatgggctagtgagaagcccagaagatccctctagaaatgaggactttggtaagcctgctgtgagcacagtcaccttagagcatcagaaggaactggaaaacgtggcacaaccccctcaagctccgcaccagcccactgagaggacaggcaggagcgagatggttctctacattcaaagtgagcctgtgtcccaagacgccaaaccaactggtcacaacagggaagcctcgaaaaagcgcaaggtccgtacccgctctctgtcagatttcacaggcccccctcagctccaggccttgaagtataaggacccagcttccaggagagagctggagctgcccagctccaagaccgaagggccttatggggagatcagcatgctggacacaaaagtctctgtcgcccagctccgaagtgcgttcctggcatctgccaacgcctgcaggagacctgaactcaaatcacgggtggagaggtcggctgaaggacctggcttgcccaccggtgtggaacgggagagagggtcccggaaaccaagacgctatttttctcctggtgaaagtagaaaaacttccgagagatttagaacccaacctataacttcagcagaacgaaaggaatcggataggtgcacttcacattcagaaacgccaactgtcgatgatgaagaaaaggtggatgaacgagccaagctgagcgtcgccgccaagaggttgcttttcagggagatggaaaaatcttttgatgaacaaaatgttccaaagcgacgctcaagaaacacagctgtggagcagaggctacgccgtctgcaggacaggtccctcacccagcccatcaccactgaagaggtggtcatcgcagccacattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaaggaagttttcactaagagcggcagagttcggggagcccacttccgagcagacggggacagctgctgggaaaactattgctcaaaccacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaagcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcacccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtccaggttctccagggaaaggagcccccctgtttcctgcagtgtttccagggggggatggtggtgcactcggggaggcgggaagaggaagaagaaaatgtgcaaagtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacaatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgccttttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaattttactctcaaatagtcaaaataaaaacatctcaatttctaataccggttgtaaacagtacacatgtcattttgtgatataggactcccaaataaaagtatcagaataaacacaacaattaactggt

SEQ ID NO: 187446 - DNA, 6729 bp, Homo sapiens
  Payload ID: 16905
  Gene Symbol: SVIL
  Gene Name: supervillin
  Uniprot ID: O95425
  ENST ID: ENST00000375400
  CDS Start-End: 454-5820
ctgtcggcgggaagcggcgatcctgccaccgggaggtgtggaagagccgggtagattctggctacattggagattggttgctttctaaaactgaaggagaagcccatgaagagatggtggattctcactgagttttgactagcggaagaaaagagagagttcaagtggatggccttgaggacttgaaaagctgagatatgatgattttgaagtcatttcacatcgaagccatgatttaaatatcggcgttaagatttcaacaagaaaaacttaagcttccttggattcccacgtcaaaggaaagtttcaagctttcagaaggagttctcactcgaagataaagaacagctcgctaaccacgaaagaggaatcgatgctcagcttttagttgcacttcctaaagttgcagaattaagacaaatctttgaaccaaagaagaaagaattcttagaaatgaaaagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgctagttctctgtaccccgggaccgagacgatggggctcaggacctgtgccggtgaatccaaggactatgccctccatgtgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccaggtgcacttcacattcagaaacgccaactgtcgatgatgaagaaaaggtggatgaacgagccaagctgagcgtcgccgccaagaggttgcttttcagggagatggaaaaatcttttgatgaacaaaatgttccaaagcgacgctcaagaaacacagctgtggagcagaggctacgccgtctgcaggacaggtccctcacccagcccatcaccactgaagaggtggtcatcgcagccacattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaaggaagttttcactaagagcggcagagttcggggagcccacttccgagcagacggggacagctgctgggaaaactattgctcaaaccacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaagcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcacccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtccaggttctccagggaaaggagcccccctgtttcctgcagtgtttccagggggggatggtggtgcactcggggaggcgggaagaggaagaagaaaatgtgcaaagtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacaatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgccttttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaattttactctcaaatagtcaaaataaaaacatctcaatttctaataccggttgtaaacagtacacatgtcattttgtgatataggactcccaaataaaagtatcagaataaacacaacaattaactggttcacattgaa

SEQ ID NO: 187447 - DNA, 2889 bp, Homo sapiens
  Payload ID: 16905
  Gene Symbol: SVIL
  Gene Name: supervillin
  ENST ID: ENST00000632315
  CDS Start-End: 1-2889
agccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaaggaagaaggaggagttgcggatgatagtgccatttctaatctgctttggcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcacccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtccaggttctccagggaaaggagcccccctgtttcctgcagtgtttccagggggggatggtggtgcactcggggaggcgggaagaggaagaagaaaatgtgcaaagtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacaatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatc

SEQ ID NO: 187448 - DNA, 3595 bp, Homo sapiens
  Payload ID: 16906
  Gene Symbol: ST13
  Gene Name: suppression of tumorigenicity 13 (colon carcinoma) (Hsp70 interacting protein)
  Uniprot ID: P50502
  ENST ID: ENST00000216218
  CDS Start-End: 483-1592
atgccccgagctgggaccgaccctccggctccacgcccttttttttttttttttttaggtcccgggcgttgagctctactcagtgcacgcagccacacaatatgctcttggacgtcgccccctggaggggatgttatctcccgcctccttgaagtcgcccatttctggggttgccccatccagggagctggttcctagttaagaatatgagaatgtatgcgcagggaggcaggcaacagcacgaacagccacgcttctagaagattctagggagcgcgcaggagcagcgcagagggagtaggaatgagcaggcggaggacccgaggtcacgagaccgttgggtgggaggagccagcggccggggaggttctagtctgttctgtcttgcggcagccgcccccttctgcgcggtcacgccgagccagcgcctgggcctggaaccgggccgtagcccccccagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttcctgggggaatgcctggtaattttcccggaggaatgcctggaatgggagggggcatgcctggaatggctggaatgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgaggcaaacataactcatttgaggataaagtttgtgttggatatgtggttcctgatgcattttgacttgtctttttaaatgctttatctttttctttaaagatttatttcaataaaactaattgggaccacccgtatttcagtaggacctgggtagggattggaagtacttggcagggcagcagcaatcttgctgtgtttgatataacatgcatccttgggcaggttgcccttaaatcttacactgtggtgaagggatgttttttttgtaatgctgcagtagagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgccttatcagaagacattggaaagagggattccctttggtgtttggtcttctacttagaaaaacctattgcagttagtttatcttgtagtattcatctttgtattctgaagataaggtttgaattaaattgatacacacagaggggaaccgattttttttatccaatgtgaattataaatgagataatccacagttattcattgtggagttgttgagactatgaaagactcattgtctttgtattcagctcttaaatagtgtaactatatccccacctctgcttgctttctttccctcccctccaatgataaagaaaatgataaattttctgttgtgcattcaattcttattttaaataagactaagtataggcattgtacctgacattgctacgtttctaccagtgtttcaatttaaagtgctagtgtttaaaaacattttcaagggataaggccttctgtactttgcttatttgaagaatcagtggtaggagcagtgaagtaaattctatggagtacatttctaaaataccacatttctgaaatcataaataagtttattcaggttctaaccctttgctgtacacaagcagacagaaatgcatctgttacataaatgagaaaaagctattatgctgatggagcatgctttttaaatcctttaaaaacactcaccatataaacttgcatttgagcttgtgtgttcttttgttaatgtgtagagttctcctttctcgaaattgccagtgtgtacttggcttaactcaagaacagtttcttctggattccttatttgatttatttaacctaattatattctaatattgcaaatattaccataagtgggtaaaagtaaaattcctcttctgaaaatgtgtcctgtgcttttagatttttaaattccataatatacattcttaattttcaactcaa

SEQ ID NO: 187449 - DNA, 549 bp, Homo sapiens
  Payload ID: 16906
  Gene Symbol: ST13
  Gene Name: suppression of tumorigenicity 13 (colon carcinoma) (Hsp70 interacting protein)
  ENST ID: ENST00000411695
  CDS Start-End: 63-549
aacagtgtcctcctgacttgtgctggagtgattgtgcctatgtagagaattccactttaagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaag

SEQ ID NO: 187450 - DNA, 798 bp, Homo sapiens
  Payload ID: 16906
  Gene Symbol: ST13
  Gene Name: suppression of tumorigenicity 13 (colon carcinoma) (Hsp70 interacting protein)
  ENST ID: ENST00000455824
  CDS Start-End: 77-193
cgcggtcacgccgagccagcgcctgggcctggaaccgggccgtagcccccccagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttc

SEQ ID NO: 187451 - DNA, 630 bp, Homo sapiens
  Payload ID: 16906
  Gene Symbol: ST13
  Gene Name: suppression of tumorigenicity 13 (colon carcinoma) (Hsp70 interacting protein)
  ENST ID: ENST00000413424
  CDS Start-End: 1-439
gattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggtgtgtacaaccactttataaagcaagaagaccttgtggaagttaagaagtttcaggctttccggccaggcgcggtggctcatgcctgtaatcccagcactttgggaggccgaggcaggtggatcatgaggcacagaaaattgcagaacatcggagaaagtatgagcgaaaacgtgaagagcgagagatcaaagaaagaatagaacgagtta

SEQ ID NO: 187452 - DNA, 944 bp, Homo sapiens
  Payload ID: 16906
  Gene Symbol: ST13
  Gene Name: suppression of tumorigenicity 13 (colon carcinoma) (Hsp70 interacting protein)
  ENST ID: ENST00000620312
  CDS Start-End: 26-661
cagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgc

SEQ ID NO: 187453 - DNA, 3123 bp, Homo sapiens
  Payload ID: 16906
  Gene Symbol: ST13
  Gene Name: suppression of tumorigenicity 13 (colon carcinoma) (Hsp70 interacting protein)
  ENST ID: ENST00000615506
  CDS Start-End: 420-1184
cgcggtcacgccgagccagcgcctgggcctggaaccgggccgtagcccccccagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttcctgggggaatgcctggtaattttcccggaggaatgcctggaatgggagggggcatgcctggaatggctggaatgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgaggcaaacataactcatttgaggataaagtttgtgttggatatgtggttcctgatgcattttgacttgtctttttaaatgctttatctttttctttaaagatttatttcaataaaactaattgggaccacccgtatttcagtaggacctgggtagggattggaagtacttggcagggcagcagcaatcttgctgtgtttgatataacatgcatccttgggcaggttgcccttaaatcttacactgtggtgaagggatgttttttttgtaatgctgcagtagagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgccttatcagaagacattggaaagagggattccctttggtgtttggtcttctacttagaaaaacctattgcagttagtttatcttgtagtattcatctttgtattctgaagataaggtttgaattaaattgatacacacagaggggaaccgattttttttatccaatgtgaattataaatgagataatccacagttattcattgtggagttgttgagactatgaaagactcattgtctttgtattcagctcttaaatagtgtaactatatccccacctctgcttgctttctttccctcccctccaatgataaagaaaatgataaattttctgttgtgcattcaattcttattttaaataagactaagtataggcattgtacctgacattgctacgtttctaccagtgtttcaatttaaagtgctagtgtttaaaaacattttcaagggataaggccttctgtactttgcttatttgaagaatcagtggtaggagcagtgaagtaaattctatggagtacatttctaaaataccacatttctgaaatcataaataagtttattcaggttctaaccctttgctgtacacaagcagacagaaatgcatctgttacataaatgagaaaaagctattatgctgatggagcatgctttttaaatcctttaaaaacactcaccatataaacttgcatttgagcttgtgtgttcttttgttaatgtgtagagttctcctttctcgaaattgccagtgtgtacttggcttaactcaagaacagtttcttctggattccttatttgatttatttaacctaattatattctaatattgcaaatattaccataagtgggtaaaagtaaaattcctcttctg

SEQ ID NO: 187454 - DNA, 3539 bp, Homo sapiens
  Payload ID: 16907
  Gene Symbol: ST14
  Gene Name: suppression of tumorigenicity 14 (colon carcinoma)
  Uniprot ID: Q9Y5Y6
  ENST ID: ENST00000278742
  CDS Start-End: 419-2986
ggccggaggggtggtgaacgccgtcgtggtgatggtgagggccttagcgaccaccacccgagtgaggccccctcaccttcaggcccagagccgaggggaggagcctcccccagggccggcgggggcgggcaggtgagccgggcaggtgcgcaggcgagcgcggcgggctgggcgggccgaggccacaccctgaaactacctgcgtgggccgggccggagtgtgagagcggagctgcagccggagaaagaggaagagggagagagagcgcgccagggcgagggcaccgccgccggtcgggcgcgctgggcctgcccggaatcccgccgcctgcgccccgcgccccgcgccctgcgggccatgggagccggccgccggcagggacgacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaacggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgcatatctgcctcccctgtctctaaggagcagcgggaacggagcttcggggcctcctcagtgaaggtggtggggctgccggatctgggctgtggggcccttgggccacgctcttgaggaagcccaggctcggaggaccctggaaaacagacgggtctgagactgaaattgttttaccagctcccagggtggacttcagtgtgtgtatttgtgtaaatgagtaaaacattttatttctttttaggtaagtttctttt

SEQ ID NO: 187455 - DNA, 6187 bp, Homo sapiens
  Payload ID: 16908
  Gene Symbol: ST18
  Gene Name: suppression of tumorigenicity 18, zinc finger
  Uniprot ID: O60284
  ENST ID: ENST00000276480
  CDS Start-End: 685-3828
ctttttgtagggagaagggcaggatgtttttaactgaatgtgacctcaggggaatactagagaaaataataaaatttctgaatggggcagcgtggagaaatcctaagagaaatagcataagagcattttggaacacatccaggaaaagataactttcgacacacctgtagacgttcgccaggtaaaggagtgatggaaactctccagttcagatccagtagcttttagggaaggaactacagttgctgacttaagttgaagaagcatctatttaatgtctggtcaaatcctacaagaaacacagaaatctatgattaaaaagctgagcactttgatatactgcaaagggtagagaaggcaggacggtagaaattttctgcaagaaagaatgaatttcaggatttatcactaaataagacaaagtcatttatttagtccccctgacacagcagggcaaactgagttgacatacaagttacctggagaaaaagagagcaattccaggacttcctcttcagcctaaaagaaggtaccagatctgtgcactggggcgatgtggaagagacctgcttattgcccctgatgtaagctccagtaagaaaagacgtcaagtacaagtactaggaaatcactttatacatctgtttataggaatgacctcaggactttgtgttcatgttatagatggatgcagaggctgaagataaaacgctgcgtactcgctctaaaggaaccgaggtgccaatggattcactaatccaggagctcagtgttgcctatgattgctccatggcaaagaagagaacagctgaagatcaggctttgggggttccagtcaacaaaaggaaatccctgctaatgaagccccgacactacagcccaaaagcagactgccaagaagaccgcagtgacaggacagaggacgatggccccttggaaacacatggtcactctaccgcagaggaaatcatgataaaacctatggatgaaagtcttctttcaactgcacaagaaaactccagtaggaaggaagacagatactcttgttatcaagagctcatggtcaagtctttaatgcacttggggaaatttgaaaaaaatgtatctgttcagactgtaagtgaaaatttaaatgacagtggcatccagtctttaaaagcagagagcgatgaagcagacgagtgctttctgattcattctgatgatggaagagacaagattgatgattctcagccacccttctgctcctctgatgacaatgaaagtaactctgaaagtgcagaaaatggctgggacagtggctccaacttctcagaagaaaccaaaccacctagagtcccaaagtatgttttaacagatcataaaaaagacctattggaagttcctgaaataaaaactgaaggtgacaaatttatcccttgtgagaacaggtgtgattctgaaacagaaaggaaagacccgcagaatgctctcgcagaacccctggatggcaatgcccagccctcattccctgacgttgaggaggaagatagcgagagcctggcagtaatgacggaagagggtagtgacctggaaaaggccaaggggaatttaagtttgctggagcaggcaattgctctgcaggctgagcgaggttgtgttttccataacacctacaaagagctggataggttcctgctggagcacctagcaggggaaaggaggcaaaccaaagttatcgacatgggtggaagacaaatctttaacaataaacattcaccaaggcctgaaaagagggagaccaagtgcccgatccctggatgtgatggcacgggacacgtgacagggctctacccgcaccaccgcagcctttcggggtgcccccacaaagtgcgggttcccctggaaattcttgccatgcatgaaaatgtgctcaagtgtcccacgccgggatgcacaggaaggggtcatgtgaacagcaaccgcaacacccacaggagtctttctggttgtccaattgctgcagctgaaaaattggcaatgtcccaggataaaaatcagcttgattctccccaaactgggcagtgtcctgaccaggcccacaggacaagtttggtgaagcaaattgaattcaatttcccgtcacaagccatcacctctcccagagccacagtgtcaaaagaacaagagaagtttggaaaagtaccatttgattatgccagttttgatgcccaagttttcggtaaacgccctctcatacaaacagtgcaaggacgaaaaacaccaccatttcctgaatcaaagcattttccaaatccagtgaaatttcctaatcgactgcctagtgcaggcgcccacacccagagccctggccgtgccagctcttatagctacggtcaatgtagtgaagacacccacatagcagcagctgctgccatcctgaacctttccacccgctgcagggaagccacagacatcctctccaacaagccacagagtctgcatgccaagggagccgaaatagaagtggatgaaaatggcacattggacttaagcatgaaaaaaaatcgaatcctggacaagtctgcacccctaacttcctctaacacttctattccaactccttcctcttccccattcaaaacaagcagcattctggtcaatgcagcattctatcaggctctttgtgaccaagagggctgggacactcctatcaactatagcaaaactcacgggaagacagaggaggagaaagagaaagacccagtgagctctctagaaaatttagaggaaaaaaagtttcctggagaggcctctataccaagccctaaacccaagcttcatgcaagagatctcaaaaaggaactaatcacctgtccaacaccaggatgtgatggaagtggccacgtgacaggaaactatgcatctcatcgcagtgtttctggatgtcctttagcagataagactctaaaatccctcatggctgccaactctcaggagcttaagtgtccaaccccaggctgcgatggctcggggcacgtgactggaaactatgcttcccacagaagcttgtccggatgccctcgtgcaaggaaaggtggtgtcaaaatgacccctaccaaggaagaaaaagaagaccctgaactgaaatgtcctgtgatagggtgtgatggccaaggtcacatatcaggtaaatacacatcacaccgcacagcttctggctgtcctctggctgccaagagacagaaggagaatcctctcaatggagcctccctctcctggaaactgaacaaacaagagctaccacattgtcccttgccaggctgcaatgggctgggccatgtaaataatgtttttgtcacccaccgaagcttatctggatgtcctctcaatgcacaagttatcaaaaagggcaaggtttctgaagaactcatgaccatcaagctcaaagcaactgggggaatagagagtgatgaagaaattaggcatttggatgaagaaataaaggaactgaatgaatccaaccttaaaattgaagcagatatgatgaaacttcagacccagatcacatctatggagagcaacttaaagacgatagaggaggagaacaaactcatagaacagaacaatgaaagtctgctgaaagagctggcaggtctaagccaagctctcatttcaagccttgctgacatccagcttccacagatgggacctatcagtgagcagaattttgaagcatatgtaaatacactcacagatatgtacagcaatctggaacgggactattccccggaatgcaaagctctactggaaagtatcaaacaggcagtgaagggtatccatgtgtaggatcacagcgctgccgggcaacagaagttaccaacagcagtaaactccagatggatctgttagaggttcatgtactgctaaggcgtggaggttgccgtactgcatttacaatttgcaacattgcactaattttattttccccagctgatataaaaaggaaagaaaaactatgatagacttcttggattaaaagcaatgcagtcaattattagatcttatttattttcatatgtttttcttttatttcttcattgtactctttttttttttgtaaagtatatgtaaaataaatgtgacatttttataatttatttattactaatcaaagagttttttatcttttaactgcattttgaagtctgccgtatttttacaagtgtgtttattaatttattttccaataggatttaaatagaaatgctattctcaagtcatctttcttgctgggttttaatgaggaaacaggaaagggtgaaggaaatccttgtctaaggactgcactatagttgagtttgatttttattgcacacttcttcccccacctttcactgatttttgtatttataaatgaatttgcggtaaggtgagctgcacggaaggaataagaagacaaatggcgcccactagtggggaatccgcactcacaaaagcacaggatgctggaaaacagcctgctcagaatttgttagcaataattaaatatagcaatcagcaaagtattcgacttggctggacggttttcgttaatatgaattatttatttgaaatgttttaaagaaacataagcctttttagtgatgcagatttgtctgtttgtttttcaagtcatatcagatcgttggcaactcgtatcccaagatgaaaaataagacttggtgtgaccagccaggctttcctgccatatgttggtacaatatacaagtgacaatattggtgtagatttgtacttagcaaatacaaacacatccaaatgaaaaattttgtagataccatatcccctgaaatagcatttatcttactgggttgactggaaaggaatggaaaatatagtaacacatgaaaaaatgctactccaatctgaatgattacttcaaacactggcaccttgggtctcacccaccataggaaacaagacaacattcaatttgatagaaatcttgccacaaaacttcaaatgctacaaaatatacacacacactcacacacacaggcatactcacacacagacacacacacacacacacacacagactcatccacacttcaaattgagcccacaatcttgaatttctgaacggatcagagtttcatagtttctatagtaaaggcaatgtctatttcagggattgtaaagtagttaagcattgtttcaaaagtttttttatatttattttttttaaggaaaaggtatagacaaccagctaaactgcctttttggtgtgcacacacatttcatgtgcagacgtgcctctgtgtaaatgtacacatgaacttcatgtgggcttaattttctgtgctataaacaaaagtgtttattttttattaacctcatggatatttagatggaaagtgatggcattcacaggcttgatgtattccactgttattactgttacctgcacaaatgaaaaacaatactcaacagtaattccactcccatgaaactttggtcattgttatgcattaagtggggcttatctttggtttggagttcatttgaactcttgaaccttagtttagtgaagatgaactgtctgttcttaggtagaaacggtgtttatttaaaaatcagttttaaaaaatgagctaccatatgtgctgtctattataaatgggacaccaaacaaaattttctattacagttgtgtacttgcaaacattttgctatacagtacttcatagatgcatacaaatgagctcacttattacaaagacaaacgtttaatttgctaaatattttaacaagtttgttatatattttatttaatttaaaagaaatctcttaccaacctacatatttattactataatttgctatgacttcaggttaatttatttgtgtttgcatagtttgagcaggatgttttgtgaagtatgtttgtatttatttgcctactttgtacttgatgtgttttgtaatgtgcactgaatttgttttcttttcaactatgttaatgatcaatactgtaaattgggtcttttgtaaacaaaaaggcaatgatgtatgcattttttttaatttgaggtagtttgtttgtatactgtttctccaaacacttaatatttcttacatcaaagcaacaaaattgtgttcagtgctgtacatttggtgtatggtaggaaataaaaattgataacg

SEQ ID NO: 187456 - DNA, 629 bp, Homo sapiens
  Payload ID: 16908
  Gene Symbol: ST18
  Gene Name: suppression of tumorigenicity 18, zinc finger
  ENST ID: ENST00000519118
  CDS Start-End: 592-629
agaggatgtttagttcaagagaggatgatattgttacaagacattcagagcccccaattttgtgagtgtccctgaagcattgtgacaattccattttatgtgtctgcgtgctcatatcaagactaaggagtgatggaaactctccagttcagatccagtagcttttagggaaggaactacagttgctgacttaagttgaagaagcatctatttaatgtctggtcaaatcctacaagaaacacagaaatctatgattaaaaagctgagcactttgatatactgcaaagggtagagaaggcaggacggtagaaattttctgcaagaaagaatgaatttcaggatttatcactaaataagacaaagtcatttatttagtccccctgacacagcagggcaaactgagttgacatacaagttacctggagaaaaagagagcaattccaggacttcctcttcagcctaaaagaaggtaccagatctgtgcactggggcgatgtggaagagacctgcttattgcccctgatgtaagctccagtaagaaaagacgtcaagtacaagtactaggaaatcactttatacatctgtttatagatggatgcagaggctgaagataaaacgctgcgtactcg

SEQ ID NO: 187457 - DNA, 2579 bp, Homo sapiens
  Payload ID: 16908
  Gene Symbol: ST18
  Gene Name: suppression of tumorigenicity 18, zinc finger
  ENST ID: ENST00000517580
  CDS Start-End: 718-2579
ggtaaataacacagagcaaagttagcaagttgcagcgcctctgcgttctgattctatggaacctttttgtagggagaagggcaggatgtttttaactgaatgtgacctcaggggaatactagagaaaataataaaatttctgaatggggcagcgtggagaaatcctaagagaaatagcataagagcattttggaacacatccaggaaaagataactttcgacacacctgtagacgttcgccaggtaaaggagtgatggaaactctccagttcagatccagtagcttttagggaaggaactacagttgctgacttaagttgaagaagcatctatttaatgtctggtcaaatcctacaagaaacacagaaatctatgattaaaaagctgagcactttgatatactgcaaagggtagagaaggcaggacggtagaaattttctgcaagaaagaatgaatttcaggatttatcactaaataagacaaagtcatttatttagtccccctgacacagcagggcaaactgagttgacatacaagttacctggagaaaaagagagcaattccaggacttcctcttcagcctaaaagaaggtaccagatctgtgcactggggcgatgtggaagagacctgcttattgcccctgatgtaagctccagtaagaaaagacgtcaagtacaagtactaggaaatcactttatacatctgtttataggtttatggatgcagaggctgaagataaaacgctgcgtactcgctctaaaggaaccgaggtgccaatggattcactaatccaggagctcagtgttgcctatgattgctccatggcaaagaagagaacagctgaagatcaggctttgggggttccagtcaacaaaaggaaatccctgctaatgaagccccgacactacagcccaaaagcagactgccaagaagaccgcagtgacaggacagaggacgatggccccttggaaacacatggtcactctaccgcagaggaaatcatgataaaacctatggatgaaagtcttctttcaactgcacaagaaaactccagtaggaaggaagacagatactcttgttatcaagagctcatggtcaagtctttaatgcacttggggaaatttgaaaaaaatgtatctgttcagactgtaagtgaaaatttaaatgacagtggcatccagtctttaaaagcagagagcgatgaagcagacgagtgctttctgattcattctgatgatggaagagacaagattgatgattctcagccacccttctgctcctctgatgacaatgaaagtaactctgaaagtgcagaaaatggctgggacagtggctccaacttctcagaagaaaccaaaccacctagagtcccaaagtatgttttaacagatcataaaaaagacctattggaagttcctgaaataaaaactgaaggtgacaaatttatcccttgtgagaacaggtgtgattctgaaacagaaaggaaagacccgcagaatgctctcgcagaacccctggatggcaatgcccagccctcattccctgacgttgaggaggaagatagcgagagcctggcagtaatgacggaagagggtagtgacctggaaaaggccaaggggaatttaagtttgctggagcaggcaattgctctgcaggctgagcgaggttgtgttttccataacacctacaaagagctggataggttcctgctggagcacctagcaggggaaaggaggcaaaccaaagttatcgacatgggtggaagacaaatctttaacaataaacattcaccaaggcctgaaaagagggagaccaagtgcccgatccctggatgtgatggcacgggacacgtgacagggctctacccgcaccaccgcagcctttcggggtgcccccacaaagtgcgggttcccctggaaattcttgccatgcatgaaaatgtgctcaagtgtcccacgccgggatgcacaggaaggggtcatgtgaacagcaaccgcaacacccacaggagtctttctggttgtccaattgctgcagctgaaaaattggcaatgtcccaggataaaaatcagcttgattctccccaaactgggcagtgtcctgaccaggcccacaggacaagtttggtgaagcaaattgaattcaatttcccgtcacaagccatcacctctcccagagccacagtgtcaaaagaacaagagaagtttggaaaagtaccatttgattatgccagttttgatgcccaagttttcggtaaacgccctctcatacaaacagtgcaaggacgaaaaacaccaccatttcctgaatcaaagcattttccaaatccagtgaaatttcctaatcgactgcctagtgcaggcgcccacacccagagccctggccgtgccagctcttatagctacggtcaatgtagtgaagacacccacatagcagcagctgctgccatcctgaacctttccacccgctgcagggaagccacagacatcctctccaacaagccacagagtctgcatgccaagggagccgaaatagaagtggatgaaaatggcacattggacttaagcatgaaaaaaaa

SEQ ID NO: 187458 - DNA, 3963 bp, Homo sapiens
  Payload ID: 16908
  Gene Symbol: ST18
  Gene Name: suppression of tumorigenicity 18, zinc finger
  ENST ID: ENST00000522251
  CDS Start-End: 78-203
tgcccctgatgtaagctccagtaagaaaagacgtcaagtacaagtactaggaaatcactttatacatctgtttatagatggatgcagaggctgaagataaaacgctgcgtactcgctctaaaggaaccgaggtgccaatggattcactaatccaggagctcagaatcagtgtgcccgtggacatgaggccacttacctggtgagggacaccagagtcctttaaaggaaccaagtcattcagagaaaaaaagtgttgcctatgattgctccatggcaaagaagagaacagctgaagatcaggctttgggggttccagtcaacaaaaggaaatccctgctaatgaagccccgacactacagcccaaaagcagactgccaagaagaccgcagtgacaggacagaggacgatggccccttggaaacacatggtcactctaccgcagaggaaatcatgataaaacctatggatgaaagtcttctttcaactgcacaagaaaactccagtaggaaggaagacagatactcttgttatcaagagctcatggtcaagtctttaatgcacttggggaaatttgaaaaaaatgtatctgttcagactgtaagtgaaaatttaaatgacagtggcatccagtctttaaaagcagagagcgatgaagcagacgagtgctttctgattcattctgatgatggaagagacaagattgatgattctcagccacccttctgctcctctgatgacaatgaaagtaactctgaaagtgcagaaaatggctgggacagtggctccaacttctcagaagaaaccaaaccacctagagtcccaaagtatgttttaacagatcataaaaaagacctattggaagttcctgaaataaaaactgaaggtgacaaatttatcccttgtgagaacaggtgtgattctgaaacagaaaggaaagacccgcagaatgctctcgcagaacccctggatggcaatgcccagccctcattccctgacgttgaggaggaagatagcgagagcctggcagtaatgacggaagagggtagtgacctggaaaaggccaaggggaatttaagtttgctggagcaggcaattgctctgcaggctgagcgaggttgtgttttccataacacctacaaagagctggataggttcctgctggagcacctagcaggggaaaggaggcaaaccaaagttatcgacatgggtggaagacaaatctttaacaataaacattcaccaaggcctgaaaagagggagaccaagtgcccgatccctggatgtgatggcacgggacacgtgacagggctctacccgcaccaccgcagcctttcggggtgcccccacaaagtgcgggttcccctggaaattcttgccatgcatgaaaatgtgctcaagtgtcccacgccgggatgcacaggaaggggtcatgtgaacagcaaccgcaacacccacaggagtctttctggttgtccaattgctgcagctgaaaaattggcaatgtcccaggataaaaatcagcttgattctccccaaactgggcagtgtcctgaccaggcccacaggacaagtttggtgaagcaaattgaattcaatttcccgtcacaagccatcacctctcccagagccacagtgtcaaaagaacaagagaagtttggaaaagtaccatttgattatgccagttttgatgcccaagttttcggtaaacgccctctcatacaaacagtgcaaggacgaaaaacaccaccatttcctgaatcaaagcattttccaaatccagtgaaatttcctaatcgactgcctagtgcaggcgcccacacccagagccctggccgtgccagctcttatagctacggtcaatgtagtgaagacacccacatagcagcagctgctgccatcctgaacctttccacccgctgcagggaagccacagacatcctctccaacaagccacagagtctgcatgccaagggagccgaaatagaagtggatgaaaatggcacattggacttaagcatgaaaaaaaatcgaatcctggacaagtctgcacccctaacttcctctaacacttctattccaactccttcctcttccccattcaaaacaagcagcattctggtcaatgcagcattctatcaggctctttgtgaccaagagggctgggacactcctatcaactatagcaaaactcacgggaagacagaggaggagaaagagaaagacccagtgagctctctagaaaatttagaggaaaaaaagtttcctggagaggcctctataccaagccctaaacccaagcttcatgcaagagatctcaaaaaggaactaatcacctgtccaacaccaggatgtgatggaagtggccacgtgacaggaaactatgcatctcatcgcagtgtttctggatgtcctttagcagataagactctaaaatccctcatggctgccaactctcaggagcttaagtgtccaaccccaggctgcgatggctcggggcacgtgactggaaactatgcttcccacagaagcttgtccggatgccctcgtgcaaggaaaggtggtgtcaaaatgacccctaccaaggaagaaaaagaagaccctgaactgaaatgtcctgtgatagggtgtgatggccaaggtcacatatcaggtaaatacacatcacaccgcacagcttctggctgtcctctggctgccaagagacagaaggagaatcctctcaatggagcctccctctcctggaaactgaacaaacaagagctaccacattgtcccttgccaggctgcaatgggctgggccatgtaaataatgtttttgtcacccaccgaagcttatctggatgtcctctcaatgcacaagttatcaaaaagggcaaggtttctgaagaactcatgaccatcaagctcaaagcaactgggggaatagagagtgatgaagaaattaggcatttggatgaagaaataaaggaactgaatgaatccaaccttaaaattgaagcagatatgatgaaacttcagacccagatcacatctatggagagcaacttaaagacgatagaggaggagaacaaactcatagaacagaacaatgaaagtctgctgaaagagctggcaggtctaagccaagctctcatttcaagccttgctgacatccagcttccacagatgggacctatcagtgagcagaattttgaagcatatgtaaatacactcacagatatgtacagcaatctggaacgggactattccccggaatgcaaagctctactggaaagtatcaaacaggcagtgaagggtatccatgtgtaggatcacagcgctgccgggcaacagaagttaccaacagcagtaaactccagatggatctgttagaggttcatgtactgctaaggcgtggaggttgccgtactgcatttacaatttgcaacattgcactaattttattttccccagctgatataaaaaggaaagaaaaactatgatagacttcttggattaaaagcaatgcagtcaattattagatcttatttattttcatatgtttttcttttatttcttcattgtactctttttttttttgtaaagtatatgtaaaataaatgtgacatttttataatttatttattactaatcaaagagttttttatcttttaactgcattttgaagtctgccgtatttttacaagtgtgtttattaatttattttccaataggatttaaatagaaatgctattctcaagtcatctttcttgctgggttttaatgaggaaacaggaaagggtgaaggaaatccttgtctaaggactgcactatagttgagtttgatttttattgcacacttcttcccccacctttcactgatttttgtatttataaatgaatttgcggtaaggtgagctgcacggaaggaataagaagacaaatggcgcccactagtggggaatccgcactcacaaaagcaca

SEQ ID NO: 187459 - DNA, 3870 bp, Homo sapiens
  Payload ID: 16908
  Gene Symbol: ST18
  Gene Name: suppression of tumorigenicity 18, zinc finger
  ENST ID: ENST00000521824
  CDS Start-End: 77-361
gcccctgatgtaagctccagtaagaaaagacgtcaagtacaagtactaggaaatcactttatacatctgtttatagatggatgcagaggctgaagataaaacgctgcgtactcgctctaaaggaaccgaggtgccaatggattcactaatccaggagctcagtgttgcctatgattgctccatggcaaagaagagaacagctgaagatcaggctttgggggttccagtcaacaaaaggaaatccctgctaatgaagccccgacactacagcccaaaagcagactgccaagaagaccgcagtgacaggacagaggacgatggccccttggaaacacatggtcactctaccaggaaatcatgataaaacctatggatgaaagtcttctttcaactgcacaagaaaactccagtaggaaggaagacagatactcttgttatcaagagctcatggtcaagtctttaatgcacttggggaaatttgaaaaaaatgtatctgttcagactgtaagtgaaaatttaaatgacagtggcatccagtctttaaaagcagagagcgatgaagcagacgagtgctttctgattcattctgatgatggaagagacaagattgatgattctcagccacccttctgctcctctgatgacaatgaaagtaactctgaaagtgcagaaaatggctgggacagtggctccaacttctcagaagaaaccaaaccacctagagtcccaaagtatgttttaacagatcataaaaaagacctattggaagttcctgaaataaaaactgaaggtgacaaatttatcccttgtgagaacaggtgtgattctgaaacagaaaggaaagacccgcagaatgctctcgcagaacccctggatggcaatgcccagccctcattccctgacgttgaggaggaagatagcgagagcctggcagtaatgacggaagagggtagtgacctggaaaaggccaaggggaatttaagtttgctggagcaggcaattgctctgcaggctgagcgaggttgtgttttccataacacctacaaagagctggataggttcctgctggagcacctagcaggggaaaggaggcaaaccaaagttatcgacatgggtggaagacaaatctttaacaataaacattcaccaaggcctgaaaagagggagaccaagtgcccgatccctggatgtgatggcacgggacacgtgacagggctctacccgcaccaccgcagcctttcggggtgcccccacaaagtgcgggttcccctggaaattcttgccatgcatgaaaatgtgctcaagtgtcccacgccgggatgcacaggaaggggtcatgtgaacagcaaccgcaacacccacaggagtctttctggttgtccaattgctgcagctgaaaaattggcaatgtcccaggataaaaatcagcttgattctccccaaactgggcagtgtcctgaccaggcccacaggacaagtttggtgaagcaaattgaattcaatttcccgtcacaagccatcacctctcccagagccacagtgtcaaaagaacaagagaagtttggaaaagtaccatttgattatgccagttttgatgcccaagttttcggtaaacgccctctcatacaaacagtgcaaggacgaaaaacaccaccatttcctgaatcaaagcattttccaaatccagtgaaatttcctaatcgactgcctagtgcaggcgcccacacccagagccctggccgtgccagctcttatagctacggtcaatgtagtgaagacacccacatagcagcagctgctgccatcctgaacctttccacccgctgcagggaagccacagacatcctctccaacaagccacagagtctgcatgccaagggagccgaaatagaagtggatgaaaatggcacattggacttaagcatgaaaaaaaatcgaatcctggacaagtctgcacccctaacttcctctaacacttctattccaactccttcctcttccccattcaaaacaagcagcattctggtcaatgcagcattctatcaggctctttgtgaccaagagggctgggacactcctatcaactatagcaaaactcacgggaagacagaggaggagaaagagaaagacccagtgagctctctagaaaatttagaggaaaaaaagtttcctggagaggcctctataccaagccctaaacccaagcttcatgcaagagatctcaaaaaggaactaatcacctgtccaacaccaggatgtgatggaagtggccacgtgacaggaaactatgcatctcatcgcagtgtttctggatgtcctttagcagataagactctaaaatccctcatggctgccaactctcaggagcttaagtgtccaaccccaggctgcgatggctcggggcacgtgactggaaactatgcttcccacagaagcttgtccggatgccctcgtgcaaggaaaggtggtgtcaaaatgacccctaccaaggaagaaaaagaagaccctgaactgaaatgtcctgtgatagggtgtgatggccaaggtcacatatcaggtaaatacacatcacaccgcacagcttctggctgtcctctggctgccaagagacagaaggagaatcctctcaatggagcctccctctcctggaaactgaacaaacaagagctaccacattgtcccttgccaggctgcaatgggctgggccatgtaaataatgtttttgtcacccaccgaagcttatctggatgtcctctcaatgcacaagttatcaaaaagggcaaggtttctgaagaactcatgaccatcaagctcaaagcaactgggggaatagagagtgatgaagaaattaggcatttggatgaagaaataaaggaactgaatgaatccaaccttaaaattgaagcagatatgatgaaacttcagacccagatcacatctatggagagcaacttaaagacgatagaggaggagaacaaactcatagaacagaacaatgaaagtctgctgaaagagctggcaggtctaagccaagctctcatttcaagccttgctgacatccagcttccacagatgggacctatcagtgagcagaattttgaagcatatgtaaatacactcacagatatgtacagcaatctggaacgggactattccccggaatgcaaagctctactggaaagtatcaaacaggcagtgaagggtatccatgtgtaggatcacagcgctgccgggcaacagaagttaccaacagcagtaaactccagatggatctgttagaggttcatgtactgctaaggcgtggaggttgccgtactgcatttacaatttgcaacattgcactaattttattttccccagctgatataaaaaggaaagaaaaactatgatagacttcttggattaaaagcaatgcagtcaattattagatcttatttattttcatatgtttttcttttatttcttcattgtactctttttttttttgtaaagtatatgtaaaataaatgtgacatttttataatttatttattactaatcaaagagttttttatcttttaactgcattttgaagtctgccgtatttttacaagtgtgtttattaatttattttccaataggatttaaatagaaatgctattctcaagtcatctttcttgctgggttttaatgaggaaacaggaaagggtgaaggaaatccttgtctaaggactgcactatagttgagtttgatttttattgcacacttcttcccccacctttcactgatttttgtatttataaatgaatttgcggtaaggtgagctgcacggaaggaataagaagacaaatggcgcccactagtggggaatccgcactcacaaaagcaca

SEQ ID NO: 187460 - DNA, 3928 bp, Homo sapiens
  Payload ID: 16908
  Gene Symbol: ST18
  Gene Name: suppression of tumorigenicity 18, zinc finger
  ENST ID: ENST00000521582
  CDS Start-End: 78-1172
tgcccctgatgtaagctccagtaagaaaagacgtcaagtacaagtactaggaaatcactttatacatctgtttatagatggatgcagaggctgaagataaaacgctgcgtactcgctctaaaggaaccgaggtgccaatggattcactaatccaggagctcagtgttgcctatgattgctccatggcaaagaagagaacagctgaagatcaggctttgggggttccagtcaacaaaaggaaatccctgctaatgaagccccgacactacagcccaaaagcagactgccaagaagaccgcagtgacaggacagaggacgatggccccttggaaacacatggtcactctaccgcagaggaaatcatgataaaacctatggatgaaagtcttctttcaactgcacaagaaaactccagtaggaaggaagacagatactcttgttatcaagagctcatggtcaagtctttaatgcacttggggaaatttgaaaaaaatgtatctgttcagactgtaagtgaaaatttaaatgacagtggcatccagtctttaaaagcagagagcgatgaagcagacgagtgctttctgattcattctgatgatggaagagacaagattgatgattctcagccacccttctgctcctctgatgacaatgaaagtaactctgaaagtgcagaaaatggctgggacagtggctccaacttctcagaagaaaccaaaccacctagagtcccaaagtatgttttaacagatcataaaaaagacctattggaagttcctgaaataaaaactgaaggtgacaaatttatcccttgtgagaacaggtgtgattctgaaacagaaaggaaagacccgcagaatgctctcgcagaacccctggatggcaatgcccagccctcattccctgacgttgaggaggaagatagcgagagcctggcagtaatgacggaagagggtagtgacctggaaaaggccaaggggaatttaagtttgctggagcaggcaattgctctgcaggctgagcgaggttgtgttttccataacacctacaaagagctggataggttcctgctggagcacctagcaggggaaaggaggcaaaccaaagttatcgacatgggtggaagacaaatctttaacaataaacattatcctccaatcaagctgtgttaattttggactattttcacacatgaaaaaagattcaccaaggcctgaaaagagggagaccaagtgcccgatccctggatgtgatggcacgggacacgtgacagggctctacccgcaccaccgcagcctttcggggtgcccccacaaagtgcgggttcccctggaaattcttgccatgcatgaaaatgtgctcaagtgtcccacgccgggatgcacaggaaggggtcatgtgaacagcaaccgcaacacccacaggagtctttctggttgtccaattgctgcagctgaaaaattggcaatgtcccaggataaaaatcagcttgattctccccaaactgggcagtgtcctgaccaggcccacaggacaagtttggtgaagcaaattgaattcaatttcccgtcacaagccatcacctctcccagagccacagtgtcaaaagaacaagagaagtttggaaaagtaccatttgattatgccagttttgatgcccaagttttcggtaaacgccctctcatacaaacagtgcaaggacgaaaaacaccaccatttcctgaatcaaagcattttccaaatccagtgaaatttcctaatcgactgcctagtgcaggcgcccacacccagagccctggccgtgccagctcttatagctacggtcaatgtagtgaagacacccacatagcagcagctgctgccatcctgaacctttccacccgctgcagggaagccacagacatcctctccaacaagccacagagtctgcatgccaagggagccgaaatagaagtggatgaaaatggcacattggacttaagcatgaaaaaaaatcgaatcctggacaagtctgcacccctaacttcctctaacacttctattccaactccttcctcttccccattcaaaacaagcagcattctggtcaatgcagcattctatcaggctctttgtgaccaagagggctgggacactcctatcaactatagcaaaactcacgggaagacagaggaggagaaagagaaagacccagtgagctctctagaaaatttagaggaaaaaaagtttcctggagaggcctctataccaagccctaaacccaagcttcatgcaagagatctcaaaaaggaactaatcacctgtccaacaccaggatgtgatggaagtggccacgtgacaggaaactatgcatctcatcgcagtgtttctggatgtcctttagcagataagactctaaaatccctcatggctgccaactctcaggagcttaagtgtccaaccccaggctgcgatggctcggggcacgtgactggaaactatgcttcccacagaagcttgtccggatgccctcgtgcaaggaaaggtggtgtcaaaatgacccctaccaaggaagaaaaagaagaccctgaactgaaatgtcctgtgatagggtgtgatggccaaggtcacatatcaggtaaatacacatcacaccgcacagcttctggctgtcctctggctgccaagagacagaaggagaatcctctcaatggagcctccctctcctggaaactgaacaaacaagagctaccacattgtcccttgccaggctgcaatgggctgggccatgtaaataatgtttttgtcacccaccgaagcttatctggatgtcctctcaatgcacaagttatcaaaaagggcaaggtttctgaagaactcatgaccatcaagctcaaagcaactgggggaatagagagtgatgaagaaattaggcatttggatgaagaaataaaggaactgaatgaatccaaccttaaaattgaagcagatatgatgaaacttcagacccagatcacatctatggagagcaacttaaagacgatagaggaggagaacaaactcatagaacagaacaatgaaagtctgctgaaagagctggcaggtctaagccaagctctcatttcaagccttgctgacatccagcttccacagatgggacctatcagtgagcagaattttgaagcatatgtaaatacactcacagatatgtacagcaatctggaacgggactattccccggaatgcaaagctctactggaaagtatcaaacaggcagtgaagggtatccatgtgtaggatcacagcgctgccgggcaacagaagttaccaacagcagtaaactccagatggatctgttagaggttcatgtactgctaaggcgtggaggttgccgtactgcatttacaatttgcaacattgcactaattttattttccccagctgatataaaaaggaaagaaaaactatgatagacttcttggattaaaagcaatgcagtcaattattagatcttatttattttcatatgtttttcttttatttcttcattgtactctttttttttttgtaaagtatatgtaaaataaatgtgacatttttataatttatttattactaatcaaagagttttttatcttttaactgcattttgaagtctgccgtatttttacaagtgtgtttattaatttattttccaataggatttaaatagaaatgctattctcaagtcatctttcttgctgggttttaatgaggaaacaggaaagggtgaaggaaatccttgtctaaggactgcactatagttgagtttgatttttattgcacacttcttcccccacctttcactgatttttgtatttataaatgaatttgcggtaaggtgagctgcacggaaggaataagaagacaaatggcgcccactagtggggaatccgcactcacaaaagca

SEQ ID NO: 187461 - DNA, 4507 bp, Homo sapiens
  Payload ID: 16909
  Gene Symbol: ST5
  Gene Name: suppression of tumorigenicity 5
  Uniprot ID: P78524
  ENST ID: ENST00000313726
  CDS Start-End: 350-3763
gagagagagagagagagagagagagagagagagacagtgagaaagaaagaaaaagagagcgcccttgtgcacgcgctaggccaagagcgcgccgctgtgcgcgcgcccgcctagcgaggacagggtctccatgacaaccggcctggccggctagcagtgctctgctcacttggctgcgaggagcgccacgaaaggtcagaggaaggagctgtgggaagctcgcagcaggtatcggagcttaagccagtggatttgggggccctgggctccctagccggctgcggtgtgagaatggagtgggcaggaaagcagcgggactttcagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgccattcccggggccagcagctggcccccggggcgtcttgctgacccgtaccggtacccgcgcccacagcctgggcatccgggagaagatatcagcatgggaaggtcgccgagaggcgtcgcccaggatgagcatgtgtggagagaagcgggagggctctgggagcgagtgggcggccagtgagggctgccccagcctgggctgtcccagcgtggtgccgtccccctgcagctctgaaaagacctttgatttcaagggcctccggaggatgagcaggaccttctccgagtgttcctacccagagactgaggaggagggagaggcgctccctgtccgggactctttctaccggctggagaaacggctgggccggagtgagcccagcgccttcctcagggggcatggcagcaggaaggagagctcagcagtgctgagccggatccagaaaattgaacaggtcctgaaggagcagccgggccgggggctcccccagctccccagcagctgctacagcgtggaccgggggaaaaggaagactggaaccttgggctccttggaggagccggcagggggcgcgagtgtgagcgctggcagccgggcagtcggagtggctggtgttgcgggggaggcgggcccacccccagagagggaaggcagtggttccactaagcccgggacccctggaaatagccctagctcccagcggctgccatcgaagagttccctcgatcccgctgtgaaccctgtccccaaacccaagcgcacctttgaatacgaggctgacaagaaccccaagagtaagcccagtaatggtctacctccttcacccacacctgctgctccacctcccttgccctccaccccagccccgccagtcacccggagacccaagaaggacatgcgtggtcaccgcaagtcccagagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccaga

SEQ ID NO: 187462 - DNA, 4315 bp, Homo sapiens
  Payload ID: 16909
  Gene Symbol: ST5
  Gene Name: suppression of tumorigenicity 5
  Uniprot ID: P78524
  ENST ID: ENST00000357665
  CDS Start-End: 161-3574
cacagatttcacaccctttggagagtttctttcttggataattcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgccattcccggggccagcagctggcccccggggcgtcttgctgacccgtaccggtacccgcgcccacagcctgggcatccgggagaagatatcagcatgggaaggtcgccgagaggcgtcgcccaggatgagcatgtgtggagagaagcgggagggctctgggagcgagtgggcggccagtgagggctgccccagcctgggctgtcccagcgtggtgccgtccccctgcagctctgaaaagacctttgatttcaagggcctccggaggatgagcaggaccttctccgagtgttcctacccagagactgaggaggagggagaggcgctccctgtccgggactctttctaccggctggagaaacggctgggccggagtgagcccagcgccttcctcagggggcatggcagcaggaaggagagctcagcagtgctgagccggatccagaaaattgaacaggtcctgaaggagcagccgggccgggggctcccccagctccccagcagctgctacagcgtggaccgggggaaaaggaagactggaaccttgggctccttggaggagccggcagggggcgcgagtgtgagcgctggcagccgggcagtcggagtggctggtgttgcgggggaggcgggcccacccccagagagggaaggcagtggttccactaagcccgggacccctggaaatagccctagctcccagcggctgccatcgaagagttccctcgatcccgctgtgaaccctgtccccaaacccaagcgcacctttgaatacgaggctgacaagaaccccaagagtaagcccagtaatggtctacctccttcacccacacctgctgctccacctcccttgccctccaccccagccccgccagtcacccggagacccaagaaggacatgcgtggtcaccgcaagtcccagagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggccc

SEQ ID NO: 187463 - DNA, 887 bp, Homo sapiens
  Payload ID: 16909
  Gene Symbol: ST5
  Gene Name: suppression of tumorigenicity 5
  ENST ID: ENST00000526155
  CDS Start-End: 515-887
cttggtcggatggtgaggaggtgagggccgtccagtttgggggccaacttctcctccctgctgcccccggcccccgcctccctcacccctgtcccccaccctccctcgcacactctcggcgcggctttctcgctgcctccggcgcctccgagcgctcccctccgccgggctccagcagcccaccctctctgtcttgggtggaggcgcacatcctccacgccccctccactcaaatctgcgctccctcccctctctctccctgcagcccggccgcagcccggggcgcggatgcctgcccgccgcccgccctctctgcaggagcggctcctcctccgggccgcgcggctcccggcgagaccccatccaggcgccgcgcccggcccggctggggaacgcagaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatg

SEQ ID NO: 187464 - DNA, 560 bp, Homo sapiens
  Payload ID: 16909
  Gene Symbol: ST5
  Gene Name: suppression of tumorigenicity 5
  ENST ID: ENST00000527930
  CDS Start-End: 12-560
aacagaggattatgacttcaaggaagaatggaggtggggcgcatagctggcaagaaaccccgtgggaacaaagaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgccattcccggggccagcagctggcccccggggcgtcttgctgacc

SEQ ID NO: 187465 - DNA, 547 bp, Homo sapiens
  Payload ID: 16909
  Gene Symbol: ST5
  Gene Name: suppression of tumorigenicity 5
  ENST ID: ENST00000533580
  CDS Start-End: 82-547
agttgtcagaggcagggctggactcaaggcaggtgtttttccactgcccctcggggcctgcgactgtgcctgtttgtctggatgcagtttgtagaaaagttccagagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgc

SEQ ID NO: 187466 - DNA, 595 bp, Homo sapiens
  Payload ID: 16909
  Gene Symbol: ST5
  Gene Name: suppression of tumorigenicity 5
  ENST ID: ENST00000528196
  CDS Start-End: 150-595
ataaagacaggtagggctgaagggtggaggtagggtctccagctgcagttgtcaagaacccaacgtgaaggctgactgagcagagaaactgctgctgcccagaaagaaagcacttttagcagtgggctctgggtttgcagagagccgaaatgaccatgactgccaacaagaattccagcatcacccacggagctggtggcactaaagcccctcgggggactctgagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgatt

SEQ ID NO: 187467 - DNA, 940 bp, Homo sapiens
  Payload ID: 16909
  Gene Symbol: ST5
  Gene Name: suppression of tumorigenicity 5
  ENST ID: ENST00000528527
  CDS Start-End: 402-940
acttggctgcgaggagcgccacgaaaggtcagaggaaggagctgtgggaagctcgcagcaggtatcggagcttaagccagtggatttgggggccctgggctccctagccggctgcggtgtgagaatggagtgggcaggaaagcagcgggactttcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaa

SEQ ID NO: 187468 - DNA, 573 bp, Homo sapiens
  Payload ID: 16909
  Gene Symbol: ST5
  Gene Name: suppression of tumorigenicity 5
  ENST ID: ENST00000527347
  CDS Start-End: 239-573
gtgcgcgcccggtcccgcccctgccctcccagcccttttccctctgctcccgactcccggccccggcagcggtgtccagctccatttcacaccctttggagagtttctttcttggataattcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagaga

SEQ ID NO: 187469 - DNA, 631 bp, Homo sapiens
  Payload ID: 16909
  Gene Symbol: ST5
  Gene Name: suppression of tumorigenicity 5
  ENST ID: ENST00000527516
  CDS Start-End: 347-631
agaccccgttgtgctttgctccagacccagacaactcttggtcggatggtgaggagcccggccgcagcccggggcgcggatgcctgcccgccgcccgccctctctgcaggagcggctcctcctccgggccgcgcggctcccggcgagaccccatccaggcgccgcgcccggcccggctggggaacgcagagatttcacaccctttggagagtttctttcttggataattcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaag

SEQ ID NO: 187470 - DNA, 588 bp, Homo sapiens
  Payload ID: 16909
  Gene Symbol: ST5
  Gene Name: suppression of tumorigenicity 5
  ENST ID: ENST00000530580
  CDS Start-End: 182-588
ttgactttcacttccccaggcctcagtgcctcttcccacagaggctgggttttctccttgttgctgcctgagcaggtgaccttgggatggttcccacagagcagtgtggctccaggcactgccctttgctgtctacttcagcacctgtggcttcagggctctgggtttgcagagagccgaaatgaccatgactgccaacaagaattccagcatcacccacggagctggtggcactaaagcccctcgggggactctgagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgg

SEQ ID NO: 187471 - DNA, 564 bp, Homo sapiens
  Payload ID: 16909
  Gene Symbol: ST5
  Gene Name: suppression of tumorigenicity 5
  ENST ID: ENST00000534248
  CDS Start-End: 197-564
taatatccagtgcgtcctccctggcactccgattctcagtagtcatgaaccagctggcttctatatctctcaccaatcacaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagccca

SEQ ID NO: 187472 - DNA, 3396 bp, Homo sapiens
  Payload ID: 16909
  Gene Symbol: ST5
  Gene Name: suppression of tumorigenicity 5
  Uniprot ID: P78524
  ENST ID: ENST00000530991
  CDS Start-End: 824-2653
ttctgcctgcttcctgaggagtggggtctgagttcctctggggcgtaaggcacattcagacatctgtagaacaagtgtgggactcagtggcacccaggctcaatcctgctgctgagcagaggtgctggagtgagtcctgctctgcagcaggaaaatagggaaaggggtgcagagagggctgtgttctgagttccccagggacctgttcaccccacggattctgccaccaggattgagctaggactgacccggcccatggtgttactctattttagaaaatgtgtgtgttggaggggtgggggcaggagatacagcttgtggaaaggagtgccactcaacatcttcaagggcagggattctgttttggacttttctgagattttctggtaatgccaatacaatgcccgctgccagagattttagaactagtcctgagaagcaagaactcccctcacccccaccctttggcccagactccttccaagcctttcacacctcccctgtgtcacagcaggagagtttgttccaaaaggggagtgttgatggttctctttttgctgagatcagcggtagagggaatagacactacagtaggagagtcatcgaacagatcattactgaacacttcctccttgctaatcactgttccgttccgaggttgcctcagtgaacaacacaaaaccctgccctaaaagacttgttgaacggcatcgtaggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccag

SEQ ID NO: 187473 - DNA, 751 bp, Homo sapiens
  Payload ID: 16909
  Gene Symbol: ST5
  Gene Name: suppression of tumorigenicity 5
  ENST ID: ENST00000530959
  CDS Start-End: 333-751
acataatatccagtgcgtcctccctggcactccgattctcagtagtcatgaaccagctggcttctatatctctcaccaatcacagggtcttgctgtgttgctcgggctgctcttgaactcctgggctcaaacagtcctcttgcctcagcctcccaacgtgctgggattacgggagcaagccaccccactgtgtgcagcccagaagttgagcctgagaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgccatt

SEQ ID NO: 187474 - DNA, 776 bp, Homo sapiens
  Payload ID: 16909
  Gene Symbol: ST5
  Gene Name: suppression of tumorigenicity 5
  ENST ID: ENST00000526062
  CDS Start-End: 1-334
acctgcctcagtgtgcgccagctcatccgaatctttgcctcactgctgctggagcgccgggtcatttttgtggcagataagctcagctgcctctgagcacattccaggaccattctgggagggacgatcccaaggtcttgttcttggcctggccgggtattcaagttctgccaatctggggtcttggaaaagatgtccttcctgttctgcctggggtctgcctctggctggagaggggagggtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggctt

SEQ ID NO: 187475 - DNA, 580 bp, Homo sapiens
  Payload ID: 16909
  Gene Symbol: ST5
  Gene Name: suppression of tumorigenicity 5
  ENST ID: ENST00000525169
  CDS Start-End: 461-580
tccagacccagacaactcttggtcggatggtgaggagcccggccgcagcccggggcgcggatgcctgcccgccgcccgccctctctgcaggagcggctcctcctccgggccgcgcggctcccggcgagaccccatccaggcgccgcgcccggcccggctggggaacgcagagatttcacaccctttggagagtttctttcttggataattcagggtcttgctgtgttgctcgggctgctcttgaactcctgggctcaaacagtcctcttgcctcagcctcccaacgtgctgggattacgggagcaagccaccccactgtgtgcagcccagaagttgagcctgagaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccacca

SEQ ID NO: 187476 - DNA, 523 bp, Homo sapiens
  Payload ID: 16909
  Gene Symbol: ST5
  Gene Name: suppression of tumorigenicity 5
  ENST ID: ENST00000526241
  CDS Start-End: 98-523
gccgcgcccggcccggctggggaacgcagagatttcacaccctttggagagtttctttcttggataattcagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgccattcccgggg

SEQ ID NO: 187477 - DNA, 1352 bp, Homo sapiens
  Payload ID: 16909
  Gene Symbol: ST5
  Gene Name: suppression of tumorigenicity 5
  ENST ID: ENST00000534278
  CDS Start-End: 169-1155
gagcctggtacctggtgctgggagaccctgcagagctgaggcctgtcctgagagtggtggctgttccttcagggctctggttgcagagaggtttagaggaggcttaaagtcttcctccactagaagggcagtccttactcctccgttcccaaggaaaaggagccagaaatggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttt

SEQ ID NO: 187478 - DNA, 4545 bp, Homo sapiens
  Payload ID: 16909
  Gene Symbol: ST5
  Gene Name: suppression of tumorigenicity 5
  Uniprot ID: P78524
  ENST ID: ENST00000534127
  CDS Start-End: 387-3800
gggggtcgggggtcgggggctgggggctgaggactgagtcgagccagcagcccagggcatctgtccacgctgtcagaggagcctctgggcgtggggctggcccttagagggctactgcgctgcttaacttgcctttcacagaaaaccactggaggagatactcacaaaaatgaaggggaagaacaggaaacaggaagacatgagatgaaggaaacaggagattcaacatggatttcacaccctttggagagtttctttcttggataattcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgccattcccggggccagcagctggcccccggggcgtcttgctgacccgtaccggtacccgcgcccacagcctgggcatccgggagaagatatcagcatgggaaggtcgccgagaggcgtcgcccaggatgagcatgtgtggagagaagcgggagggctctgggagcgagtgggcggccagtgagggctgccccagcctgggctgtcccagcgtggtgccgtccccctgcagctctgaaaagacctttgatttcaagggcctccggaggatgagcaggaccttctccgagtgttcctacccagagactgaggaggagggagaggcgctccctgtccgggactctttctaccggctggagaaacggctgggccggagtgagcccagcgccttcctcagggggcatggcagcaggaaggagagctcagcagtgctgagccggatccagaaaattgaacaggtcctgaaggagcagccgggccgggggctcccccagctccccagcagctgctacagcgtggaccgggggaaaaggaagactggaaccttgggctccttggaggagccggcagggggcgcgagtgtgagcgctggcagccgggcagtcggagtggctggtgttgcgggggaggcgggcccacccccagagagggaaggcagtggttccactaagcccgggacccctggaaatagccctagctcccagcggctgccatcgaagagttccctcgatcccgctgtgaaccctgtccccaaacccaagcgcacctttgaatacgaggctgacaagaaccccaagagtaagcccagtaatggtctacctccttcacccacacctgctgctccacctcccttgccctccaccccagccccgccagtcacccggagacccaagaaggacatgcgtggtcaccgcaagtcccagagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccagag

SEQ ID NO: 187479 - DNA, 1309 bp, Homo sapiens
  Payload ID: 16909
  Gene Symbol: ST5
  Gene Name: suppression of tumorigenicity 5
  ENST ID: ENST00000533020
  CDS Start-End: 276-1309
gtagcctccccactgcagacgggcagctgcatgactcatgagctgaggggccaggcagaagccattctctttggttcacaggaattctgcttgtttatttgtgtgtgtgtgagttcgtgtgtttccttcttcccttctcccccttctctaactcttcctcctctgcaggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtgga

SEQ ID NO: 187480 - DNA, 560 bp, Homo sapiens
  Payload ID: 16909
  Gene Symbol: ST5
  Gene Name: suppression of tumorigenicity 5
  ENST ID: ENST00000528523
  CDS Start-End: 99-560
agtgctctgctcacttggctgcgaggagcgccacgaaaggtcagaggaaggagctgtgggaagctcgcagcagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgccattcccggggccagcagctggcccccggggcgtcttgctgacccgt

SEQ ID NO: 187481 - DNA, 1412 bp, Homo sapiens
  Payload ID: 16909
  Gene Symbol: ST5
  Gene Name: suppression of tumorigenicity 5
  ENST ID: ENST00000532734
  CDS Start-End: 4-1074
attatgacttcaaggaagaatggaggtggggcgcatagctggcaagaaaccccgtgggaacaaagaagggctctgggtttgcagagagccgaaatgaccatgactgccaacaagaattccagcatcacccacggagctggtggcactaaagcccctcgggggactctgagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaaggaatgtgctttctccagctcttcacgtggctgctggctccttctcatttctcaggctctgctcaagtaggacctctttcaggaggtctgtccagacacctgcatggagcccctcccctgcccagcttgctctgctggaccgacccaccaagcagatgcgagaggcagaggaaaggctcaaagccattccccagttttgcttccctgatgccaaggactggcttcctgtgtcagagtatagcagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcg

SEQ ID NO: 187482 - DNA, 452 bp, Homo sapiens
  Payload ID: 16909
  Gene Symbol: ST5
  Gene Name: suppression of tumorigenicity 5
  ENST ID: ENST00000531060
  CDS Start-End: 1-438
ggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaaggtaccctccccagaggcagcccactggagccgggcaggtgggcgggcaggcagccagcctttctctctctttcctggcttccttccttccctaatctggactgcttcctcgattccctttgaataaattctgggtccgtg

SEQ ID NO: 187483 - DNA, 822 bp, Homo sapiens
  Payload ID: 16909
  Gene Symbol: ST5
  Gene Name: suppression of tumorigenicity 5
  ENST ID: ENST00000533016
  CDS Start-End: 454-822
tattctaagccactaggccgtggtggcttctttgaaaggttgaagtcttgaaaggtaagaagaccccatctagctgggtttcatgtgctgccctcaccttacccctacaagtggcacagcaagctgcctgcgatgtctggtggttgactctgctgcctgcatggttcaggtgagcagagcagttcatgttgaagcccctcccaccggtcaggagcctgtaggactgtgttgttttccttcctgtgtcctcagtgactgggctagtgtcttgcacaaggcaggtgcttggtcattgtttgtggattgaatggcttctcagcctgagcttcaggggaccttggcctgggccttggagcatactaggagttggataagcagagaggaagaaggagagcactccaggctgccagtgatttgagcccagaaacatggggcagaaatggacacgtggacatgtttggagcagaaggtgtcctgcctggagagagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggac

SEQ ID NO: 187484 - DNA, 571 bp, Homo sapiens
  Payload ID: 16909
  Gene Symbol: ST5
  Gene Name: suppression of tumorigenicity 5
  ENST ID: ENST00000527510
  CDS Start-End: 159-571
aaggtcagaggaaggagctgtgggaagctcgcagcaggtatcggagcttaagccagtggatttgggggccctgggctccctagccggctgcggtgtgagaatggagtgggcaggaaagcagcgggactttcagggctctgggtttgcagagagccgaaatgaccatgactgccaacaagaattccagcatcacccacggagctggtggcactaaagcccctcgggggactctgagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagccagtccctgcgcagtgggaactggtcagaaaggaagagccacc

SEQ ID NO: 187485 - DNA, 556 bp, Homo sapiens
  Payload ID: 16909
  Gene Symbol: ST5
  Gene Name: suppression of tumorigenicity 5
  ENST ID: ENST00000533471
  CDS Start-End: 335-556
gtgtgtatgagaaaatgacataaagtttcagaccccgttgtgctttgctccagacccagacaactcttggtcggatggtgaggagcccggccgcagcccggggcgcggatgcctgcccgccgcccgccctctctgcaggagcggctcctcctccgggccgcgcggctcccggcgagaccccatccaggcgccgcgcccggcccggctggggaacgcagaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagct

SEQ ID NO: 187486 - DNA, 638 bp, Homo sapiens
  Payload ID: 16909
  Gene Symbol: ST5
  Gene Name: suppression of tumorigenicity 5
  ENST ID: ENST00000533681
  CDS Start-End: 206-638
gattactgtgctttgggattaaagtgtcctgccgtttctggaagagactgctagtcataaagacaggtagggctgaagggtggaggtagggtctccagctgcagttgtcaagaacccaacgtgaaggctgactgagcagagaaactgctgctgcccagaaagaaagcacttttagcagtgggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgccattcccggggccagcag

SEQ ID NO: 187487 - DNA, 590 bp, Homo sapiens
  Payload ID: 16909
  Gene Symbol: ST5
  Gene Name: suppression of tumorigenicity 5
  ENST ID: ENST00000530338
  CDS Start-End: 1-296
tggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagtcctctcacacctccctgatgccagacctctctttgttccagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctg

SEQ ID NO: 187488 - DNA, 3019 bp, Homo sapiens
  Payload ID: 16909
  Gene Symbol: ST5
  Gene Name: suppression of tumorigenicity 5
  Uniprot ID: P78524
  ENST ID: ENST00000526757
  CDS Start-End: 121-2274
tttcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccagag

SEQ ID NO: 187489 - DNA, 576 bp, Homo sapiens
  Payload ID: 16909
  Gene Symbol: ST5
  Gene Name: suppression of tumorigenicity 5
  ENST ID: ENST00000527392
  CDS Start-End: 417-576
agacccagacaactcttggtcggatggtgaggagcccggccgcagcccggggcgcggatgcctgcccgccgcccgccctctctgcaggagcggctcctcctccgggccgcgcggctcccggcgagaccccatccaggcgccgcgcccggcccggctggggaacgcagagggtcttgctgtgttgctcgggctgctcttgaactcctgggctcaaacagtcctcttgcctcagcctcccaacgtgctgggattacgggagcaagccaccccactgtgtgcagcccagaagttgagcctgagaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcag

SEQ ID NO: 187490 - DNA, 514 bp, Homo sapiens
  Payload ID: 16909
  Gene Symbol: ST5
  Gene Name: suppression of tumorigenicity 5
  ENST ID: ENST00000527473
  CDS Start-End: 265-514
aaacttagggggtctgccgtgtcccagggactgtgctcattttctgacaggagcaatattattaccgactgtgacagcagctcccactaagcctgcaccttagctgcagatccttagcagggcagagagacaaggctgtatttgtatcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccct

SEQ ID NO: 187491 - DNA, 583 bp, Homo sapiens
  Payload ID: 16909
  Gene Symbol: ST5
  Gene Name: suppression of tumorigenicity 5
  ENST ID: ENST00000533225
  CDS Start-End: 356-583
gtcacataatatccagtgcgtcctccctggcactccgattctcagtagtcatgaaccagctggcttctatatctctcaccaatcacaggtaatttaggtctccctcagggtcttgctgtgttgctcgggctgctcttgaactcctgggctcaaacagtcctcttgcctcagcctcccaacgtgctgggattacgggagcaagccaccccactgtgtgcagcccagaagttgagcctgagaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgccc

SEQ ID NO: 187492 - DNA, 550 bp, Homo sapiens
  Payload ID: 16909
  Gene Symbol: ST5
  Gene Name: suppression of tumorigenicity 5
  ENST ID: ENST00000526828
  CDS Start-End: 394-550
gttgacactctgaatggtttgtgaaggcatcctctggcccctgaaggcattaccatccttaccaggtttaaaatctttcagagtgcacccagcatcatcagctcctgcaagcagaaagggcccaagggagcatgaacacacactggggtcttgctgtgttgctcgggctgctcttgaactcctgggctcaaacagtcctcttgcctcagcctcccaacgtgctgggattacgggagcaagccaccccactgtgtgcagcccagaagttgagcctgagaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacct

SEQ ID NO: 187493 - DNA, 590 bp, Homo sapiens
  Payload ID: 16909
  Gene Symbol: ST5
  Gene Name: suppression of tumorigenicity 5
  ENST ID: ENST00000524757
  CDS Start-End: 419-590
agacccagacaactcttggtcggatggtgaggagcccggccgcagcccggggcgcggatgcctgcccgccgcccgccctctctgcaggagcggctcctcctccgggccgcgcggctcccggcgagaccccatccaggcgccgcgcccggcccggctggggaacgcagagggatggtgacagaatggatagtatagaaaatggattggaattgaggaggaaactagaagctaagaggagttaggaggcccttgtaacaatccagatttcacaccctttggagagtttctttcttggataattcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtacc

SEQ ID NO: 187494 - DNA, 299 bp, Homo sapiens
  Payload ID: 16909
  Gene Symbol: ST5
  Gene Name: suppression of tumorigenicity 5
  ENST ID: ENST00000531578
  CDS Start-End: 220-299
acataatatccagtgcgtcctccctggcactccgattctcagtagtcatgaaccagctggcttctatatctctcaccaatcacaggtaatttaggtctccctcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcag

SEQ ID NO: 187495 - DNA, 659 bp, Homo sapiens
  Payload ID: 16909
  Gene Symbol: ST5
  Gene Name: suppression of tumorigenicity 5
  ENST ID: ENST00000534665
  CDS Start-End: 570-659
agacccagacaactcttggtcggatggtgaggaggtgagggccgtccagtttgggggccaacttctcctccctgctgcccccggcccccgcctccctcacccctgtcccccaccctccctcgcacactctcggcgcggctttctcgctgcctccggcgcctccgagcgctcccctccgccgggctccagcagcccaccctctctgtcttgggtggaggcgcacatcctccacgccccctccactcaaatctgcgctccctcccctctctctccctgcagcccggccgcagcccggggcgcggatgcctgcccgccgcccgccctctctgcaggagcggctcctcctccgggccgcgcggctcccggcgagaccccatccaggcgccgcgcccggcccggctggggaacgcagagatttcacaccctttggagagtttctttcttggataattcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtca

SEQ ID NO: 187496 - DNA, 502 bp, Homo sapiens
  Payload ID: 16909
  Gene Symbol: ST5
  Gene Name: suppression of tumorigenicity 5
  ENST ID: ENST00000531093
  CDS Start-End: 272-502
gggccatgagggctccaccctcatgaatggattaatgctgtcattgctagagtttgtttctgataaaaacaagtccggccccctcctgccctctctctcttttgtgtgtactgttgtgcccttctgcctttctgctatgggatgatgcaggaagaaggcccgcaccagattcagccatcaatcttaagacttccaagcctctggaaccgtaagaaataaatcctcacttcattagcataaattcagggctctgggtttgcagagagccgaaatgaccatgactgccaacaagaattccagcatcacccacggagctggtggcactaaagcccctcgggggactctgagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaag

SEQ ID NO: 187497 - DNA, 534 bp, Homo sapiens
  Payload ID: 16909
  Gene Symbol: ST5
  Gene Name: suppression of tumorigenicity 5
  ENST ID: ENST00000530938
  CDS Start-End: 313-534
gatgcctgcccgccgcccgccctctctgcaggagcggctcctcctccgggccgcgcggctcccggcgagaccccatccaggcgccgcgcccggcccggctggggaacgcagagatttcacaccctttggagagtttctttcttggataattcagggtcttgctgtgttgctcgggctgctcttgaactcctgggctcaaacagtcctcttgcctcagcctcccaacgtgctgggattacgggagcaagccaccccactgtgtgcagcccagaagttgagcctgagagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagct

SEQ ID NO: 187498 - DNA, 559 bp, Homo sapiens
  Payload ID: 16909
  Gene Symbol: ST5
  Gene Name: suppression of tumorigenicity 5
  ENST ID: ENST00000526126
  CDS Start-End: 343-559
tcccggcgagaccccatccaggcgccgcgcccggcccggctggggaacgcagagatttcacaccctttggagagtttctttcttggataattcagggtcttgctgtgttgctcgggctgctcttgaactcctgggctcaaacagtcctcttgcctcagcctcccaacgtgctgggattacgggagcaagccaccccactgtgtgcagcccagaagttgagcctgagaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcagaaaatcctttgagtttgaggatgcatccagtctccagtccctgtacccctcttctcccactgagaatggtactgagaaccaacccaagtttggatccaaaagcactttagaagaaaatgcctatgaagatattgtgg

SEQ ID NO: 187499 - DNA, 2679 bp, Homo sapiens
  Payload ID: 16909
  Gene Symbol: ST5
  Gene Name: suppression of tumorigenicity 5
  Uniprot ID: P78524
  ENST ID: ENST00000530438
  CDS Start-End: 526-2679
gaagaaaacaagtccactcactgtcttctcccttctcccctctgagctgttcaagcaagttcccaggagcagttcagagcccctgttggactggaagggaggtaggaggagtggaatgcatgcaaaaaccgagctgatcaaaagacagtgctgtttcatggaagcctcccagaactgagagagagagagagagagagagagagagagagacagtgagaaagaaagaaaaagagagcgcccttgtgcacgcgctaggccaagagcgcgccgctgtgcgcgcgcccgcctagcgaggacagggtctccatgacaaccggcctggccggctagcagtgctctgctcacttggctgcgaggagcgccacgaaaggtcagaggaaggagctgtgggaagctcgcagcaggtatcggagcttaagccagtggatttgggggccctgggctccctagccggctgcggtgtgagaatggagtgggcaggaaagcagcgggactttcagggctctgggtttgcagagagccgaaatgaccatgactgccaacaagaattccagcatcacccacggagctggtggcactaaagcccctcgggggactctgagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaa

SEQ ID NO: 187500 - DNA, 2404 bp, Homo sapiens
  Payload ID: 16909
  Gene Symbol: ST5
  Gene Name: suppression of tumorigenicity 5
  ENST ID: ENST00000526099
  CDS Start-End: 104-2056
gtgaacaacacaaaaccctgccctaaaagacttgttgaacggcatcgtaggtgagaagggggcctggcgaagccctgctccctacggttctgtgagttcctccatgcccaccctccaaagagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatctt

SEQ ID NO: 187501 - DNA, 600 bp, Homo sapiens
  Payload ID: 16909
  Gene Symbol: ST5
  Gene Name: suppression of tumorigenicity 5
  ENST ID: ENST00000526057
  CDS Start-End: 460-600
agcccggggcgcggatgcctgcccgccgcccgccctctctgcaggagcggctcctcctccgggccgcgcggctcccggcgagaccccatccaggcgccgcgcccggcccggctggggaacgcagaggaagatgagagactgcttaggcgccaccactagtaccatgagtccctgcactggttaaagccatcgccacaacctggacaggcagcaagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccat

SEQ ID NO: 187502 - DNA, 862 bp, Homo sapiens
  Payload ID: 16909
  Gene Symbol: ST5
  Gene Name: suppression of tumorigenicity 5
  ENST ID: ENST00000530593
  CDS Start-End: 210-862
agtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcag

SEQ ID NO: 187503 - DNA, 1071 bp, Homo sapiens
  Payload ID: 16909
  Gene Symbol: ST5
  Gene Name: suppression of tumorigenicity 5
  ENST ID: ENST00000626808
  CDS Start-End: 1-1071
atgacttcaaggaagaatggaggtggggcgcatagctggcaagaaaccccgtgggaacaaagaagggctctgggtttgcagagagccgaaatgaccatgactgccaacaagaattccagcatcacccacggagctggtggcactaaagcccctcgggggactctgagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaaggaatgtgctttctccagctcttcacgtggctgctggctccttctcatttctcaggctctgctcaagtag

SEQ ID NO: 187504 - DNA, 2899 bp, Homo sapiens
  Payload ID: 16910
  Gene Symbol: ST7
  Gene Name: suppression of tumorigenicity 7
  Uniprot ID: Q9NRC1
  ENST ID: ENST00000265437
  CDS Start-End: 215-1972
gggacctttagagagttagcaataaggctggagaaggaaaagccggcgcgcccgcggcccgcgcgatttcccgccgagcccgcgtccccggcggcgggcgggctccgggggcgcccgggccgcggcggcggcggcggcgcgagctgcgcctccgggccggtgaatcatcccggcagacaccaagagccgcggcagcagagaggagcgctgaaacatggctgaagcggccacgggctttctggagcagctcaagtcctgcatagtttggtcttggacgtatctgtggaccgtgtggttcttcatcgtgctattcctggtctacatcctgcgggtgcctttgaaaatcaacgacaacttgagcacagtgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgcagaaagcctggagagagagaaacccccaagctaggatttctgcagctcatgaagccttggagataaatgaaattaggtccagagttgaagttcccctaattgcttcctctaccatctgggagataaaattgttaccaaagtgtgcaactgcttatattctcttggctgaagaggaagcaacaaccattgctgaagcagaaaaattatttaagcaggccctgaaggctggagatggctgttaccgacgctctcagcagctacaacatcatggatcccagtatgaagcccaacatagacgagacaccaatgtcttggtgtacatcaaaagaaggctagcaatgtgtgccagaagactcgggaggaccagggaagcagtgaaaatgatgagagatttaatgaaggagttcccccttctgagtatgttcaatatccatgaaaaccttttagaagcccttctggaactacaagcatatgctgatgttcaggcagtcttagcaaagtatgatgatataagcttaccaaagtcagcaacaatatgctacacagctgctttgctcaaagcaagagctgtctctgacaaattctctcctgaggctgcatctcggcgggggctgagcacagcagagatgaatgcagtagaggccattcatagagctgtggaattcaatcctcatgtgccaaaatacctactagaaatgaaaagcttaatcctacccccagaacatatcctgaagagaggagacagtgaagcaatagcatatgcattctttcatcttgcacactggaagagagtggaaggggctttgaatcttttgcattgtacgtgggaaggcacttttcggatgatcccttatcccttggaaaaggggcacctattttatccttacccaatctgtacagaaacagcagaccgagagctgcttccatctttccatgaagtctcagtttacccaaagaaggagcttcccttctttattctctttactgctggattatgttccttcacagccatgctggccctcctgacacatcagttcccggaacttatgggggtcttcgcaaaagctatgattgacattttctgctcggcagagttcagggactggaattgcaagagtattttcatgcgtgttgaagatgaactggaaatccctccggcacctcaatctcaacatttccaaaactgaactcatcacccctcttcccccaccaccaaaactgctcctcctcctgtattcctgacctccgccatccaccccgttgctcaagccggaaactcggcagcccttccaaactcttccctctctcactccccacatcccatcgtctcggccttcacaatctgtcagttctaacctcctaagcaactaggccttcagtaaatgtgattcacctcttctttccctccttttcccaaagcatccctcttagtctaggtccttgttgtttcttgcctgaactcctgccatagtcttaactggtctccttgcttcctgtcttatcctccaccgtctttcttttatactgacacaagaatggtctttctgaattgcacatgtgagcatgtcacttccctgcttaaatttctccagtggattcccagggacttcaggatcaagtcctagttgttcagcatggcatccaagactctttatgatctggcccttgcttacctctcagccttagctctcccaactcttgcacagtcactgctcttcagccatagtggatcactcaccattcccagatgtaccaggctctcgcacacctctgcacctttgcacgtgctgtttgctgtgcgtggaatgcccttcactgtcaccaccctgctcatccactctactaatgcctcttcattcttttatactcagctttctttaaagttcttctaagctgagttaggtgtctgtcctttatgatcccgcagtattccatgaatacgtatattctcacatttattgtactgtattataattgttgaaaacttgtctgtcccatttagaatgtgagctccttgagagcagaacggtgtcttcattatctctgtatccccaaggctttgcacagtgccttgctcatagtaggttttcaataaatgattattaaataaataa

SEQ ID NO: 187505 - DNA, 2142 bp, Homo sapiens
  Payload ID: 16910
  Gene Symbol: ST7
  Gene Name: suppression of tumorigenicity 7
  ENST ID: ENST00000323984
  CDS Start-End: 163-1896
cgcggcccgcgcgatttcccgccgagcccgcgtccccggcggcgggcgggctccgggggcgcccgggccgcggcggcggcggcggcgcgagctgcgcctccgggccggtgaatcatcccggcagacaccaagagccgcggcagcagagaggagcgctgaaacatggctgaagcggccacgggctttctggagcagctcaagtcctgcatagtttggtcttggacgtatctgtggaccgtgtggttcttcatcgtgctattcctggtctacatcctgcgggtgcctttgaaaatcaacgacaacttgagcacagtgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgcagaaagcctggagagagagaaacccccaagctaggatttctgcagctcatgaagccttggagataaatgaaattaggtccagagttgaagttcccctaattgcttcctctaccatctgggagataaaattgttaccaaagtgtgcaactgcttatattctcttggctgaagaggaagcaacaaccattgctgaagcagaaaaattatttaagcaggccctgaaggctggagatggctgttaccgacgctctcagcagctacaacatcatggatcccagtatgaagcccaacatagacgagacaccaatgtcttggtgtacatcaaaagaaggctagcaatgtgtgccagaagactcgggaggaccagggaagcagtgaaaatgatgagagatttaatgaaggagttcccccttctgagtatgttcaatatccatgaaaaccttttagaagcccttctggaactacaagcatatgctgatgttcaggcagtcttagcaaagtatgatgatataagcttaccaaagtcagcaacaatatgctacacagctgctttgctcaaagcaagagctgtctctgacaaattctctcctgaggctgcatctcggcgggggctgagcacagcagagatgaatgcagtagaggccattcatagagctgtggaattcaatcctcatgtgccaaaatacctactagaaatgaaaagcttaatcctacccccagaacatatcctgaagagaggagacagtgaagcaatagcatatgcattctttcatcttgcacactggaagagagtggaaggggctttgaatcttttgcattgtacgtgggaaggcacttttcggatgatcccttatcccttggaaaaggggcacctattttatccttacccaatctgtacagaaacagcagaccgagagctgcttccatctttccatgaagtctcagtttacccaaagaaggagcttcccttctttattctctttactgctggattatgttccttcacagccatgctggccctcctgacacatcagttcccggaacttatgggggtcttcgcaaaagctttcctcagcactttgtttgcccccttaaactttgtcatggagaaagtggagagcatcctcccatccagtctgtggcaccagctaacacggatctgagagaagccctgtcctccactcacctcacccgccgctgccaccatctcctctgtgccaactccttgtggaccgcaagaaagcatgactttgaaaaagggaagccattccgagattttaaaatgttcatggactattccatattaaaagctgtttttgttgtacaaaattcactgatgttcagttctattttattttgccttcagaaaagaagaaagtcaaaaataaaacttttgtgtattacagcaa

SEQ ID NO: 187506 - DNA, 2360 bp, Homo sapiens
  Payload ID: 16910
  Gene Symbol: ST7
  Gene Name: suppression of tumorigenicity 7
  Uniprot ID: Q9NRC1
  ENST ID: ENST00000393443
  CDS Start-End: 615-2114
gtcttactgctacagcagggctggggattgcagtatccgctgttgctgctgctcccagtcctgcccctgctgctacctagtccagcctcaccgcatcccagaagaggcacgtcggccttcatttgcctagtggattttcaaaagcagctcttcggtttttggtgctgttaagagaccttgcatttcaatcacaccgggagaaaactgaagctcgtaacaggagaatctggcagctggacacagcttggactgcattgtctggcttcatgacccctgctgtgtagccggctcatctcttcactctcacatgtacactctcctcgcttttctttcttttttttttcccttttctttcttctaatttttaaaaagcagcctctggagccagccatgtttggcactgaatcttcatagaaaaatatttgttgaatgagtgaacgtgggatctctgttcattttggtatattactttgctttctgggctgagctcaggacagatgccaaagcctttccctctaatgacatcaaagccctacttctaaaaccagactggatgtgattcccttctacaaacagattcagtaaagaaatgtgaatactcccacaaaaagcccatgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgcagaaagcctggagagagagaaacccccaagctaggatttctgcagctcatgaagccttggagataaatgagtgtgcaactgcttatattctcttggctgaagaggaagcaacaaccattgctgaagcagaaaaattatttaagcaggccctgaaggctggagatggctgttaccgacgctctcagcagctacaacatcatggatcccagtatgaagcccaacatagacgagacaccaatgtcttggtgtacatcaaaagaaggctagcaatgtgtgccagaagactcgggaggaccagggaagcagtgaaaatgatgagagatttaatgaaggagttcccccttctgagtatgttcaatatccatgaaaaccttttagaagcccttctggaactacaagcatatgctgatgttcaggcagtcttagcaaagtatgatgatataagcttaccaaagtcagcaacaatatgctacacagctgctttgctcaaagcaagagctgtctctgacaaattctctcctgaggctgcatctcggcgggggctgagcacagcagagatgaatgcagtagaggccattcatagagctgtggaattcaatcctcatgtgccaaaatacctactagaaatgaaaagcttaatcctacccccagaacatatcctgaagagaggagacagtgaagcaatagcatatgcattctttcatcttgcacactggaagagagtggaaggggctttgaatcttttgcattcttttcggatgatcccttatcccttggaaaaggggcacctattttatccttacccaatctgtacagaaacagcagaccgagagctgcttccatctttccatgaagtctcagtttacccaaagaaggagcttcccttctttattctctttactgctggattatgttccttcacagccatgctggccctcctgacacatcagttcccggaacttatgggggtcttcgcaaaagctttcctcagcactttgtttgcccccttaaactttgtcatggagaaagtggagagcatcctcccatccagtctgtggcaccagctaacacggatctgagagaagccctgtcctccactcacctcacccgccgctgccaccatctcctctgtgccaactccttgtggaccgcaagaaagcatgactttgaaaaagggaagccattccgagattttaaaatgttcatggactattccatattaaaagctgtttttgttgtacaaaattcactgatgttcagttctattttattttgccttcagaaaagaagaaagtcaaaaataaaacttttgtgtattacagcaa

SEQ ID NO: 187507 - DNA, 2113 bp, Homo sapiens
  Payload ID: 16910
  Gene Symbol: ST7
  Gene Name: suppression of tumorigenicity 7
  ENST ID: ENST00000393444
  CDS Start-End: 332-1867
cctgcccctgctgctacctagtccagcctcaccgcatcccagaagaggcacgtcggccttcatttgcctagtggattttcaaaagcagctcttcggtttttggtgctgttaagagaccttgcatttcaatcacaccgggagaaaactgaagctcgtaacaggagaatctggcagctggacacagcttggactgcattgtctggcttcatgacccctgctgtgtagccggctcatctcttcactctcacatgtacactctcctcgcttttctttcttttttttttcccttttctttcttctaatttttaaaaagcagcctctggagccagccatgtttggcactgaatcttcattgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgcagaaagcctggagagagagaaacccccaagctaggatttctgcagctcatgaagccttggagataaatgagtgtgcaactgcttatattctcttggctgaagaggaagcaacaaccattgctgaagcagaaaaattatttaagcaggccctgaaggctggagatggctgttaccgacgctctcagcagctacaacatcatggatcccagtatgaagcccaacatagacgagacaccaatgtcttggtgtacatcaaaagaaggctagcaatgtgtgccagaagactcgggaggaccagggaagcagtgaaaatgatgagagatttaatgaaggagttcccccttctgagtatgttcaatatccatgaaaaccttttagaagcccttctggaactacaagcatatgctgatgttcaggcagtcttagcaaagtatgatgatataagcttaccaaagtcagcaacaatatgctacacagctgctttgctcaaagcaagagctgtctctgacaaattctctcctgaggctgcatctcggcgggggctgagcacagcagagatgaatgcagtagaggccattcatagagctgtggaattcaatcctcatgtgccaaaatacctactagaaatgaaaagcttaatcctacccccagaacatatcctgaagagaggagacagtgaagcaatagcatatgcattctttcatcttgcacactggaagagagtggaaggggctttgaatcttttgcattgtacgtgggaaggcacttttcggatgatcccttatcccttggaaaaggggcacctattttatccttacccaatctgtacagaaacagcagaccgagagctgcttccatctttccatgaagtctcagtttacccaaagaaggagcttcccttctttattctctttactgctggattatgttccttcacagccatgctggccctcctgacacatcagttcccggaacttatgggggtcttcgcaaaagctttcctcagcactttgtttgcccccttaaactttgtcatggagaaagtggagagcatcctcccatccagtctgtggcaccagctaacacggatctgagagaagccctgtcctccactcacctcacccgccgctgccaccatctcctctgtgccaactccttgtggaccgcaagaaagcatgactttgaaaaagggaagccattccgagattttaaaatgttcatggactattccatattaaaagctgtttttgttgtacaaaattcactgatgttcagttctattttattttgccttcagaaaagaagaaagtcaaaaataaaacttttgtgtattacagcaa

SEQ ID NO: 187508 - DNA, 2114 bp, Homo sapiens
  Payload ID: 16910
  Gene Symbol: ST7
  Gene Name: suppression of tumorigenicity 7
  ENST ID: ENST00000393446
  CDS Start-End: 304-1875
tctttctaaatattagcataataaatataaatggacccagaacgcgagggggcaggggccacgtgatcgctccacgaaagccacttgtagggacctttagagagttagcaataaggctggagaaggaaaagccggcgcgcccgcggcccgcgcgatttcccgccgagcccgcgtccccggcggcgggcgggctccgggggcgcccgggccgcggcggcggcggcggcgcgagctgcgcctccgggccggtgaatcatcccggcagacaccaagagccgcggcagcagagaggagcgctgaaacatggctgaagcggccacgggctttctggagcagctcaagtcctgcatagtttggtcttggacgtatctgtggaccgtgtggttcttcatcgtgctattcctggtctacatcctgcgggtgcctttgaaaatcaacgacaacttgagcacagtgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgcagaaagcctggagagagagaaacccccaagctaggatttctgcagctcatgaagccttggagataaatgagtgtgcaactgcttatattctcttggctgaagaggaagcaacaaccattgctgaagcagaaaaattatttaagcaggccctgaaggctggagatggctgttaccgacgctctcagcagctacaacatcatggatcccagtatgaagcccaacatagacgagacaccaatgtcttggtgtacatcaaaagaaggctagcaatgtgtgccagaagactcgggaggaccagggaagcagtgaaaatgatgagagatttaatgaaggagttcccccttctgagtatgttcaatatccatgaaaaccttttagaagcccttctggaactacaagcatatgctgatgttcaggcagtcttagcaaagtatgatgatataagcttaccaaagtcagcaacaatatgctacacagctgctttgctcaaagcaagagctgtctctgacaaattctctcctgaggctgcatctcggcgggggctgagcacagcagagatgaatgcagtagaggccattcatagagctgtggaattcaatcctcatgtgccaaaatacctactagaaatgaaaagcttaatcctacccccagaacatatcctgaagagaggagacagtgaagcaatagcatatgcattctttcatcttgcacactggaagagagtggaaggggctttgaatcttttgcattgtacgtgggaaggcactttccatgaagtctcagtttacccaaagaaggagcttcccttctttattctctttactgctggattatgttccttcacagccatgctggccctcctgacacatcagttcccggaacttatgggggtcttcgcaaaagctttcctcagcactttgtttgcccccttaaactttgtcatggagaaagtggagagcatcctcccatccagtctgtggcaccagctaacacggatctgagagaagccctgtcctccactcacctcacccgccgctgccaccatctcctctgtgccaactccttgtggaccgcaagaaagcatgactttgaaaaagggaagccattccgagattttaaaatgttcatggactattccatattaaaagctgtttttgttgtacaaaattcactgatgttcagttctattttattttgccttcagaaaagaagaaagtcaaaaataaaacttttgtgtatt

SEQ ID NO: 187509 - DNA, 2182 bp, Homo sapiens
  Payload ID: 16910
  Gene Symbol: ST7
  Gene Name: suppression of tumorigenicity 7
  ENST ID: ENST00000393447
  CDS Start-End: 332-1936
cctgcccctgctgctacctagtccagcctcaccgcatcccagaagaggcacgtcggccttcatttgcctagtggattttcaaaagcagctcttcggtttttggtgctgttaagagaccttgcatttcaatcacaccgggagaaaactgaagctcgtaacaggagaatctggcagctggacacagcttggactgcattgtctggcttcatgacccctgctgtgtagccggctcatctcttcactctcacatgtacactctcctcgcttttctttcttttttttttcccttttctttcttctaatttttaaaaagcagcctctggagccagccatgtttggcactgaatcttcattgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgcagaaagcctggagagagagaaacccccaagctaggatttctgcagctcatgaagccttggagataaatgaaattaggtccagagttgaagttcccctaattgcttcctctaccatctgggagataaaattgttaccaaagtgtgcaactgcttatattctcttggctgaagaggaagcaacaaccattgctgaagcagaaaaattatttaagcaggccctgaaggctggagatggctgttaccgacgctctcagcagctacaacatcatggatcccagtatgaagcccaacatagacgagacaccaatgtcttggtgtacatcaaaagaaggctagcaatgtgtgccagaagactcgggaggaccagggaagcagtgaaaatgatgagagatttaatgaaggagttcccccttctgagtatgttcaatatccatgaaaaccttttagaagcccttctggaactacaagcatatgctgatgttcaggcagtcttagcaaagtatgatgatataagcttaccaaagtcagcaacaatatgctacacagctgctttgctcaaagcaagagctgtctctgacaaattctctcctgaggctgcatctcggcgggggctgagcacagcagagatgaatgcagtagaggccattcatagagctgtggaattcaatcctcatgtgccaaaatacctactagaaatgaaaagcttaatcctacccccagaacatatcctgaagagaggagacagtgaagcaatagcatatgcattctttcatcttgcacactggaagagagtggaaggggctttgaatcttttgcattgtacgtgggaaggcacttttcggatgatcccttatcccttggaaaaggggcacctattttatccttacccaatctgtacagaaacagcagaccgagagctgcttccatctttccatgaagtctcagtttacccaaagaaggagcttcccttctttattctctttactgctggattatgttccttcacagccatgctggccctcctgacacatcagttcccggaacttatgggggtcttcgcaaaagctttcctcagcactttgtttgcccccttaaactttgtcatggagaaagtggagagcatcctcccatccagtctgtggcaccagctaacacggatctgagagaagccctgtcctccactcacctcacccgccgctgccaccatctcctctgtgccaactccttgtggaccgcaagaaagcatgactttgaaaaagggaagccattccgagattttaaaatgttcatggactattccatattaaaagctgtttttgttgtacaaaattcactgatgttcagttctattttattttgccttcagaaaagaagaaagtcaaaaataaaacttttgtgtattacagcaa

SEQ ID NO: 187510 - DNA, 2127 bp, Homo sapiens
  Payload ID: 16910
  Gene Symbol: ST7
  Gene Name: suppression of tumorigenicity 7
  ENST ID: ENST00000393449
  CDS Start-End: 163-1881
cgcggcccgcgcgatttcccgccgagcccgcgtccccggcggcgggcgggctccgggggcgcccgggccgcggcggcggcggcggcgcgagctgcgcctccgggccggtgaatcatcccggcagacaccaagagccgcggcagcagagaggagcgctgaaacatggctgaagcggccacgggctttctggagcagctcaagtcctgcatagtttggtcttggacgtatctgtggaccgtgtggttcttcatcgtgctattcctggtctacatcctgcgggtgcctttgaaaatcaacgacaacttgagcacagtgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgcagaaagcctggagagagagaaacccccaagctaggatttctgcagctcatgaagccttggagataaatgaaattaggtccagagttgaagttcccctaattgcttcctctaccatctgggagataaaattgttaccaaagtgtgcaactgcttatattctcttggctgaagaggaagcaacaaccattgctgaagcagaaaaattatttaagcaggccctgaaggctggagatggctgttaccgacgctctcagcagctacaacatcatggatcccagtatgaagcccaacatagacgagacaccaatgtcttggtgtacatcaaaagaaggctagcaatgtgtgccagaagactcgggaggaccagggaagcagtgaaaatgatgagagatttaatgaaggagttcccccttctgagtatgttcaatatccatgaaaaccttttagaagcccttctggaactacaagcatatgctgatgttcaggcagtcttagcaaagtatgatgatataagcttaccaaagtcagcaacaatatgctacacagctgctttgctcaaagcaagagctgtctctgacaaattctctcctgaggctgcatctcggcgggggctgagcacagcagagatgaatgcagtagaggccattcatagagctgtggaattcaatcctcatgtgccaaaatacctactagaaatgaaaagcttaatcctacccccagaacatatcctgaagagaggagacagtgaagcaatagcatatgcattctttcatcttgcacactggaagagagtggaaggggctttgaatcttttgcattcttttcggatgatcccttatcccttggaaaaggggcacctattttatccttacccaatctgtacagaaacagcagaccgagagctgcttccatctttccatgaagtctcagtttacccaaagaaggagcttcccttctttattctctttactgctggattatgttccttcacagccatgctggccctcctgacacatcagttcccggaacttatgggggtcttcgcaaaagctttcctcagcactttgtttgcccccttaaactttgtcatggagaaagtggagagcatcctcccatccagtctgtggcaccagctaacacggatctgagagaagccctgtcctccactcacctcacccgccgctgccaccatctcctctgtgccaactccttgtggaccgcaagaaagcatgactttgaaaaagggaagccattccgagattttaaaatgttcatggactattccatattaaaagctgtttttgttgtacaaaattcactgatgttcagttctattttattttgccttcagaaaagaagaaagtcaaaaataaaacttttgtgtattacagcaa

SEQ ID NO: 187511 - DNA, 2110 bp, Homo sapiens
  Payload ID: 16910
  Gene Symbol: ST7
  Gene Name: suppression of tumorigenicity 7
  Uniprot ID: Q9NRC1
  ENST ID: ENST00000393451
  CDS Start-End: 200-1864
ttagcaataaggctggagaaggaaaagccggcgcgcccgcggcccgcgcgatttcccgccgagcccgcgtccccggcggcgggcgggctccgggggcgcccgggccgcggcggcggcggcggcgcgagctgcgcctccgggccggtgaatcatcccggcagacaccaagagccgcggcagcagagaggagcgctgaaacatggctgaagcggccacgggctttctggagcagctcaagtcctgcatagtttggtcttggacgtatctgtggaccgtgtggttcttcatcgtgctattcctggtctacatcctgcgggtgcctttgaaaatcaacgacaacttgagcacagtgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgcagaaagcctggagagagagaaacccccaagctaggatttctgcagctcatgaagccttggagataaatgagtgtgcaactgcttatattctcttggctgaagaggaagcaacaaccattgctgaagcagaaaaattatttaagcaggccctgaaggctggagatggctgttaccgacgctctcagcagctacaacatcatggatcccagtatgaagcccaacatagacgagacaccaatgtcttggtgtacatcaaaagaaggctagcaatgtgtgccagaagactcgggaggaccagggaagcagtgaaaatgatgagagatttaatgaaggagttcccccttctgagtatgttcaatatccatgaaaaccttttagaagcccttctggaactacaagcatatgctgatgttcaggcagtcttagcaaagtatgatgatataagcttaccaaagtcagcaacaatatgctacacagctgctttgctcaaagcaagagctgtctctgacaaattctctcctgaggctgcatctcggcgggggctgagcacagcagagatgaatgcagtagaggccattcatagagctgtggaattcaatcctcatgtgccaaaatacctactagaaatgaaaagcttaatcctacccccagaacatatcctgaagagaggagacagtgaagcaatagcatatgcattctttcatcttgcacactggaagagagtggaaggggctttgaatcttttgcattgtacgtgggaaggcacttttcggatgatcccttatcccttggaaaaggggcacctattttatccttacccaatctgtacagaaacagcagaccgagagctgcttccatctttccatgaagtctcagtttacccaaagaaggagcttcccttctttattctctttactgctggattatgttccttcacagccatgctggccctcctgacacatcagttcccggaacttatgggggtcttcgcaaaagctttcctcagcactttgtttgcccccttaaactttgtcatggagaaagtggagagcatcctcccatccagtctgtggcaccagctaacacggatctgagagaagccctgtcctccactcacctcacccgccgctgccaccatctcctctgtgccaactccttgtggaccgcaagaaagcatgactttgaaaaagggaagccattccgagattttaaaatgttcatggactattccatattaaaagctgtttttgttgtacaaaattcactgatgttcagttctattttattttgccttcagaaaagaagaaagtcaaaaataaaacttttgtgtattacagcaa

SEQ ID NO: 187512 - DNA, 549 bp, Homo sapiens
  Payload ID: 16910
  Gene Symbol: ST7
  Gene Name: suppression of tumorigenicity 7
  ENST ID: ENST00000420755
  CDS Start-End: 134-549
gtatgcgagcaaacaaggtaggaactggagtgcatgagcgctggagtcagctggccacttgggcactggcaggatcaaactccactcagacccactgccttccaccccttgtgggagggagcacccagtgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgca

SEQ ID NO: 187513 - DNA, 1005 bp, Homo sapiens
  Payload ID: 16910
  Gene Symbol: ST7
  Gene Name: suppression of tumorigenicity 7
  ENST ID: ENST00000438863
  CDS Start-End: 195-353
aataaggctggagaaggaaaagccggcgcgcccgcggcccgcgcgatttcccgccgagcccgcgtccccggcggcgggcgggctccgggggcgcccgggccgcggcggcggcggcggcgcgagctgcgcctccgggccggtgaatcatcccggcagacaccaagagccgcggcagcagagaggagcgctgaaacatggctgaagcggccacgggctttctggagcagctcaagtcctgcatagtttggtcttggacgtatctgtggaccgtgtggttcttcatcgtgctattcctggtctacatcctgcgggtgcctttgaaaatcaacgacaacttgagcacagatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgcagaaagcctggagagagagaaacccccaagctaggatttctgcagctcatgaagccttggagataaatgagtgtgcaactgcttatattctcttggctgaagaggaagcaacaaccattgctgaagcagaaaaattatttaagcaggccctgaaggctggagatggctgttaccgacgctctcagcagctacaacatcatggatcccagtatgaagcccaacatagacgagacaccaatgtcttggtgtacatcaaaagaaggctagcaatgtgtgccagaagactcgggaggaccagggaagcagtgaaaatgatgagagat

SEQ ID NO: 187514 - DNA, 577 bp, Homo sapiens
  Payload ID: 16910
  Gene Symbol: ST7
  Gene Name: suppression of tumorigenicity 7
  ENST ID: ENST00000417919
  CDS Start-End: 392-577
acaccaagagccgcggcagcagagaggagcgctgaaacatggctgaagcggccacgggctttctggagcagctcaagtcctgcatagtttggtcttggacgtatctgtggaccgtgtggttcttcatcgtgctattcctggtctacatcctgcgggtgcctttgaaaatcaacgacaacttgagcacagagaaaaatatttgttgaatgagtgaacgtgggatctctgttcattttggtatattactttgctttctgggctgagctcaggacagatgccaaagcctttccctctaatgacatcaaagccctacttctaaaaccagactggatgtgattcccttctacaaacagattcagtaaagaaatgtgaatactcccacaaaaagcccatgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactct

SEQ ID NO: 187515 - DNA, 805 bp, Homo sapiens
  Payload ID: 16910
  Gene Symbol: ST7
  Gene Name: suppression of tumorigenicity 7
  ENST ID: ENST00000443979
  CDS Start-End: 75-269
gagctgcgcctccgggccggtgaatcatcccggcagacaccaagagccgcggcagcagagaggagcgctgaaacatggctgaagcggccacgggctttctggagcagctcaagtcctgcatagtttggtcttggacgtatctgtggaccgtgtggttcttcatcgtgctattcctggtctacatcctgcgggtgcctttgaaaatcaacgacaacttgagcacagttaatgaaggagttcccccttctgagtatgttcaatatccatgaaaaccttttagaagcccttctggaactacaagcatatgctgatgttcaggcagtcttagcaaagtatgatgatataagcttaccaaagtcagcaacaatatgctacacagctgctttgctcaaagcaagagctgtctctgacaaattctctcctgaggctgcatctcggcgggggctgagcacagcagagatgaatgcagtagaggccattcatagagctgtggaattcaatcctcatgtgccaaaatacctactagaaatgaaaagcttaatcctacccccagaacatatcctgaagagaggagacagtgaagcaatagcatatgcattctttcatcttgcacactggaagagagtggaaggggctttgaatcttttgcattgtacgtgggaaggcacttttcggatgatcccttatcccttggaaaaggggcacctattttatccttacccaatctgtacagaaacagcagaccgagagctgcttccatctttccatgaagtctcagtttacccaaagaaggagcttcccttct

SEQ ID NO: 187516 - DNA, 579 bp, Homo sapiens
  Payload ID: 16910
  Gene Symbol: ST7
  Gene Name: suppression of tumorigenicity 7
  ENST ID: ENST00000434836
  CDS Start-End: 507-579
gtcttactgctacagcagggctggggattgcagtatccgctgttgctgctgctcccagtcctgcccctgctgctacctagtccagcctcaccgcatcccagaagaggcacgtcggccttcatttgcctagtggattttcaaaagcagctcttcggtttttggtgctgttaagagaccttgcatttcaatcacaccgggagaaaactgaagctcgtaacaggagaatctggcagctggacacagcttggactgcattgtctggcttcatgacccctgctgtgtagccggctcatctcttcactctcacatgtacactctcctcgcttttctttcttttttttttcccttttctttcttctaatttttaaaaagcagcctctggagccagccatgtttggcactgaatcttcatggtggagatcttcattatcaagtttcctgtaactaaaagggaacagatcgtctgagatcttgctccacttgtccttgagggttattaagtgagcatgtttttgaacacattaacaccgaagttctacgtggccctaacaggcacttcctcactaatatcagggctta

SEQ ID NO: 187517 - DNA, 1694 bp, Homo sapiens
  Payload ID: 16910
  Gene Symbol: ST7
  Gene Name: suppression of tumorigenicity 7
  ENST ID: ENST00000446490
  CDS Start-End: 21-1694
gcagagaggagcgctgaaacatggctgaagcggccacgggctttctggagcagctcaagtcctgcatagtttggtcttggacgtatctgtggaccgtgtggttcttcatcgtgctattcctggtctacatcctgcgggtgcctttgaaaatcaacgacaacttgagcacagtgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgcagaaagcctggagagagagaaacccccaagctaggatttctgcagctcatgaagccttggagataaatgagtgtgcaactgcttatattctcttggctgaagaggaagcaacaaccattgctgaagcagaaaaattatttaagcaggccctgaaggctggagatggctgttaccgacgctctcagcagctacaacatcatggatcccagtatgaagcccaacatagacgagacaccaatgtcttggtgtacatcaaaagaaggctagcaatgtgtgccagaagactcgggaggaccagggaagcagtgaaaatgatgagagatttaatgaaggagttcccccttctgagtatgttcaatatccatgaaaaccttttagaagcccttctggaactacaagcatatgctgatgttcaggcagtcttagcaaagtatgatgatataagcttaccaaagtcagcaacaatatgctacacagctgctttgctcaaagcaagagctgtctctgacaaattctctcctgaggctgcatctcggcgggggctgagcacagcagagatgaatgcagtagaggccattcatagagctgtggaattcaatcctcatgtgccaaaatacctactagaaatgaaaagcttaatcctacccccagaacatatcctgaagagaggagacagtgaagcaatagcatatgcattctttcatcttgcacactggaagagagtggaaggggctttgaatcttttgcattgtacgtgggaaggcattcctcagcactttgtttgcccccttaaactttgtcatggagaaagtggagagcatcctcccatccagtctgtggcaccagctaacacggatctgagagaagccctgtcctccactcacctcacccgccgctgccaccatctcctctgtgccaactccttgtggaccgcaagaaagcatgactttgaaaaagggaagccattccgagattttaaaatgttcatggactattccatattaaaagctgtttttgttgtacaaaattcactgatgttcagttctattttattttgccttcagaaaagaagaaagtcaaaaataaaacttttgtgtattaca

SEQ ID NO: 187518 - DNA, 1956 bp, Homo sapiens
  Payload ID: 16910
  Gene Symbol: ST7
  Gene Name: suppression of tumorigenicity 7
  ENST ID: ENST00000432298
  CDS Start-End: 115-1710
gtcacatggcaggaggcttccccagaacggttcgtcagtccagggagccgtttcattttctggctgatagagttgtacttggaaaatactcagtttcctgcttactgcttcattatggattatacagtgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgcagaaagcctggagagagagaaacccccaagctaggatttctgcagctcatgaagccttggagataaatgaaattaggtccagagttgaagttcccctaattgcttcctctaccatctgggagataaaattgttaccaaagtgtgcaactgcttatattctcttggctgaagaggaagcaacaaccattgctgaagcagaaaaattatttaagcaggccctgaaggctggagatggctgttaccgacgctctcagcagctacaacatcatggatcccagtatgaagcccaacatagacgagacaccaatgtcttggtgtacatcaaaagaaggctagcaatgtgtgccagaagactcgggaggaccagggaagcagtgaaaatgatgagagatttaatgaaggagttcccccttctgagtatgttcaatatccatgaaaaccttttagaagcccttctggaactacaagcatatgctgatgttcaggcagtcttagcaaagtatgatgatataagcttaccaaagtcagcaacaatatgctacacagctgctttgctcaaagcaagagctgtctctgacaaattctctcctgaggctgcatctcggcgggggctgagcacagcagagatgaatgcagtagaggccattcatagagctgtggaattcaatcctcatgtgccaaaatacctactagaaatgaaaagcttaatcctacccccagaacatatcctgaagagaggagacagtgaagcaatagcatatgcattctttcatcttgcacactggaagagagtggaaggggctttgaatcttttgcattgtacgtgggaaggcacttttcggatgatcccttatcccttggaaaaggggcacctattttatccttacccaatctgtacagaaacagcagaccgagagctgcttccatctttccatgaagtctcagtttacccaaagaaggagcttcccttctttattctctttactgctggattatgttccttcacagccatgctggccctcctgacacatcagttcccggaacttatgggggtcttcgcaaaagctttcctcagcactttgtttgcccccttaaactttgtcatggagaaagtggagagcatcctcccatccagtctgtggcaccagctaacacggatctgagagaagccctgtcctccactcacctcacccgccgctgccaccatctcctctgtgccaactccttgtggaccgcaagaaagcatgactttgaaaaagggaagccattccgagattttaaaatgttcatggactattccatattaaaagctgtttttgttgtacaaaattcactgatgttcagttctattttattttgccttcagaaaagaagaaagtcaaaaataaaacttttgtgtattacagcaa

SEQ ID NO: 187519 - DNA, 542 bp, Homo sapiens
  Payload ID: 16910
  Gene Symbol: ST7
  Gene Name: suppression of tumorigenicity 7
  ENST ID: ENST00000449366
  CDS Start-End: 282-542
cgtttcattttctggctgatagagttgtacttggaaaatactcagtttcctgcttactgcttcattatggattatacagagaaaaatatttgttgaatgagtgaacgtgggatctctgttcattttggtatattactttgctttctgggctgagctcaggacagatgccaaagcctttccctctaatgacatcaaagccctacttctaaaaccagactggatgtgattcccttctacaaacagattcagtaaagaaatgtgaatactcccacaaaaagcccatgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcga

SEQ ID NO: 187520 - DNA, 1887 bp, Homo sapiens
  Payload ID: 16910
  Gene Symbol: ST7
  Gene Name: suppression of tumorigenicity 7
  ENST ID: ENST00000422922
  CDS Start-End: 115-1641
gtcacatggcaggaggcttccccagaacggttcgtcagtccagggagccgtttcattttctggctgatagagttgtacttggaaaatactcagtttcctgcttactgcttcattatggattatacagtgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgcagaaagcctggagagagagaaacccccaagctaggatttctgcagctcatgaagccttggagataaatgagtgtgcaactgcttatattctcttggctgaagaggaagcaacaaccattgctgaagcagaaaaattatttaagcaggccctgaaggctggagatggctgttaccgacgctctcagcagctacaacatcatggatcccagtatgaagcccaacatagacgagacaccaatgtcttggtgtacatcaaaagaaggctagcaatgtgtgccagaagactcgggaggaccagggaagcagtgaaaatgatgagagatttaatgaaggagttcccccttctgagtatgttcaatatccatgaaaaccttttagaagcccttctggaactacaagcatatgctgatgttcaggcagtcttagcaaagtatgatgatataagcttaccaaagtcagcaacaatatgctacacagctgctttgctcaaagcaagagctgtctctgacaaattctctcctgaggctgcatctcggcgggggctgagcacagcagagatgaatgcagtagaggccattcatagagctgtggaattcaatcctcatgtgccaaaatacctactagaaatgaaaagcttaatcctacccccagaacatatcctgaagagaggagacagtgaagcaatagcatatgcattctttcatcttgcacactggaagagagtggaaggggctttgaatcttttgcattgtacgtgggaaggcacttttcggatgatcccttatcccttggaaaaggggcacctattttatccttacccaatctgtacagaaacagcagaccgagagctgcttccatctttccatgaagtctcagtttacccaaagaaggagcttcccttctttattctctttactgctggattatgttccttcacagccatgctggccctcctgacacatcagttcccggaacttatgggggtcttcgcaaaagctttcctcagcactttgtttgcccccttaaactttgtcatggagaaagtggagagcatcctcccatccagtctgtggcaccagctaacacggatctgagagaagccctgtcctccactcacctcacccgccgctgccaccatctcctctgtgccaactccttgtggaccgcaagaaagcatgactttgaaaaagggaagccattccgagattttaaaatgttcatggactattccatattaaaagctgtttttgttgtacaaaattcactgatgttcagttctattttattttgccttcagaaaagaagaaagtcaaaaataaaacttttgtgtattacagcaa

SEQ ID NO: 187521 - DNA, 531 bp, Homo sapiens
  Payload ID: 16910
  Gene Symbol: ST7
  Gene Name: suppression of tumorigenicity 7
  ENST ID: ENST00000421345
  CDS Start-End: 295-531
agagctggaatttctgagggtttcggttgcagttttcagtgatctttgctcgtctcccttccctgtaaagctacatatgctcagcaagtgccgcgtgcctcccatccttggtcggtggtaaatgcaggaggtaattaacaggatcttcacaaacttggagccagcccactgagtcgttaaaaaaacacccgcaaagaaaacacacgagccttaacactccagagagttccgaaacacaaagtaaatttcgagctaagggttacagtcctttaaatctggaaatttcaagtgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctca

SEQ ID NO: 187522 - DNA, 1689 bp, Homo sapiens
  Payload ID: 16910
  Gene Symbol: ST7
  Gene Name: suppression of tumorigenicity 7
  ENST ID: ENST00000490039
  CDS Start-End: 6-1689
tgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgcagaaagcctggagagagagaaacccccaagctaggatttctgcagctcatgaagccttggagataaatgaaattaggtccagagttgaagttcccctaattgcttcctctaccatctgggagataaaattgttaccaaagtgtgcaactgcttatattctcttggctgaagaggaagcaacaaccattgctgaagcagaaaaattatttaagcaggccctgaaggctggagatggctgttaccgacgctctcagcagctacaacatcatggatcccagtatgaagcccaacatagacgagacaccaatgtcttggtgtacatcaaaagaaggctagcaatgtgtgccagaagactcgggaggaccagggaagcagtgaaaatgatgagagatttaatgaaggagttcccccttctgagtatgttcaatatccatgaaaaccttttagaagcccttctggaactacaagcatatgctgatgttcaggcagtcttagcaaagtatgatgatataagcttaccaaagtcagcaacaatatgctacacagctgctttgctcaaagcaagagctgtctctgacaaattctctcctgaggctgcatctcggcgggggctgagcacagcagagatgaatgcagtagaggccattcatagagctgtggaattcaatcctcatgtgccaaaatacctactagaaatgaaaagcttaatcctacccccagaacatatcctgaagagaggagacagtgaagcaatagcatatgcattctttcatcttgcacactggaagagagtggaaggggctttgaatcttttgcattgtacgtgggaaggcacttttcggatgatcccttatcccttggaaaaggggcacctattttatccttacccaatctgtacagaaacagcagaccgagagctgcttccatttcctcagcactttgtttgcccccttaaactttgtcatggagaaagtggagagcatcctcccatccagtctgtggcaccagctaacacggatctgagagaagccctgtcctccactcacctcacccgccgctgccaccatctcctctgtgccaactccttgtggaccgcaagaaagcatgactttgaaaaagggaagccattccgagattttaaaatgttcatggactattccatattaaaagctgtttttgttgtacaaaattcactgatgttcagttctattttattttgccttcagaaaagaagaaagtcaaaaataaaacttttgtgtattacagcaa

SEQ ID NO: 187523 - DNA, 780 bp, Homo sapiens
  Payload ID: 16910
  Gene Symbol: ST7
  Gene Name: suppression of tumorigenicity 7
  ENST ID: ENST00000477742
  CDS Start-End: 488-780
ttgcagtatccgctgttgctgctgctcccagtcctgcccctgctgctacctagtccagcctcaccgcatcccagaagaggcacgtcggccttcatttgcctagtggattttcaaaagcagctcttcggtttttggtgctgttaagagaccttgcatttcaatcacaccgggagaaaactgaagctcgtaacaggagaatctggcagctggacacagcttggactgcattgtctggcttcatgacccctgctgtgtagccggctcatctcttcactctcacatgtacactctcctcgcttttctttcttttttttttcccttttctttcttctaatttttaaaaagcagcctctggagccagccatgtttggcactgaatcttcataactctactcagctcaaaatacagaacatttccatttcccctggaagttctcttgtggcctttcccagtcaatattatttcccctcttcatgaaaagtgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcgaaatccactaaatttatttaggggtgctgaatacaatcg

SEQ ID NO: 187524 - DNA, 2155 bp, Homo sapiens
  Payload ID: 16910
  Gene Symbol: ST7
  Gene Name: suppression of tumorigenicity 7
  ENST ID: ENST00000465133
  CDS Start-End: 382-1137
ctacagcagggctggggattgcagtatccgctgttgctgctgctcccagtcctgcccctgctgctacctagtccagcctcaccgcatcccagaagaggcacgtcggccttcatttgcctagtggattttcaaaagcagctcttcggtttttggtgctgttaagagaccttgcatttcaatcacaccgggagaaaactgaagctcgtaacaggagaatctggcagctggacacagcttggactgcattgtctggcttcatgacccctgctgtgtagccggctcatctcttcactctcacatgtacactctcctcgcttttctttcttttttttttcccttttctttcttctaatttttaaaaagcagcctctggagccagccatgtttggcactgaatcttcattgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgcagaaagcctggagagagagaaacccccaagctaggatttctgcagctcatgaagccttggagataaatgagtgtgcaactgcttatattctcttggctgaagaggaagcaacaaccattgctgaagcagaaaaattatttaagcaggccctgaaggctggagatggctgttaccgacgctctcagcagctacaacatcatggatcccagtatgaagcccaacatagtaaggtttcctgcaggttgatgcattgggggatcagaattgtaaaaattattaatcagagcaaatttttagtccagttcaaaatatgattctcctagacaagagaaaatattggcttttgctttgtttttattaattttcttctttcctataagtgcagttagtaaataattaacttacagcttcattgctgtttatattcacattctctttcctgcccatagattcctaaccgcagaaataaatggcagtaacctttaatagtaaccttttttcctcctgagttcttacatatttctgttcatcagttgcttctgctcacaactttaaaacccagatgggaaacaggatttaaattagccatagtgttagcaaaggttttatcttatagatcttctacaacatggattgaaataggacaattaagaatataagttattggtgattgtatcagcatttatctcttacataagaaacattggtattggcttccagagagaaagagccatgagctcctagttatttatcttttttatattaaaataatgcctttttaaactccccaaaaaacgcctttttaaatttaagataactctttaaaatctgagacctttcacttcagtatactaaactgaaagccaatgacatttcgtgggggaacagtatagaaacaaaacaacgaaatcatttctggaattccctgagcccctcgactcatcagtttgtttgttgttgaagcagaaatttagcagtccttgtggtaagagagttaagtatttccatggtccaaccaaaatttgagagtatttccatggtccaaccaaaattcacaaagttattttgtttctcacttagtttctccctcctgaaacttagagagtagggatgtatctccttcatatttgagattataaaattaaatgttaacgttaaacttgggtttggtgtagaaactgactgcattagtccccataactaaggtgccagcaaaatctttgcattatagcctgcatatacatgagtatgtcctcacatgtaccacatcaattcctaagtttttatttttattctgcagcatatatatgctaataaagtctctaatcacca

SEQ ID NO: 187525 - DNA, 1866 bp, Homo sapiens
  Payload ID: 16911
  Gene Symbol: ST7L
  Gene Name: suppression of tumorigenicity 7 like
  Uniprot ID: Q8TDW4
  ENST ID: ENST00000343210
  CDS Start-End: 77-1744
actatcccaggattcccgactcccggtttcctgtccttctcccctcccagctcctggcgcctgcgatagcggcaagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggtgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgactgtgccactgcatatgttctactggctgaggaagaagcaacaactattgtagatgctgaaaggttatttaaacaggcactcaaggcaggagaaacaatttataggcagtcacagcagtgccagcaccaaagtcctcagcatgaagctcaactgaggagagataccaatgtactggtatatattaaaagaagattggcaatgtgtgcaagaaaattaggaagaataagagaagcagtaaaaataatgagagatttgatgaaagaatttcctcctcttaccatgttgaacatccatgaaaatctcttagaatcacttttagaattacaggcctatccagatgttcaggcagtcctagcaaaatatgatgatataagccttccaaagtcagcagcaatctgttacacagcagcactgttgaagacaaggactgtttcagaaaaattctctccagaaacagcctccagaagaggattaagcacagcagaaattaatgccgtggaagcaattcatagagctgtggaatttaatcctcatgttccaaaatatttattagagatgaaaagtttaattttacctccagaacacattctgaaacggggtgatagtgaagcaattgcctatgctttctttcatcttcagcactggaaacgaatagaaggtgctcttaatctgttacagtgtacatgggaaggcacttttagaatgattccatacccgttagagaaaggacatctattttacccttatcccagctgcacagagacggctgatagagagctattacctacctttcatcatgtttctgtttacccaaaaaaggagcttcctttgttcatccatttcacagcaggattttgctcttctacagcaatgatagccattctcactcaccagtttcctgaaatcatgggtatttttgctaaagctgtaagtatgatctcaaggacttgtgtagattatttgtaaaacacacaagaaaccatctctgatctgcctgtgctaacccagctgaacaatggaagatatttgttgtaaattaaaggaattgatttgtatatagttgctgccataaatacatcaaacataaa

SEQ ID NO: 187526 - DNA, 4528 bp, Homo sapiens
  Payload ID: 16911
  Gene Symbol: ST7L
  Gene Name: suppression of tumorigenicity 7 like
  Uniprot ID: Q8TDW4
  ENST ID: ENST00000358039
  CDS Start-End: 306-2033
cggggggggggcggtgtgaaaggtgaccctcatttcgtttggaagcggtaacacttcggggtcacatctcagtccagttcctccagaataggcgctgctgtccgccccttccctgccccacgaaagaacaggtagccccaatcttgagacacgctcctccaccttcgaaatcttctcggtcccggttccccaggactcagccttcacagaggccaacttcaggtccgccactatcccaggattcccgactcccggtttcctgtccttctcccctcccagctcctggcgcctgcgatagcggcaagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggtgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgactgtgccactgcatatgttctactggctgaggaagaagcaacaactattgtagatgctgaaaggttatttaaacaggcactcaaggcaggagaaacaatttataggcagtcacagcagtgccagcaccaaagtcctcagcatgaagctcaactgaggagagataccaatgtactggtatatattaaaagaagattggcaatgtgtgcaagaaaattaggaagaataagagaagcagtaaaaataatgagagatttgatgaaagaatttcctcctcttaccatgttgaacatccatgaaaatctcttagaatcacttttagaattacaggcctatccagatgttcaggcagtcctagcaaaatatgatgatataagccttccaaagtcagcagcaatctgttacacagcagcactgttgaagacaaggactgtttcagaaaaattctctccagaaacagcctccagaagaggattaagcacagcagaaattaatgccgtggaagcaattcatagagctgtggaatttaatcctcatgttccaaaatatttattagagatgaaaagtttaattttacctccagaacacattctgaaacggggtgatagtgaagcaattgcctatgctttctttcatcttcagcactggaaacgaatagaaggtgctcttaatctgttacagtgtacatgggaaggcacttttagaatgattccatacccgttagagaaaggacatctattttacccttatcccagctgcacagagacggctgatagagagctattacctacctttcatcatgtttctgtttacccaaaaaaggagcttcctttgttcatccatttcacagcaggattttgctcttctacagcaatgatagccattctcactcaccagtttcctgaaatcatgggtatttttgctaaagctgtgctgggactctggtgcccccaaccctgggcatcctcaggctttgaggagaatacacaggatttgaagtcagaagacctaggtttgagttctggctgagccacgcactgttcatgtgaccttggacaaatcaccaaatttttctgaacagcatctgtaaagtgacagtaacccctacctcacagggttgttgtgaggattacatatatgctaaagcattttgcatatgaaaaagcttcttatgaatattgttattcctaggcaaaccccccttggaagctgtcaaaaaggacaactgtagatgaaattgtcttccttttttcttcattcagcttagcctttctgtttggccagggctacttacaggggctgttggggttgaagtcaagtcaccgcattttggctcctttggtcaaagagaaagaactctaatgtccagctgctccatcgatatactcatagaatggaagtgagcaaaggaaaattttaagccaggatagttaaccgttagggggccagtgggagaatgcttgccttgcatttgcacatccagaatgactaaaacatcttaagtaaatgaggaatagccaccgagatgctcagagataatataagccatgagtgggaagtgggaaaatgagtttgtcaacgccctctcttttctatccctttacctttgaggtcagggacagggcatattactgacaccccactggctattgccctatacctgccaatcacccaaagaaaataatagcttctgagaaagctcaattcactgtagcaactgtgatatatttaccctaataaagccaccacttggtcttttccagtgcttctctcttatggagatcatccctggaatccaaagctctccagttttctaacccagttaagagttaaaaacaaccacaggtcatgagcagtaggcttggcagttataccccatgcagtcataggagactgctccatcattctcagcacatagggtgcacatctcactatctctggcatgaaccagccttgcgaacttatacagtctcagccactctgctttgatggtaattcttcaccactgatctctcctcaccatgcccttcctgcatccttcccccaaccacccaccagaggagttctggtccccaaaccaaagagttgcctgcaggttggtaatgtgactttgtagatattccttgattaaagccagaccctattggtatcctttttgaagtactggatcgaaatctaattgcttttttttttaattgttggggagaggaggatgagcagaactcctatgcagcctgagagaagttctctatgtgtctgtatatgtacacctctgtgtgtgtgtgtgtaacctcatggttgtgctcaggctgacagggagggcaaagagtgaaaaggaagcatctctttcttgttatccaacattgcttcaaagatgcccaacccccgtagtagcaggcagttcccaagtggagggtcggggcagaggcctccaccaaggccatcaataaccaggtgtgagctacaggtctctgtgtaatgtgaagctctcccgtatttcatttctgcacccagggggcggctctgcaggattgcttacggagaactctgtgtctggcacctctctccacaaggcccaggcgcccagggtcccaccgacctgcccaggaatgcatcacattgttctctggtgctgtaatttggctgcaggagctaggctgaatgcctcccagggatgagaaacatactctccctggcgtcctcccttcgccccagctagcttgagcttctgccctatgaccactgagtgcatttaaataaaaacctcagaaagactgaggaaaaaaaaatcctaattatctctcttctgttaagccatgtagagactcgtgtcctgagtgggtctgagaatttggcaaagacttactggttggtgttcttgataagggaagtgagacaaaggagaagaaattactccctgcaacaggaggaatagaaatgaagcagtgagtgttcagaaattagatctacaagaagttttgcaaacagaccctcagggccaggcaatgtttgtttttgttttttgttttttgtttttttttttaatctgaagcccctgattttatttttccagcatcactctaaggaagagtgtggattagtgccattattcagggctggtattaataaaagttagcttttatctgcagggctaggttaaggctggcattcttacttttacattaaaaaaactggctacaggctgcgcagctgaggtacttcagtcatgtgccttctctaaaggattcttagatccttaaaatatatagtatgttttaagtttgtatctaaatagcacttactgtaatgtattatacctaaatgtttattaaaagttagaagaaatgagtaccaacaggaaggaatggaagagaggagaggggctaagacattgctgatctgagggacagacctctatcaaatagaagagggctgggagaaggggtgattagaagcagagtgagggaactaaatggagccctgactgcaccaaataaagttctcattttgctgcttgttccaaa

SEQ ID NO: 187527 - DNA, 4206 bp, Homo sapiens
  Payload ID: 16911
  Gene Symbol: ST7L
  Gene Name: suppression of tumorigenicity 7 like
  Uniprot ID: Q8TDW4
  ENST ID: ENST00000360743
  CDS Start-End: 77-1711
actatcccaggattcccgactcccggtttcctgtccttctcccctcccagctcctggcgcctgcgatagcggcaagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggtgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgactgtgccactgcatatgttctactggctgaggaagaagcaacaactattgtagatgctgaaaggttatttaaacaggcactcaaggcaggagaaacaatttataggcagtcacagcagtgccagcaccaaagtcctcagcatgaagctcaactgaggagagataccaatgtactggtatatattaaaagaagattggcaatgtgtgcaagaaaattaggaagaataagagaagcagtaaaaataatgagagatttgatgaaagaatttcctcctcttaccatgttgaacatccatgaaaatctcttagaatcacttttagaattacaggcctatccagatgttcaggcagtcctagcaaaatatgatgatataagccttccaaagtcagcagcaatctgttacacagcagcactgttgaagacaaggactgtttcagaaaaattctctccagaaacagcctccagaagaggattaagcacagcagaaattaatgccgtggaagcaattcatagagctgtggaatttaatcctcatgttccaaaatatttattagagatgaaaagtttaattttacctccagaacacattctgaaacggggtgatagtgaagcaattgcctatgctttctttcatcttcagcactggaaacgaatagaaggtgctcttaatctgttacagtgtacatgggaaggcacctttcatcatgtttctgtttacccaaaaaaggagcttcctttgttcatccatttcacagcaggattttgctcttctacagcaatgatagccattctcactcaccagtttcctgaaatcatgggtatttttgctaaagctgtgctgggactctggtgcccccaaccctgggcatcctcaggctttgaggagaatacacaggatttgaagtcagaagacctaggtttgagttctggctgagccacgcactgttcatgtgaccttggacaaatcaccaaatttttctgaacagcatctgtaaagtgacagtaacccctacctcacagggttgttgtgaggattacatatatgctaaagcattttgcatatgaaaaagcttcttatgaatattgttattcctaggcaaaccccccttggaagctgtcaaaaaggacaactgtagatgaaattgtcttccttttttcttcattcagcttagcctttctgtttggccagggctacttacaggggctgttggggttgaagtcaagtcaccgcattttggctcctttggtcaaagagaaagaactctaatgtccagctgctccatcgatatactcatagaatggaagtgagcaaaggaaaattttaagccaggatagttaaccgttagggggccagtgggagaatgcttgccttgcatttgcacatccagaatgactaaaacatcttaagtaaatgaggaatagccaccgagatgctcagagataatataagccatgagtgggaagtgggaaaatgagtttgtcaacgccctctcttttctatccctttacctttgaggtcagggacagggcatattactgacaccccactggctattgccctatacctgccaatcacccaaagaaaataatagcttctgagaaagctcaattcactgtagcaactgtgatatatttaccctaataaagccaccacttggtcttttccagtgcttctctcttatggagatcatccctggaatccaaagctctccagttttctaacccagttaagagttaaaaacaaccacaggtcatgagcagtaggcttggcagttataccccatgcagtcataggagactgctccatcattctcagcacatagggtgcacatctcactatctctggcatgaaccagccttgcgaacttatacagtctcagccactctgctttgatggtaattcttcaccactgatctctcctcaccatgcccttcctgcatccttcccccaaccacccaccagaggagttctggtccccaaaccaaagagttgcctgcaggttggtaatgtgactttgtagatattccttgattaaagccagaccctattggtatcctttttgaagtactggatcgaaatctaattgcttttttttttaattgttggggagaggaggatgagcagaactcctatgcagcctgagagaagttctctatgtgtctgtatatgtacacctctgtgtgtgtgtgtgtaacctcatggttgtgctcaggctgacagggagggcaaagagtgaaaaggaagcatctctttcttgttatccaacattgcttcaaagatgcccaacccccgtagtagcaggcagttcccaagtggagggtcggggcagaggcctccaccaaggccatcaataaccaggtgtgagctacaggtctctgtgtaatgtgaagctctcccgtatttcatttctgcacccagggggcggctctgcaggattgcttacggagaactctgtgtctggcacctctctccacaaggcccaggcgcccagggtcccaccgacctgcccaggaatgcatcacattgttctctggtgctgtaatttggctgcaggagctaggctgaatgcctcccagggatgagaaacatactctccctggcgtcctcccttcgccccagctagcttgagcttctgccctatgaccactgagtgcatttaaataaaaacctcagaaagactgaggaaaaaaaaatcctaattatctctcttctgttaagccatgtagagactcgtgtcctgagtgggtctgagaatttggcaaagacttactggttggtgttcttgataagggaagtgagacaaaggagaagaaattactccctgcaacaggaggaatagaaatgaagcagtgagtgttcagaaattagatctacaagaagttttgcaaacagaccctcagggccaggcaatgtttgtttttgttttttgttttttgtttttttttttaatctgaagcccctgattttatttttccagcatcactctaaggaagagtgtggattagtgccattattcagggctggtattaataaaagttagcttttatctgcagggctaggttaaggctggcattcttacttttacattaaaaaaactggctacaggctgcgcagctgaggtacttcagtcatgtgccttctctaaaggattcttagatccttaaaatatatagtatgttttaagtttgtatctaaatagcacttactgtaatgtattatacctaaatgtttattaaaagttagaagaaatgagtaccaacaggaaggaatggaagagaggagaggggctaagacattgctgatctgagggacagacctctatcaaatagaagagggctgggagaaggggtgattagaagcagagtgagggaactaaatggagccctgactgcaccaaataaagttctcattttgctgcttgttccaaa

SEQ ID NO: 187528 - DNA, 862 bp, Homo sapiens
  Payload ID: 16911
  Gene Symbol: ST7L
  Gene Name: suppression of tumorigenicity 7 like
  ENST ID: ENST00000369664
  CDS Start-End: 175-862
atatactgtactattctttagctgtagacaggatgaagtgtttagggcccaggtccccttaccatgtgattatatttcactcaagatctgagcagcaacctcagaacaagatataagtatttccattacatgattcagtatggtggttgatttttctgaagcaaaaggcagcaaatgtcccctttcctgttcagagatgacatgaaagacttgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgactgtgccactgcatatgttctactggctgaggaagaagcaacaactattgtagatgctgaaaggttatttaaacaggcactcaaggcaggagaaacaatttataggcagtcacagcagtgccagcaccaaagtcctcagcatgaagctcaactga

SEQ ID NO: 187529 - DNA, 1815 bp, Homo sapiens
  Payload ID: 16911
  Gene Symbol: ST7L
  Gene Name: suppression of tumorigenicity 7 like
  Uniprot ID: Q8TDW4
  ENST ID: ENST00000369666
  CDS Start-End: 77-1693
actatcccaggattcccgactcccggtttcctgtccttctcccctcccagctcctggcgcctgcgatagcggcaagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgactgtgccactgcatatgttctactggctgaggaagaagcaacaactattgtagatgctgaaaggttatttaaacaggcactcaaggcaggagaaacaatttataggcagtcacagcagtgccagcaccaaagtcctcagcatgaagctcaactgaggagagataccaatgtactggtatatattaaaagaagattggcaatgtgtgcaagaaaattaggaagaataagagaagcagtaaaaataatgagagatttgatgaaagaatttcctcctcttaccatgttgaacatccatgaaaatctcttagaatcacttttagaattacaggcctatccagatgttcaggcagtcctagcaaaatatgatgatataagccttccaaagtcagcagcaatctgttacacagcagcactgttgaagacaaggactgtttcagaaaaattctctccagaaacagcctccagaagaggattaagcacagcagaaattaatgccgtggaagcaattcatagagctgtggaatttaatcctcatgttccaaaatatttattagagatgaaaagtttaattttacctccagaacacattctgaaacggggtgatagtgaagcaattgcctatgctttctttcatcttcagcactggaaacgaatagaaggtgctcttaatctgttacagtgtacatgggaaggcacttttagaatgattccatacccgttagagaaaggacatctattttacccttatcccagctgcacagagacggctgatagagagctattacctacctttcatcatgtttctgtttacccaaaaaaggagcttcctttgttcatccatttcacagcaggattttgctcttctacagcaatgatagccattctcactcaccagtttcctgaaatcatgggtatttttgctaaagctgtaagtatgatctcaaggacttgtgtagattatttgtaaaacacacaagaaaccatctctgatctgcctgtgctaacccagctgaacaatggaagatatttgttgtaaattaaaggaattgatttgtatatagttgctgccataaatacatcaaacataaa

SEQ ID NO: 187530 - DNA, 1743 bp, Homo sapiens
  Payload ID: 16911
  Gene Symbol: ST7L
  Gene Name: suppression of tumorigenicity 7 like
  Uniprot ID: Q8TDW4
  ENST ID: ENST00000369669
  CDS Start-End: 435-1613
gtgtgagaatttggcagcgggtgagaggaccagacctcctggggcagggcggggggccaggagagatgtcgggggcaagagccaaagggcaagagattctcggtagtcctagagggcctctgaggagtcgatgatgagcgatcaatgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgactgtgccactgcatatgttctactggctgaggaagaagcaacaactattgtagatgctgaaaggttatttaaacaggcactcaaggcaggagaaacaatttataggcagtcacagcagtgccagcaccaaagtcctcagcatgaagctcaactgaggagagataccaatgtactggtatatattaaaagaagattggcaatgtgtgcaagaaaattaggaagaataagagaagcagtaaaaataatgagagatttgatgaaagaatttcctcctcttaccatgttgaacatccatgaaaatctcttagaatcacttttagaattacaggcctatccagatgttcaggcagtcctagcaaaatatgatgatataagccttccaaagtcagcagcaatctgttacacagcagcactgttgaagacaaggactgtttcagaaaaattctctccagaaacagcctccagaagaggattaagcacagcagaaattaatgccgtggaagcaattcatagagctgtggaatttaatcctcatgttccaaaatatttattagagatgaaaagtttaattttacctccagaacacattctgaaacggggtgatagtgaagcaattgcctatgctttctttcatcttcagcactggaaacgaatagaaggtgctcttaatctgttacagtgtacatgggaaggcacttttagaatgattccatacccgttagagaaaggacatctattttacccttatcccagctgcacagagacggctgatagagagctattacctacctttcatcatgtttctgtttacccaaaaaaggagcttcctttgttcatccatttcacagcaggattttgctcttctacagcaatgatagccattctcactcaccagtttcctgaaatcatgggtatttttgctaaagctgtgctgggactctggtgcccccaaccctgggcatcctcaggctttgaggagaatacacaggatttgaagtcagaagacctaggtttgagttctggctgagccacgcactgttcatgtgaccttggacaaatcaccaaatttttctgaacagcatctgtaaagtgacagtaacccctacctcacagggttgttgtgaggattacatatatgctaaagcattttgcatatg

SEQ ID NO: 187531 - DNA, 860 bp, Homo sapiens
  Payload ID: 16911
  Gene Symbol: ST7L
  Gene Name: suppression of tumorigenicity 7 like
  ENST ID: ENST00000418497
  CDS Start-End: 1-860
gcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgactgtgccactgcatatgttctactggctgaggaagaagcaacaactattgtagatgctgaaaggttatttaaacaggcactcaaggcaggagaaacaatttataggcagtcacagcagtgccagcaccaaagtcctcagcatgaagctcaactgaggagagataccaatgtactggtatatattaaaagaagattggcaatgtgtgcaagaaaattaggaagaataagagaagcagtaaaaataatgagagattatttattagagatgaaaagtttaattttacctccagaacacattctgaaacggggtgatagtgaagcaattgcctatgctttctttcatcttcagcactggaaacgaatagaaggtgctcttaatctgttacagtgtacatgggaaggcacctttcatcatgtttctgtttacccaaaaaaggagcttcctttgttcatccatttcacagcaggattttgctcttctacagcaatgatagccattctcactcaccagtttcctgaaatcatgggtatttttgctaaagct

SEQ ID NO: 187532 - DNA, 1780 bp, Homo sapiens
  Payload ID: 16911
  Gene Symbol: ST7L
  Gene Name: suppression of tumorigenicity 7 like
  Uniprot ID: Q8TDW4
  ENST ID: ENST00000490067
  CDS Start-End: 77-1753
actatcccaggattcccgactcccggtttcctgtccttctcccctcccagctcctggcgcctgcgatagcggcaagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgactgtgccactgcatatgttctactggctgaggaagaagcaacaactattgtagatgctgaaaggttatttaaacaggcactcaaggcaggagaaacaatttataggcagtcacagcagtgccagcaccaaagtcctcagcatgaagctcaactgaggagagataccaatgtactggtatatattaaaagaagattggcaatgtgtgcaagaaaattaggaagaataagagaagcagtaaaaataatgagagatttgatgaaagaatttcctcctcttaccatgttgaacatccatgaaaatctcttagaatcacttttagaattacaggcctatccagatgttcaggcagtcctagcaaaatatgatgatataagccttccaaagtcagcagcaatctgttacacagcagcactgttgaagacaaggactgtttcagaaaaattctctccagaaacagcctccagaagaggattaagcacagcagaaattaatgccgtggaagcaattcatagagctgtggaatttaatcctcatgttccaaaatatttattagagatgaaaagtttaattttacctccagaacacattctgaaacggggtgatagtgaagcaattgcctatgctttctttcatcttcagcactggaaacgaatagaaggtgctcttaatctgttacagtgtacatgggaaggcacttttagaatgattccatacccgttagagaaaggacatctattttacccttatcccagctgcacagagacggctgatagagagctattacctacctttcatcatgtttctgtttacccaaaaaaggagcttcctttgttcatccatttcacagcaggattttgctcttctacagcaatgatagccattctcactcaccagtttcctgaaatcatgggtatttttgctaaagctgtgctgggactctggtgcccccaaccctgggcatcctcaggctttgaggagaatacacaggatttgaagtcagaagacctaggtttgagttctggctgagccacgcactgttcatgtgaccttgga

SEQ ID NO: 187533 - DNA, 4348 bp, Homo sapiens
  Payload ID: 16911
  Gene Symbol: ST7L
  Gene Name: suppression of tumorigenicity 7 like
  Uniprot ID: Q8TDW4
  ENST ID: ENST00000361846
  CDS Start-End: 32-1699
cccagctcctggcgcctgcgatagcggcaagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggtgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgactgtgccactgcatatgttctactggctgaggaagaagcaacaactattgtagatgctgaaaggttatttaaacaggcactcaaggcaggagaaacaatttataggcagtcacagcagtgccagcaccaaagtcctcagcatgaagctcaactgaggagagataccaatgtactggtatatattaaaagaagattggcaatgtgtgcaagaaaattaggaagaataagagaagcagtaaaaataatgagagatttgatgaaagaatttcctcctcttaccatgttgaacatccatgaaaatctcttagaatcacttttagaattacaggcctatccagatgttcaggcagtcctagcaaaatatgatgatataagccttccaaagtcagcagcaatctgttacacagcagcactgttgaagacaaggactgtttcagaaaaattctctccagaaacagcctccagaagaggattaagcacagcagaaattaatgccgtggaagcaattcatagagctgtggaatttaatcctcatgttccaaaatatttattagagatgaaaagtttaattttacctccagaacacattctgaaacggggtgatagtgaagcaattgcctatgctttctttcatcttcagcactggaaacgaatagaaggtgctcttaatctgttacagtgtacatgggaaggcacttttagaatgattccatacccgttagagaaaggacatctattttacccttatcccagctgcacagagacggctgatagagagctattacctacctttcatcatgtttctgtttacccaaaaaaggagcttcctttgttcatccatttcacagcaggattttgctcttctacagcaatgatagccattctcactcaccagtttcctgaaatcatgggtatttttgctaaagctgtagtaggagttaaaacccaaaaagaaaatgctgattaattatattcccaaaaatgaaaacactgagaaccatggaaaaactagtccttacttggtgctgggactctggtgcccccaaccctgggcatcctcaggctttgaggagaatacacaggatttgaagtcagaagacctaggtttgagttctggctgagccacgcactgttcatgtgaccttggacaaatcaccaaatttttctgaacagcatctgtaaagtgacagtaacccctacctcacagggttgttgtgaggattacatatatgctaaagcattttgcatatgaaaaagcttcttatgaatattgttattcctaggcaaaccccccttggaagctgtcaaaaaggacaactgtagatgaaattgtcttccttttttcttcattcagcttagcctttctgtttggccagggctacttacaggggctgttggggttgaagtcaagtcaccgcattttggctcctttggtcaaagagaaagaactctaatgtccagctgctccatcgatatactcatagaatggaagtgagcaaaggaaaattttaagccaggatagttaaccgttagggggccagtgggagaatgcttgccttgcatttgcacatccagaatgactaaaacatcttaagtaaatgaggaatagccaccgagatgctcagagataatataagccatgagtgggaagtgggaaaatgagtttgtcaacgccctctcttttctatccctttacctttgaggtcagggacagggcatattactgacaccccactggctattgccctatacctgccaatcacccaaagaaaataatagcttctgagaaagctcaattcactgtagcaactgtgatatatttaccctaataaagccaccacttggtcttttccagtgcttctctcttatggagatcatccctggaatccaaagctctccagttttctaacccagttaagagttaaaaacaaccacaggtcatgagcagtaggcttggcagttataccccatgcagtcataggagactgctccatcattctcagcacatagggtgcacatctcactatctctggcatgaaccagccttgcgaacttatacagtctcagccactctgctttgatggtaattcttcaccactgatctctcctcaccatgcccttcctgcatccttcccccaaccacccaccagaggagttctggtccccaaaccaaagagttgcctgcaggttggtaatgtgactttgtagatattccttgattaaagccagaccctattggtatcctttttgaagtactggatcgaaatctaattgcttttttttttaattgttggggagaggaggatgagcagaactcctatgcagcctgagagaagttctctatgtgtctgtatatgtacacctctgtgtgtgtgtgtgtaacctcatggttgtgctcaggctgacagggagggcaaagagtgaaaaggaagcatctctttcttgttatccaacattgcttcaaagatgcccaacccccgtagtagcaggcagttcccaagtggagggtcggggcagaggcctccaccaaggccatcaataaccaggtgtgagctacaggtctctgtgtaatgtgaagctctcccgtatttcatttctgcacccagggggcggctctgcaggattgcttacggagaactctgtgtctggcacctctctccacaaggcccaggcgcccagggtcccaccgacctgcccaggaatgcatcacattgttctctggtgctgtaatttggctgcaggagctaggctgaatgcctcccagggatgagaaacatactctccctggcgtcctcccttcgccccagctagcttgagcttctgccctatgaccactgagtgcatttaaataaaaacctcagaaagactgaggaaaaaaaaatcctaattatctctcttctgttaagccatgtagagactcgtgtcctgagtgggtctgagaatttggcaaagacttactggttggtgttcttgataagggaagtgagacaaaggagaagaaattactccctgcaacaggaggaatagaaatgaagcagtgagtgttcagaaattagatctacaagaagttttgcaaacagaccctcagggccaggcaatgtttgtttttgttttttgttttttgtttttttttttaatctgaagcccctgattttatttttccagcatcactctaaggaagagtgtggattagtgccattattcagggctggtattaataaaagttagcttttatctgcagggctaggttaaggctggcattcttacttttacattaaaaaaactggctacaggctgcgcagctgaggtacttcagtcatgtgccttctctaaaggattcttagatccttaaaatatatagtatgttttaagtttgtatctaaatagcacttactgtaatgtattatacctaaatgtttattaaaagttagaagaaatgagtaccaacaggaaggaatggaagagaggagaggggctaagacattgctgatctgagggacagacctctatcaaatagaagagggctgggagaaggggtgattagaagcagagtgagggaactaaatggagccctgactgcaccaaataaagttctcattttgctgcttgttccaaa

SEQ ID NO: 187534 - DNA, 4483 bp, Homo sapiens
  Payload ID: 16911
  Gene Symbol: ST7L
  Gene Name: suppression of tumorigenicity 7 like
  Uniprot ID: Q8TDW4
  ENST ID: ENST00000490715
  CDS Start-End: 167-1834
gatggaatcaccgcggcggccgtcggaaggacccgcccggaaacgccgaccaagagggccccatgtcagttatgcgcgggagtgacgtctcctaacgccagcgcccgcgcccgcgccccaggaagtagggtttgccttagctcctggcgcctgcgatagcggcaagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggtgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgactgtgccactgcatatgttctactggctgaggaagaagcaacaactattgtagatgctgaaaggttatttaaacaggcactcaaggcaggagaaacaatttataggcagtcacagcagtgccagcaccaaagtcctcagcatgaagctcaactgaggagagataccaatgtactggtatatattaaaagaagattggcaatgtgtgcaagaaaattaggaagaataagagaagcagtaaaaataatgagagatttgatgaaagaatttcctcctcttaccatgttgaacatccatgaaaatctcttagaatcacttttagaattacaggcctatccagatgttcaggcagtcctagcaaaatatgatgatataagccttccaaagtcagcagcaatctgttacacagcagcactgttgaagacaaggactgtttcagaaaaattctctccagaaacagcctccagaagaggattaagcacagcagaaattaatgccgtggaagcaattcatagagctgtggaatttaatcctcatgttccaaaatatttattagagatgaaaagtttaattttacctccagaacacattctgaaacggggtgatagtgaagcaattgcctatgctttctttcatcttcagcactggaaacgaatagaaggtgctcttaatctgttacagtgtacatgggaaggcacttttagaatgattccatacccgttagagaaaggacatctattttacccttatcccagctgcacagagacggctgatagagagctattacctacctttcatcatgtttctgtttacccaaaaaaggagcttcctttgttcatccatttcacagcaggattttgctcttctacagcaatgatagccattctcactcaccagtttcctgaaatcatgggtatttttgctaaagctgtagtaggagttaaaacccaaaaagaaaatgctgattaattatattcccaaaaatgaaaacactgagaaccatggaaaaactagtccttacttggtgctgggactctggtgcccccaaccctgggcatcctcaggctttgaggagaatacacaggatttgaagtcagaagacctaggtttgagttctggctgagccacgcactgttcatgtgaccttggacaaatcaccaaatttttctgaacagcatctgtaaagtgacagtaacccctacctcacagggttgttgtgaggattacatatatgctaaagcattttgcatatgaaaaagcttcttatgaatattgttattcctaggcaaaccccccttggaagctgtcaaaaaggacaactgtagatgaaattgtcttccttttttcttcattcagcttagcctttctgtttggccagggctacttacaggggctgttggggttgaagtcaagtcaccgcattttggctcctttggtcaaagagaaagaactctaatgtccagctgctccatcgatatactcatagaatggaagtgagcaaaggaaaattttaagccaggatagttaaccgttagggggccagtgggagaatgcttgccttgcatttgcacatccagaatgactaaaacatcttaagtaaatgaggaatagccaccgagatgctcagagataatataagccatgagtgggaagtgggaaaatgagtttgtcaacgccctctcttttctatccctttacctttgaggtcagggacagggcatattactgacaccccactggctattgccctatacctgccaatcacccaaagaaaataatagcttctgagaaagctcaattcactgtagcaactgtgatatatttaccctaataaagccaccacttggtcttttccagtgcttctctcttatggagatcatccctggaatccaaagctctccagttttctaacccagttaagagttaaaaacaaccacaggtcatgagcagtaggcttggcagttataccccatgcagtcataggagactgctccatcattctcagcacatagggtgcacatctcactatctctggcatgaaccagccttgcgaacttatacagtctcagccactctgctttgatggtaattcttcaccactgatctctcctcaccatgcccttcctgcatccttcccccaaccacccaccagaggagttctggtccccaaaccaaagagttgcctgcaggttggtaatgtgactttgtagatattccttgattaaagccagaccctattggtatcctttttgaagtactggatcgaaatctaattgcttttttttttaattgttggggagaggaggatgagcagaactcctatgcagcctgagagaagttctctatgtgtctgtatatgtacacctctgtgtgtgtgtgtgtaacctcatggttgtgctcaggctgacagggagggcaaagagtgaaaaggaagcatctctttcttgttatccaacattgcttcaaagatgcccaacccccgtagtagcaggcagttcccaagtggagggtcggggcagaggcctccaccaaggccatcaataaccaggtgtgagctacaggtctctgtgtaatgtgaagctctcccgtatttcatttctgcacccagggggcggctctgcaggattgcttacggagaactctgtgtctggcacctctctccacaaggcccaggcgcccagggtcccaccgacctgcccaggaatgcatcacattgttctctggtgctgtaatttggctgcaggagctaggctgaatgcctcccagggatgagaaacatactctccctggcgtcctcccttcgccccagctagcttgagcttctgccctatgaccactgagtgcatttaaataaaaacctcagaaagactgaggaaaaaaaaatcctaattatctctcttctgttaagccatgtagagactcgtgtcctgagtgggtctgagaatttggcaaagacttactggttggtgttcttgataagggaagtgagacaaaggagaagaaattactccctgcaacaggaggaatagaaatgaagcagtgagtgttcagaaattagatctacaagaagttttgcaaacagaccctcagggccaggcaatgtttgtttttgttttttgttttttgtttttttttttaatctgaagcccctgattttatttttccagcatcactctaaggaagagtgtggattagtgccattattcagggctggtattaataaaagttagcttttatctgcagggctaggttaaggctggcattcttacttttacattaaaaaaactggctacaggctgcgcagctgaggtacttcagtcatgtgccttctctaaaggattcttagatccttaaaatatatagtatgttttaagtttgtatctaaatagcacttactgtaatgtattatacctaaatgtttattaaaagttagaagaaatgagtaccaacaggaaggaatggaagagaggagaggggctaagacattgctgatctgagggacagacctctatcaaatagaagagggctgggagaaggggtgattagaagcagagtgagggaactaaatggagccctgactgcaccaaataaagttctcattttgctgcttgttccaaa

SEQ ID NO: 187535 - DNA, 1021 bp, Homo sapiens
  Payload ID: 16912
  Gene Symbol: SAPCD1
  Gene Name: suppressor APC domain containing 1
  ENST ID: ENST00000383205
  CDS Start-End: 257-700
cggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagacatgtttattgaaactgtccttcagccttaaatacaaaaataaaactgaaactgctccagaaagcagctttctccaaaaat

SEQ ID NO: 187536 - DNA, 916 bp, Homo sapiens
  Payload ID: 16912
  Gene Symbol: SAPCD1
  Gene Name: suppressor APC domain containing 1
  Uniprot ID: Q5SSQ6
  ENST ID: ENST00000449857
  CDS Start-End: 60-596
ggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaagttctccccaagtccactgaacaaggctagttcctgcaccacccaggattcaaaggaaagacgaagggagcagaacttgtggcagcaacaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagcatgtttattgaaactgtccttcagccttaaatacaaaaataaaactgaaactgctccagaaagcagctttctccaaaaat

SEQ ID NO: 187537 - DNA, 916 bp, Homo sapiens; identical to SEQ ID NO: 187536
  Payload ID: 16912
  Gene Symbol: SAPCD1
  Gene Name: suppressor APC domain containing 1
  Uniprot ID: Q5SSQ6
  ENST ID: ENST00000447852
  CDS Start-End: 60-596

SEQ ID NO: 187538 - DNA, 916 bp, Homo sapiens; identical to SEQ ID NO: 187536
  Payload ID: 16912
  Gene Symbol: SAPCD1
  Gene Name: suppressor APC domain containing 1
  Uniprot ID: Q5SSQ6
  ENST ID: ENST00000443153
  CDS Start-End: 60-596

SEQ ID NO: 187539 - DNA, 916 bp, Homo sapiens; identical to SEQ ID NO: 187536
  Payload ID: 16912
  Gene Symbol: SAPCD1
  Gene Name: suppressor APC domain containing 1
  Uniprot ID: Q5SSQ6
  ENST ID: ENST00000453534
  CDS Start-End: 60-596

SEQ ID NO: 187540 - DNA, 917 bp, Homo sapiens
  Payload ID: 16912
  Gene Symbol: SAPCD1
  Gene Name: suppressor APC domain containing 1
  Uniprot ID: Q5SSQ6
  ENST ID: ENST00000457185
  CDS Start-End: 60-596
ggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaagttctccccaagtccactgaacaaggctagttcctgcaccacccaggattcaaaggaaagacgaagggagcagaacttgtggcagcaacaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagacatgtttattgaaactgtccttcagccttaaatacaaaaataaaactgaaactgctccagaaagcagctttctccaaaaat

SEQ ID NO: 187541 - DNA, 607 bp, Homo sapiens
  Payload ID: 16912
  Gene Symbol: SAPCD1
  Gene Name: suppressor APC domain containing 1
  ENST ID: ENST00000433778
  CDS Start-End: 257-607
cggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaag

SEQ ID NO: 187542 - DNA, 1020 bp, Homo sapiens
  Payload ID: 16912
  Gene Symbol: SAPCD1
  Gene Name: suppressor APC domain containing 1
  ENST ID: ENST00000427166
  CDS Start-End: 257-700
cggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagcatgtttattgaaactgtccttcagccttaaatacaaaaataaaactgaaactgctccagaaagcagctttctccaaaaat

SEQ ID NO: 187543 - DNA, 916 bp, Homo sapiens; identical to SEQ ID NO: 187536
  Payload ID: 16912
  Gene Symbol: SAPCD1
  Gene Name: suppressor APC domain containing 1
  Uniprot ID: Q5SSQ6
  ENST ID: ENST00000415669
  CDS Start-End: 60-596

SEQ ID NO: 187544 - DNA, 1020 bp, Homo sapiens; identical to SEQ ID NO: 187542
  Payload ID: 16912
  Gene Symbol: SAPCD1
  Gene Name: suppressor APC domain containing 1
  ENST ID: ENST00000436320
  CDS Start-End: 257-700

SEQ ID NO: 187545 - DNA, 820 bp, Homo sapiens; identical to SEQ ID NO: 155498
  Payload ID: 16912
  Gene Symbol: SAPCD1
  Gene Name: suppressor APC domain containing 1
  Uniprot ID: Q5SSQ6
  ENST ID: ENST00000425424
  CDS Start-End: 60-506

SEQ ID NO: 187546 - DNA, 1020 bp, Homo sapiens; identical to SEQ ID NO: 187542
  Payload ID: 16912
  Gene Symbol: SAPCD1
  Gene Name: suppressor APC domain containing 1
  ENST ID: ENST00000425286
  CDS Start-End: 257-700

SEQ ID NO: 187547 - DNA, 1020 bp, Homo sapiens; identical to SEQ ID NO: 187542
  Payload ID: 16912
  Gene Symbol: SAPCD1
  Gene Name: suppressor APC domain containing 1
  ENST ID: ENST00000449925
  CDS Start-End: 257-700

SEQ ID NO: 187548 - DNA, 820 bp, Homo sapiens; identical to SEQ ID NO: 155498
  Payload ID: 16912
  Gene Symbol: SAPCD1
  Gene Name: suppressor APC domain containing 1
  Uniprot ID: Q5SSQ6
  ENST ID: ENST00000551778
  CDS Start-End: 60-506

SEQ ID NO: 187549 - DNA, 3848 bp, Homo sapiens
  Payload ID: 16913
  Gene Symbol: SAPCD2
  Gene Name: suppressor APC domain containing 2
  Uniprot ID: Q86UD0
  ENST ID: ENST00000409687
  CDS Start-End: 129-1313
gccgcgaggagggccccattcaaaagtagtcgctattgtcgccgtgggctgagctcgccgggccggcccctccgtggggccgcgctgggacgcacgcgggtggacgaggggaccgatcccgggcgcccatggccggggccgccatggccgagcggggccgcgtgcctccccccgcacccgcgcccagcacggaggggctgccgcgcgccttcctgcagagcctgcgcaccctgttcgacatcctggacgaccggcggcgcggctgcgtgcacctgcgcgagatcgagtcccgctggcagggcaccgacgcgcgggagctgccccgcggggtgctggagggcttgcgccaggtggccccggccagcggctacctgaccttcgagcgcttcgtggccggcctgcgcacctccctgctgagcgccgacggcggcccccgggaccccacgcgcgccccggcccggcccggggatcagccgccgccgccgccgcagcgcctggtgttcgctccggccgacgagccgcggacggtcctggagaggaagcccctgcccctgggcgtgcgcgcccctctggccggtcccagcgccgccgcccgcagcccggagcagctgtgcgccccggctgaggcggcgccctgccccgcggagcccgagcggtcccagagcgcggcgctggaaccgagctccagcgcggacgcaggtgcagtggcgtgcagggccctggaggcggactcaggggatgcccggcgggctccccgtgcccgaggggaacgtcggaggcacaccatcgccagcggcgtggactgcggcctgctgaagcagatgaaggagctggagcaggagaaggaggtgctgctgcagggtttggagatgatggcgcggggccgcgactggtaccagcagcagctgcaacgagtgcaggagcgccagcgccgcctgggccagagcagagccagcgccgactttggggctgcagggagcccccgcccactggggcggctactgcccaaggtacaagaggtggcccggtgcctgggggagctgctggctgcagcctgtgccagccgggccctgcccccgtcctcctccgggcccccctgccctgccctgacgtccacctcacccccggtctggcagcagcagaccatcctcatgctgaaggagcagaaccgactcctcacccaggaggtgaccgagaagagtgagcgcatcacgcagctggagcaggagaagtcggcgctcattaagcagctgtttgaggcccgcgccctgagccagcaggacgggggacctctggattccaccttcatctagtccttgtgggccgcgtgggcccccagggccagcctggcactcagcccttcgagggtgggcgccccatcgcacccaccctctctggctggagacccccggcaggcccaggcacagtcccggagtgggcgccttcctgccgcccttgccagatgggctccccaggcctgcccccggctggtccccgcaccgagcgcttgactccgttttggctcctggtgctgacatgggctggggctctcttgagtccgcatagtccgcagctactactgccgctgtcagtggacagtggggtacccctccatgagttagcgtccccccgtttccagcggtgccgccctgggtcccatcttcagggaaaggcactgcccacgccaggctgcacttccaacaacgggcagcagagggcgcggggcggctccgacgcgggtccaagggcagcttcccgctcaaccagggcaccaggacgaggtggctgtagctcggacggacggaagtagatggagggggtggggacggcctgtaagcggggggtgcctgcctggctggggagccccagggatagcggtcggacttcaggttctggccaaggctgagggaccctggctgcagcggatcggcacgccgggtgggcgagagcttggcctgcatgtgcctcccacagaccctggggtgatggccttccccctcttggccgggacgttgccccacgttgagtcccacacaacatcctgtgagcctggctccccaggagggcccccagacagctcccaggcacgtcataggcaaagcctgttcccccgactcaggatttccaaggcctggggtcctgctcacccccctttgctctcacgcccagcctgtccccaggtttcagctgggagaggccacctccctcagccaaggaaaacgagaacccccagggtacaggaggaggctggggcaggtccccttgggtgtcactccctcagcccctgcccaggcccactcccgctggtgctggagtacgcactggtgggggggccctgctcagcccaacctggagggtcccagtgtcaccagaaccaggggcacggcaacagcatcgatgggttctgcagcccagggcccccgatgcggggtcagtgcgtggggggcgcagggcccccgatgccgatgcggggtcagtgtgtgtggggcgcagggcctccgatgcggggtcagtgcgtggggggcgcagggccccctcgtgtccagggcactttggtacactgtcccacaaggcacctgtctcagaggaggggccctggcaggcagcgtggcaactcccttccggagcccagctccatgctaacctgcccacagcaaccccacagagccacattccctgctgcacctggtctgcaggggtgtcccaggacaggcccaagtcagcccagcatgcagctgccctcctaccctgaagatgggagtgggctttccaggggacataaggatgtcaggcctggacctcctgggcaggaaagggtgcaggtcctgagggcctgtgccccacagccccagcaccaggtggactgcagcgcagtgggtgggccagtggcagccagggagaagccccccgtcagcaggctggggtctgcccaccagggcctccccacgtctgcctttgagggtgcctgccatgccctgggggatcctggcatctttactggactggaagcaggagacagaacagtgtctgtcccggggtgacttcatcaggagaccgcccacatagagctggaccccgcagctgaagcggaaatgtgagacaggctggcacctccggaaaaactgcctttcagccttggtgttccgtgcaaggtgaaaagaaataggtcctcccagtttacagcttgaaatcaggctagtgagtggccctggagaccacgaggggagaatttaaaggccccggctggcagggtctaggtggctggcagaggcacatgcagaccctgcctggagcctgccctaggacgctgggcgggtcagtctccgtgcaggatgtgagcagcgtccctgggctctatccgcgaggtgccagtagcgtgtgcaggtacatacacgtgcgtgcacactgtgatgacacccggaaatgtctcaggatgttgaaatgtgtccttgggggcagaagtgtccccagttgagaatctgccccagaggaacacacccacaccaggcctcaggattttgtgttgatcaagttccaaggaaaaggaacatctcagccgggcgtggtggttcacgcctggaatcccagcacttgaggccaggagttccagagcagcctgggcaacgcagtgagagaccccatctctacaaaaaaaaaaaagaaagaaagaaaatgagagatccaggtttaaaaattcataaacaccacaaggaaacaatacactatgagacccagcagaagcaacagattgactctagacccagatactagaattatcagagagaatataaagtaacagtgttttatatatctaaagaaataaaagagatttctggaaacatgaacaa

SEQ ID NO: 187550 - DNA, 12079 bp, Homo sapiens
  Payload ID: 16914
  Gene Symbol: SCAI
  Gene Name: suppressor of cancer cell invasion
  Uniprot ID: Q8N9R8
  ENST ID: ENST00000336505
  CDS Start-End: 60-1880
agcttcccgagcgagccctgcggccgccggagcagctcccgcggcggagcaggagccggatggtcagaggagcccggcagccccagcagccgcggagtcgcctggcccccagactgactggcacagtggagaaaccgcctcgaaaacggagaagcaggactgaatttgctcttaaagaaatcatgtcctctggaggtgctgaagatgatatcccacagggagagaggaaaacagttacagatttttgttatcttctggataaatctaagcaactgttcaatgggttaagagatttgccacaatatggacagaagcagtggcagtcctattttggaagaacttttgatgtttacaccaaactctggaagttccagcagcagcatcgacaagtcttggataatcggtatggcttgaagcgctggcaaataggagaaattgcttccaagattgggcagctatactatcattattacttacgcacatcggaaaccagctatctgaatgaggctttttccttctattctgcaatcagacagagatcatattattctcaagtcaataaagaggacagacctgaattggtagttaagaagttacgatattatgcaagatttatagtagtttgtcttcttctcaacaaaatggatgttgtaaaggatctggtaaaggaattgtcagatgaaattgaagattatactcaccgatttaatactgaagatcaagtggaatggaacttggtgcttcaagaagtagcagctttcattgaggcggatcctgtaatggtattaaatgatgataataccattgttatcacatcgaatcgccttgctgaaacaggagccccattgctggaacagggcatgattgtgggacagttgtctctggctgacgcactcattattggtaattgtaataatcaggttaagttcagtgaactaactgttgacatgttccggatgttacaagctctggaaagggagccaatgaatttagcttcccagatgaataaaccaggaatgcaggaatcagctgacaagcctactagacgagaaaacccccacaagtatctgctctacaaaccaaccttcagccagctatataccttcttagcagcgtcttttaaggagctgcctgccaatagcgtgcttctgatttacctgtcggccactggcgttttccccacaggtcgttctgatagtgaaggtccttatgattttggaggtgtacttactaatagtaaccgggatattattaatggagatgccatccacaaacgaaatcagtcccacaaggaaatgcactgccttcatcccggggatctctatcctttcaccaggaagccactgttcatcattgtggattcgtctaatagtgttgcgtataagaatttcacaaacttgtttggacagccactagtctgcttgctttctcctacagcatatccaaaagctttacaagatcaatctcagcgaggtagcctcttcactctctttttgaacaatcctctaatggccttcctatttgtctctggattgtcaagcatgcgcagaggcctatgggaaaagtgtcaagaatatcttcgaaaaatcaaccgtgatattgcccagctactgactcattcacgttcaatagatcaggcatttctccagttttttggagatgaatttcttcgcttgctcctcacaagatttatcttttgttcagccaccatgaggatgcacaagatttttcgggaaacacgaaattatccagaatcatatccacaactgccaagggatgaaacagtggagaatcctcatctccagaagcacattttggaattagcatccattctggatgttcgaaacgtgttctttgagaataccattgatgactattaaaacaaaaaccctgttgtcgaaacaagttttcattttccacaaattttaaatggtgcagttttctaacgtgataagacacatagtggtgttacttagtttttattttttaatttagggccaccattttaaaaacaaacaaaaaaatgttcacacttttagggtaactgttttaaaatgcaacctttcaggtcttttaaaatcttaaccttggaatttttattttttgattttgagggatggatatttacctccaacttctaatcctacactcaaatagtcactattctcaccctgagaagagtaaatcatttatttttgtataatgaggtaaatccaactcttatacttggacctaagttaaatgtctggatttggaaatatgtaatggttcataatgatgaagctagccaccatggactactgaaaatcaagaacagagtccctccataatatattttttctcattccaacttagctggtagaaaaatgtttgatcctttgaaacatgatcaagccagttttttgaaatcatttaatttctttcaatactgtcataatttcagaaattggattgaattgcatctgaaagctacatcttgattgaggacttgaggtggtaatattacttggaatgtatgagtattatgagatttatttgcatattttctttgtagtctgtgaatgctggaaatgaaaaaggaaacaactttgaaatattttagtcaaaaaaccatgtcattggtttcataatacaatgtctccaataggaattctatttaaactcttggtttatgagatcacatttaaagactggattgatgtctgtgacataaagttttaattttttgcctcattcaaatttatgagacttcaaagtcatagatgttttaaattttggtaaggggtaactgggtgttatgaaacctaaaatgtaagttgattttgcattggtaatttggaaataagatttattaacattccctgtatttagtattttatattcatgcacaaaatttttattatcttaaataggactcagtgtatattataaagatttttcttttttgtgttttccttccctgtcattccctttataatttcacagtcacttgctatgaagtcctccctcctttttgattatgcagcattcaatttcagaaatctatgaatgagaaggccttatacctaattttctgtacaggatcacatctggcagtcccaggagaagtgagctgattgcttttgatatctctttcccatggccctaggtaaattatactctaaatttatttattttttttgaaacagagtcttgcttttgttgcccaggttggagtgcagtggggctatctcggctcactgcaacctccgcctcccaggttcaagcaattttcctgcctcagcctcccgagtagctgggattacaggtgcccgccaccatgcctggctaatttttgtatttttagtagagacggggtttcaccatgttggtcaggctggtctcaaactcctgaccttgtgatctgcctgcctcagcctcccaaagtgctgggattacaggcgtgagccaccgcacctggctattatttttaacttggttttcatttctggcatagagactaatttgggtctaagttattcccattcctgctttgatttgctgatttttcaaacctgaagtccaaagttactgtttttggggtttggggacttggggagtattttacttttttttttttttttttttaagagacagagtcttgctttgttgcccaggttggggtgcagcggtacattcatggctcactgcagcctcaaattcctggattcaggcaatcttctcacctcagcctcccaagtagctgggactacaggcatgcgccaccatgcctggctaattttctttattttttaattttttgtagagacatggtctcactttgttgagcaggctggcctcaaactcctgggctcaagtgatcctcctgcctcaacctcccaaagtgctaggattacaggtgtgagccactgtacctggcctgtttactttttaaaaatttttttgtttgttctttcaaacagtatttcagaaagcttgggaaaagttaccctggaaagatttcctttgctagtgggttttcattttcaggtaaagactgctttccttttttttcagtatcttaataaacttcatagctttcctttagtaacagtgttcattgaactacagcaatagactatcttcggttttctgacctcttgtttcaattccccttaagtcctgtgccagttatgctcctaccaacacagagtttcctgtcctctaatgtttaaaatagtatttactgttctgagctttatcctcccccgttaagcataaagaacactggtctgagaactaggagacctaagttctagtcctggctttcctggtaacttaagcgttatgccctttgacaactgtcttcatgtctctgcttgttagcactctcatctgtaaaatgaagaggttggcccaggtcttctccaactctgattctgtaatttggactcttggttccaaaaatattgatttccccactccaaccaccaagagaactatttaccctgtttgtagtgtacacaaccttttcttttgtaagtcatatttacctagattttgttcaagaaaatctgggtcccacttagctgttttagaaactagtacagacagagactctcctgaggaaattagagcttttatgattagaaacatgcttgtctaaaaatgagggtcttagaaatcacaacattgacccttatgatgttgccccttaagctaatagtgtaattccttactggtagttaaaaatctaaagtggactgaagtgatcttgaatcttcaaagagaggaaaactgtgctggaaaatgttattgtttcattgatgccttcaaaaaaatgcgtattaaacaaagactatactccagattttcttctgggcattggggaagcaaacaaaatagacttaaaaatcctcatgttcatgaagcttacattctagtagaaggagtaaggcaataaacataagtaatttatgttagaaaatgttaagtaggatggaaaagtgtagattatggtaaggtaaatcttttgtttgttttcttaagagaagaacaatgtttaaaagagtgatcaagcagggcatggtggcatgaccctattagtcccagctacctgggaggccgaggtgggagggtcacttgagcccaggagtttgtggctgcagtgagctgtgattgcaccactgcactccagcctggatggcaaagcaagacctcgtctctggaaaaaaagaaaagaaaaagtgatgatcagggtaggcttcattaggaaggtcacatttgcatgaacactttgccttttctttctttttatgaaagttttaaacatagtttttttgttttttgtttttgagacggagtttcactcttgttactcaggctgcagtgtggtggcaggatctcagctcactgcaacctccaccttccagtttcaagtgattctcctgcctcagcctccccagtagctgggattacaggcatgtgccaccacacccagctaattttgtgttttgagatggggtttcaccatgttggtcaggctggtctcgaactcctgatttgaggtgatccgttggcctcggcctcccaaagtgctgggattacaggcatgagccaccacgcccagcctaaacatacagtttaataaatcctccttgtaccttacccagcttctgtatttctttaatcaagggagaagaattatctaaaaggacagttgcccaatgggcttgagctgatgatagtggcaaagaatttcattttttaaaaatgcataccacctgccctttataaaaaaatttaaaccctaatgtatttaattttataattcataaaaatttaaatattggaactaagaacagagcaaagcaaagggaaaaagcactcctttgttttcaaattgcacaaactgtccctggagattctgatagtctctcatctctcttaactatcactgtaaacaacatagaaagcataagactgcaagaagtcagttatacacaaaacaaaatgaagcacagtggaattttctctttctttatctgtatatttctgaagttggtaaagcaactatcttctctattttacagaagagaaagctgagacccaaaaagctattcatagtgatagagctagaactaaaactcagatctcctcatctcagcccagtcttctcagtagctcagactgctttctataatgaacaagaaagaataattagggatttgtattttggcacaaaacagtatcaaatttttattgtaaaaatccacaaatctgacattttatcttttattctagccaggatgtattcttcatttgcatgtgtgtgtttctcttagaaagtggtgctctcaaacctttcaaagcacagaatttattgtaccctctttatttttaccaaattgaaacgtttcaggatttcagaagcaaagtgcaatccaattgtggctggagttttcctgatagaggatccgggtggttccctcccctccaacttctggctactgccctttatttcctttgtgcaatagaattccctgaaacagattatgtcgtaattatactgatttagtcaggataatgggaaaagcgacaaatcggatttatgtattaggtattatggagctttctttagcactctcctccaagtttaatctctgacatgtgtgatatagtaactttctgtctctgagaagcagtttggacccagctgaaaaattttatttatggagacttgtaatcagcctgatatacagagaacactctggactggaaatatagtcaggtaccaaggtctgctaatttggccattgccagtgattcaaaaccacctccccaccctgagtaaaagatttgatatgaatatgaatgctatgagtctcctggtgatgttttgggtgtatatgttcctgtgtgtgtttggaaatcatagagggtatttaccttgagggctcttttgttgaccttatttatttgaaattcttattttatttgtaatggcatatgtatatttttgtgatgctacatgcaatctctgtgtatactttttgtatatatgtatacatatttgtaaatatattggtatgcagtgatacagtatgtgtatattatgtacccatacccattgtgggctgaatttatttaagttctgtgaggacatcctagtggcattgttcatgctgctgtaattaggttgtggctgtatctcattcataagcctctattttgagaggcttgtgtttggataaaatgggctaatttggagttgaaattaggatatgaagatcttaacagaaagctagatatttattcttagctttaaaatcacctgcaaatttttatttaaactgatgataaattagtgatataacctgaaaaacctaagtatgtgaaactgagacaccagcagattcttaggctgtagtagtcctttattttcttgatccatatttaagtattattactgagtagtaaattatgtatattggggcttaatagagaggctgtggaaaaaaattgctttaatcacatttaaaaacataggaaaatgtccattaaataggggaaatatattcccagttgtcatttttatgcctcatactgaattttgattttggaacaattcttttttcatcagtgttttatgtgtctctatgaggcagaaaagggggcattagctaagggatggcctaacctaagtaggataggatttagtgaggaacgggaggttgttaatttgtatatttgcagcagctatgattaatttagtcctgtcttggcatttccggctacagattttttcttactggacttgcatatcaaaggtgagtaggctcatctgagaaaatgcttccactgaataaaatgccttcactcgtattgctgtgtctctatgagaccacttgtgttctgcaagttgatgatatattcgcacatgaagtagagtttttaatattagatgcatggtgtgctataaaaatctgggccttcaaacctctcccaaggatgatagggttggggaggataagaggatagtaaatacgtgcaatgccaatttgtgaacctatagaatgttgccaagtatcaatgtttggttacttcagttgacatatttatttgcatgaaagagtgtaggagatgtttaatatacacttaaatacattcactgcagaaattaagtagaggttatttttgcatgataaaatataactgcaaagcaactttttacaccgtattctttggaagattaaatctatctgatccaatattatcttaaaatagagaaattatctcaggagtctgttttaccacccaaaaaaatgttacatttgctgattcattatattttaaataaaacagccaactattcataagacttttcaattatagtattaaattcagaaataattataacagcatttttcttgaataaatattaaaatttggtaatttattatttctgaaaaatcagtgaaaacatccataggatctgatggtttgttgtttgaataaccaaatcattgtttttgcactggagagtagtagagcagatattataccatttaaaattcatggaactgactcaggctccttgtggatattaatttgaggacagtagtggtaatcaaaagtacagtagaaaacacttgacattgtgaatgtgacctctgaccccaaccgttgtaaagccaataactttgagggtgaataaggtaacacttgcttagaaaacccagccctttcccccagtctcctgcgctcttatacattgatactttacaactatttttgctgtacctctcagtctttcctggataatgggaccacttaaaaaaaaaagtgattcatcttcctcaaactagaatttcaaagcctaatactacactatgttccagcttcactgagttttgaacaaaaagacttaagcatgccttgtgtttaaggaaaaataattgatgtgtgaatggaatcaatcacctattgacgggaagggtgtcaggatgatgtagggtgatatgcctttaattggataaagagaactgtattaagtataactaatttaataactgattgaagcaccattcttaattttaaaatatttttgttaatttcttttgtggttttaaaaattaataatttttttttttttgagatggagttttgctcgttgcccaggctggaatgcaatggcgcgatctcagctcactgcaacctccgcctcctgggttcaagagattctcctgcctcagcctcccaagtagctgggattacaggcgtgtgccaccacgaccagctaattttgtatttttagtagagatggggtttcaccatgttggccaggttggtctcgaactcctgacctcaagtgatccacccgcctcggcctcccaaagtgctgggattacaggtgtgagccactgtggccggcctaaaaaaaattctttttaatagttatcagactactttaaccagtgccatgtttaaacatacttggacaatagactcagtttttttaatagtttgaagtacattatattaaaactacaaactcacttattcaagcctaaatttcatcatagactataaattgggtatcaatttcctattttggtggacaattccagtctgtctactacgacaatcatctttttaggtgtaatattgtttaagacataggtaattttaggttttatacttttctcctaggcttatggaatgaaagctaataggatatcactttcagaatgaaatagggaattatggctagccttcttatagggctgccgtaaatgatacttaaatgtttgttatatcactgattttcttttctcttctgaagctgttgtgaatgtccactttgccatgattaaaagttgagatttgtaaacattacaatttgaaccataaattttctcaaacatgaaatcagtatgaataagtataaaatttgaaatgatcatacatgagaatcccaaaagtaaatacttccaaaccatagagggataaccactgtatttttaaaaagcttatttccacccttaaagaagcatgctactaattgctttttttctaaattaaaactatgtactgtggtaaattaaaaatctgcaggaaaaattgcttagtgttttagcacaataagaatttttattactcaggagttggagaccagtctgggcaatacagtgaaaccctgtcgctactaaaatacaaaaaaaaaaaaaaaaaaaaaaaaattagccaggcatggtggtgtgcgcctgtaatcccagctacttgggaggctgaggcaggagaactgcttgtaacctgggaggcggaggttgcagtgagccgagatcgtgccattgcactccagtctgggtgacagagcaagactcattctcaaaaaaaaaaaaaaaaggaatttttattactatttcctgaagaatggtttttgttaacttgttactgtatcattaaaaagaccttctaatggttcagtacaataatctagaacttgatttatgtggctttttatagttatctgaatgcattccttttgccacatagaccatatggctagttctccaacttttttgcttatttttaataaaccttgctgttcaacaatcagagaaacctttagattttggatgattcttccagttgaggtagaaacatcttagataataggaaaggcaaatacaaagtcctaacattttcatagtagagtttacaagtaaaataacttatccatataggttatcttcgttgtgtagcaccagtataaatagtgatttcattaatcattgaatcagatgaagcagttataaatcactttttactttgtgctaagaattattgtaatttcaggacactttattatttcctctgagcagtttccattggaaggttgagtttcccttttttaagttctaatcatcactaaaggttaagataatcaaataggagttaaaataagttatgtttgatctttttcccttgaaaataatgctgaacttattgtctacattctgattattaggcagaaatgcacttgtttaaatcatagaagtaattcatttggaggatataattactcgattttctagtggtgtgaaatactttttaacaattgtgcttgtctgtaactgaaatgttatagaattttaacactatagggattatagagttatattagctctcctcaagagactgaagcacaatatttttcatgtaacaattcttatccaagtgctgctaatctgtcgtgcaaataatgaagctatttggttgcctatttagctattcacaaatcactgtaatctttgaaacaatcttgtcgttcatttgtattaatatttggatattgtgagttaatactttagaaaaaaatccatcaactcagccccgttagcaaaactgtttggattcatagtttttatatgtgttaacagtagaataaattttgaaggggctatttactaccaatgactaaggggaaaattatactgtcactatcatttgacttgaacatttgtggtattgtaaaagtcttgtcagttgtgttctaaattgcttaagccatacgttctcttaaacaggatgtttttttcttcctttccagcagcctttttcttctttgtctgttatggttaatactccatagattttagaaattgagaagttcttgaaacattttattttcttgagttcatcacttttgactcttgtatgagatgtgatttgtcataaaagatagccttccactacttcactaaatgaatttcagagtaaacactgtgattctgcagagcggattcagtaggctttccaatgttttctcctgctatacagtgcctaccaccttgagggcacttcagtactagaggatgaaaactgaaacgttgttttgatgtttattgaataacgagattagagaatatttgatttttgttgtcagtgtattaaagaaattttcacattgataaatgttctctaggaatgtgtctacattcatcaggtgtgaactcttgtacatgaattttgtaccttgaatccacatatatattaagtgtatcatcaatataaaaataaacattatttgcttaaa

SEQ ID NO: 187551 - DNA, 1968 bp, Homo sapiens
  Payload ID: 16914
  Gene Symbol: SCAI
  Gene Name: suppressor of cancer cell invasion
  Uniprot ID: Q8N9R8
  ENST ID: ENST00000373549
  CDS Start-End: 60-1949
agcttcccgagcgagccctgcggccgccggagcagctcccgcggcggagcaggagccggatggtcagaggagcccggcagccccagcagccgcggagtcgcctggcccccagactgactggcacagtggagaaaccgcctcgaaaacggagaagcagtatcagaggttctggtgatagcagtcattcacaatctcaaggggaaagatatcaacatttcactgaaaagactgaatttgctcttaaagaaatcatgtcctctggaggtgctgaagatgatatcccacagggagagaggaaaacagttacagatttttgttatcttctggataaatctaagcaactgttcaatgggttaagagatttgccacaatatggacagaagcagtggcagtcctattttggaagaacttttgatgtttacaccaaactctggaagttccagcagcagcatcgacaagtcttggataatcggtatggcttgaagcgctggcaaataggagaaattgcttccaagattgggcagctatactatcattattacttacgcacatcggaaaccagctatctgaatgaggctttttccttctattctgcaatcagacagagatcatattattctcaagtcaataaagaggacagacctgaattggtagttaagaagttacgatattatgcaagatttatagtagtttgtcttcttctcaacaaaatggatgttgtaaaggatctggtaaaggaattgtcagatgaaattgaagattatactcaccgatttaatactgaagatcaagtggaatggaacttggtgcttcaagaagtagcagctttcattgaggcggatcctgtaatggtattaaatgatgataataccattgttatcacatcgaatcgccttgctgaaacaggagccccattgctggaacagggcatgattgtgggacagttgtctctggctgacgcactcattattggtaattgtaataatcaggttaagttcagtgaactaactgttgacatgttccggatgttacaagctctggaaagggagccaatgaatttagcttcccagatgaataaaccaggaatgcaggaatcagctgacaagcctactagacgagaaaacccccacaagtatctgctctacaaaccaaccttcagccagctatataccttcttagcagcgtcttttaaggagctgcctgccaatagcgtgcttctgatttacctgtcggccactggcgttttccccacaggtcgttctgatagtgaaggtccttatgattttggaggtgtacttactaatagtaaccgggatattattaatggagatgccatccacaaacgaaatcagtcccacaaggaaatgcactgccttcatcccggggatctctatcctttcaccaggaagccactgttcatcattgtggattcgtctaatagtgttgcgtataagaatttcacaaacttgtttggacagccactagtctgcttgctttctcctacagcatatccaaaagctttacaagatcaatctcagcgaggtagcctcttcactctctttttgaacaatcctctaatggccttcctatttgtctctggattgtcaagcatgcgcagaggcctatgggaaaagtgtcaagaatatcttcgaaaaatcaaccgtgatattgcccagctactgactcattcacgttcaatagatcaggcatttctccagttttttggagatgaatttcttcgcttgctcctcacaagatttatcttttgttcagccaccatgaggatgcacaagatttttcgggaaacacgaaattatccagaatcatatccacaactgccaagggatgaaacagtggagaatcctcatctccagaagcacattttggaattagcatccattctggatgttcgaaacgtgttctttgagaataccattgatgactattaaaacaaaaaccctgttgtcg

SEQ ID NO: 187552 - DNA, 691 bp, Homo sapiens
  Payload ID: 16914
  Gene Symbol: SCAI
  Gene Name: suppressor of cancer cell invasion
  ENST ID: ENST00000467917
  CDS Start-End: 1-265
caaacgaaatcagtcccacaaggaaatgcactgccttcatcccggggatctctatcctttcaccaggaagccactgttcatcattgtggattcgtctaatagtgttgcgtataagaatttcacaaacttgtttggacagccactagtctgcttgctttctcctacagcatatccaaaagctttacaagtgctgatgtctctctgtgggagatggcattttactgctacttcccagccagaagtcctgtctgctgacatagtttgacacaggaagtgatggtcagcatttgaatgcctgagagaagctggaggctttcaccgttgttttaagatcaatctcagcgaggtagcctcttcactctctttttgaacaatcctctaatggccttcctatttgtctctggattgtcaagcatgcgcagaggcctatgggaaaagtgtcaagaatatcttcgaaaaatcaaccgtgatattgcccagctactgactcattcacgttcaatagatcaggcatttctccagttttttggagatgaatttcttcgcttgctcctcacaagatttatcttttgttcagccaccatgaggatgcacaagatttttcgggaaacacgaaattatccagaatcatatccacaactgccaagggatgaaacagtggagaatcctcatctccagaagcacattttgg

SEQ ID NO: 187553 - DNA, 562 bp, Homo sapiens
  Payload ID: 16914
  Gene Symbol: SCAI
  Gene Name: suppressor of cancer cell invasion
  ENST ID: ENST00000494102
  CDS Start-End: 1-99
aatttcacaaacttgtttggacagccactagtctgcttgctttctcctacagcatatccaaaagctttacaagggactgggtctcaccatgttgcctaggctggtctcaaactcctgggctcaagagatctgcctgccttggcctcccaaagtgctattcaacatttattatcagatcaatctcagcgaggtagcctcttcactctctttttgaacaatcctctaatggccttcctatttgtctctggattgtcaagcatgcgcagaggcctatgggaaaagtgtcaagaatatcttcgaaaaatcaaccgtgatattgcccagctactgactcattcacgttcaatagatcaggcatttctccagttttttggagatgaatttcttcgcttgctcctcacaagatttatcttttgttcagccaccatgaggatgcacaagatttttcgggtaggcaaagaacattattaaagacgaattttatcattttaggtatttaagaaccatgtattatattttacctgtataaaataaggttataataaaataatattattttgga

SEQ ID NO: 187554 - DNA, 1808 bp, Homo sapiens
  Payload ID: 16914
  Gene Symbol: SCAI
  Gene Name: suppressor of cancer cell invasion
  ENST ID: ENST00000477186
  CDS Start-End: 51-1523
agcgagccctgcggccgccggagcagctcccgcggcggagcaggagccggatggtcagaggagcccggcagccccagcagccgcggagtcgcctggcccccagactgactggcacagtggagaaaccgcctcgaaaacggagaagcaggactgaatttgctcttaaagaaatcatgtcctctggaggtgctgaagatgatatcccacagggagagaggaaaacagttacagatttttgttatcttctggataaatctaagcaactgttcaatgggttaagagatttgccacaatatggacagaagcagtggcagtcctattttggaagaacttttgatgtttacaccaaactctggaagttccagcagcagcatcgacaagtcttggataatcggtatggcttgaagcgctggcaaataggagaaattgcttccaagattgggcagctatactatcattattacttacgcacatcggaaaccagctatctgaatgaggctttttccttctattctgcaatcagacagagatcatattattctcaagtcaataaagaggacagacctgaattggtagttaagaagttacgatattatgcaagatttatagtagtttgtcttcttctcaacaaaatggatgttgtaaaggatctggtaaaggaattgtcagatgaaattgaagattatactcaccgatttaatactgaagatcaagtggaatggaacttggtgcttcaagaagtagcagctttcattgaggcggatcctgtaatggtattaaatgatgataataccattgttatcacatcgaatcgccttgctgaaacaggagccccattgctggaacagggcatgattgtgggacagttgtctctggctgacgcactcattattggtaattgtaataatcaggttaagttcagtgaactaactgttgacatgttccggatgttacaagctctggaaagggagccaatgaatttagcttcccagatgaataaaccaggaatgcaggaatcagctgacaagcctactagacgagaaaacccccacaagtatctgctctacaaaccaaccttcagccagctatataccttcttagcagcgtcttttaaggagctgcctgccaatagcgtgcttctgatttacctgtcggccactggcgttttccccacaggtcgttctgatagtgaaggtccttatgattttggaggtgtacttactaatagtaaccgggatattattaatggagatgccatccacaaacgaaatcagtcccacaaggaaatgcactgccttcatcccggggatctctatcctttcaccaggaagccactgttcatcattgtggattcgtctaatagtgttgcgtataagaatttcacaaacttgtttggacagccactagtctgcttgctttctcctacagcatatccaaaagctttacaagcatgcgcagaggcctatgggaaaagtgtcaagaatatcttcgaaaaatcaaccgtgatattgcccagctactgactcattcacgttcaatagatcaggcatttctccagttttttggagatgaatttcttcgcttgctcctcacaagatttatcttttgttcagccaccatgaggatgcacaagatttttcgggaaacacgaaattatccagaatcatatccacaactgccaagggatgaaacagtggagaatcctcatctccagaagcacattttggaattagcatccattctggatgttcgaaacgtgttctttgagaataccattgatgactattaaaacaaaaaccctgttgtcg

SEQ ID NO: 187555 - DNA, 1225 bp, Homo sapiens
  Payload ID: 16915
  Gene Symbol: SOCS1
  Gene Name: suppressor of cytokine signaling 1
  Uniprot ID: O15524
  ENST ID: ENST00000332029
  CDS Start-End: 152-787
agctgcacggctcctggccccggagcatgcgcgagagccgccccggagcgccccggagccccccgccgtcccgcccgcggcgtcccgcgccccgccgccagcgcacccccggacgctatggcccacccctccggctggccccttctgtaggatggtagcacacaaccaggtggcagccgacaatgcagtctccacagcagcagagccccgacggcggccagaaccttcctcctcttcctcctcctcgcccgcggcccccgcgcgcccgcggccgtgccccgcggtcccggccccggcccccggcgacacgcacttccgcacattccgttcgcacgccgattaccggcgcatcacgcgcgccagcgcgctcctggacgcctgcggattctactgggggcccctgagcgtgcacggggcgcacgagcggctgcgcgccgagcccgtgggcaccttcctggtgcgcgacagccgccagcggaactgctttttcgcccttagcgtgaagatggcctcgggacccacgagcatccgcgtgcactttcaggccggccgctttcacctggatggcagccgcgagagcttcgactgcctcttcgagctgctggagcactacgtggcggcgccgcgccgcatgctgggggccccgctgcgccagcgccgcgtgcggccgctgcaggagctgtgccgccagcgcatcgtggccaccgtgggccgcgagaacctggctcgcatccccctcaaccccgtcctccgcgactacctgagctccttccccttccagatttgaccggcagcgcccgccgtgcacgcagcattaactgggatgccgtgttattttgttattacttgcctggaaccatgtgggtaccctccccggcctgggttggagggagcggatgggtgtaggggcgaggcgcctcccgccctcggctggagacgaggccgcagaccccttctcacctcttgagggggtcctccccctcctggtgctccctctgggtccccctggttgttgtagcagcttaactgtatctggagccaggacctgaactcgcacctcctacctcttcatgtttacatatacccagtatctttgcacaaaccaggggttgggggagggtctctggctttatttttctgctgtgcagaatcctattttatattttttaaagtcagtttaggtaataaactttattatgaaagttttttttttaaaaaaaaataa

SEQ ID NO: 187556 - DNA, 2761 bp, Homo sapiens
  Payload ID: 16916
  Gene Symbol: SOCS2
  Gene Name: suppressor of cytokine signaling 2
  Uniprot ID: O14508
  ENST ID: ENST00000340600
  CDS Start-End: 599-1195
cttcccatagccgcggcctcaactaaaagtggccattgacctttcaagctttcgagcagtgatgcaatagaatagtatttcaaagaaaaatgcttatcgaaattttggatccggttttcccgtgattgttaagggtttcttttaaaaagtaggtcacatttcaagtaggtcatatttcgggggcgggtgcgcagacaaggagatgagtttccactaaggccagggggcctccaacggggttggaggtgagaatcccaggtagggtagaggtgccgagatccttccgaatcccagccctggggcgtcagccctgcagggaatggcagagacactctccggactgagggaaccgaggccagtcaccaagccccttccgggcgcgcaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttctacaagttgcacttattgagttctagagaacgtacactttcatggtaatagaggattgccataaaaacttacgtcaagtgaaataagccaattattcaacaaaaggtagaacattacttgccattctgtaaagttatgggctgtacctgccccctttgcaatttggaaagcatggtttagaaactacaggcattgtcaagtggccgggtcttttataatttgaataggcataacactgatgtcctctgtgtttccaaaaacatggtttagaaactacaaacattatgacatggccagtcttttacaagttgagtaggcataatactaaagaaaaatacaaagttttgtggccacttattttttgctatgttagtctgcataactgttataaatgtaccatcttttctagagtccagacattatttattttatggctttaaaattttcctgcatagctacaatcctgtggtgtgtcaccataaaggtggaccctgtgtgaatgagaaaattcagttataaattgtaataaaacctgcttactgga

SEQ ID NO: 187557 - DNA, 1065 bp, Homo sapiens
  Payload ID: 16916
  Gene Symbol: SOCS2
  Gene Name: suppressor of cytokine signaling 2
  Uniprot ID: O14508
  ENST ID: ENST00000536696
  CDS Start-End: 451-1047
caagggaggcgcgtcggtctgggaagtcgcgcgcactcgctgctcctgggaccgacgtttaactcttgccaagtctcgtcgcagccgccgcggctggcgggccttgggcttcccctgaagcatgagccctctcgcccgcagccaccctcaccgcgtggcccgcggacagtgcgcgccggggtcccgggtgcacagcctcaggataccccgtgcccgcagctcgggcgcccgcggcaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaa

SEQ ID NO: 187558 - DNA, 2391 bp, Homo sapiens
  Payload ID: 16916
  Gene Symbol: SOCS2
  Gene Name: suppressor of cytokine signaling 2
  Uniprot ID: O14508
  ENST ID: ENST00000549122
  CDS Start-End: 768-1364
gcggctctgccccgcggcctagcgttgctgcctgctttctccagccccttctcggcgtctggaagtgtctggagtttcttttttttatttcccctaaactgccattcaaattaataatcctcctaataacctgatctcccgctcctccccaccggcctgcctcccgccctcgctccttcctccctccctccctctctccttcccacctccagggtcgcagccggagggaaacccggcagcagtccgagagtggaggtgtcccagcccgtagggggcgtcgccgcgcggtgggggatggggtcgaggcaatgatcctcgaggcttttgtgtgccctctgcgcacggaactccgaccgccgcctccgagcgcggggctggttgcatccccgggcatctcgttcccaaattaaacgttaacgggggaaacaagggcagacgcccctcctctcccgggcccctcccacctccccttttccccccacccccccgccccatgtccgctgaggaggctgcctggtgcggaggcggcggcggcggccgcggccgaggtcgaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttctacaa

SEQ ID NO: 187559 - DNA, 744 bp, Homo sapiens
  Payload ID: 16916
  Gene Symbol: SOCS2
  Gene Name: suppressor of cytokine signaling 2
  ENST ID: ENST00000548091
  CDS Start-End: 317-744
cgcagctcggagcgccggggaagagagagtccgaaccgcggctctgccccgcggcctagcgttgctgcctgctttctccagccccttctcggcgtctggaagtgcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagcccc

SEQ ID NO: 187560 - DNA, 984 bp, Homo sapiens
  Payload ID: 16916
  Gene Symbol: SOCS2
  Gene Name: suppressor of cytokine signaling 2
  ENST ID: ENST00000549887
  CDS Start-End: 501-984
gcggccgaggtcgaggtaagagcgcggcgttggtggtttgcattttccgcagcgctcgcgaccgcccgctcggccccggcctcgcctcggagccccgcgagggctgcgcgctcgggccgattcctcgacagcgcccgcggcggcgagaaccaccgcagccatcctggtccgggagcgaccgccgcggcacccccaaccccgccagagcgggcaccaggaagcggggggaggggagcgaggagcctcccgggcggagatgcggcagctcccgcacctccgcaccccgggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccat

SEQ ID NO: 187561 - DNA, 3733 bp, Homo sapiens
  Payload ID: 16916
  Gene Symbol: SOCS2
  Gene Name: suppressor of cytokine signaling 2
  ENST ID: ENST00000548537
  CDS Start-End: 425-733
ggaactccgaccgccgcctccgagcgcggggctggttgcatccccgggcatctcgttcccaaattaaacgttaacgggggaaacaagggcagacgcccctcctctcccgggcccctcccacctccccttttccccccacccccccgccccatgtccgctgaggaggctgcctggtgcggaggcggcggcggcggccgcggccgaggtcgaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggtagggagccgatcggccgcgacgcgtgcgggagggagcgcctccccaaggaagcagctaggaagcggggtcgaggtgggaagcaaagaataagatggaaatacgtcccttgcttccaagggaccgcggagagcacgctcgcagggtcctgggtccttgggaatgcgtaaggaaagtggttctccagggactcaggcctggcggagcgcagagcgcgggaagagcttcttggaaatagcttcttagcacgctggaagatttactgttttccgcagctgctcagggttaggctcccgggctcgaaccccggccggggaaagcgtcgggcgcctccctttgcacggggtgcaatcagcaagtcggtgccgcgggccccgcaggcccagcagcatctggctcccgggcggagctgcggctgcagcccaggatcttggcggccaagttcagggactgacactgccgcgagggcggctgcccgggcgtcgagagtaggctgcgaagcccccgccgagcgcggcttccatggtcggcgcgcccagggtactgccgctttcaagtacagtcaggcaattcgcgcggcacgctgtctctaggcatctgaaaaaagaaaaaagaaaaaaagtaaagtatctggcaaatcattctggctttccaaatccgtatcctaaaagcttacagttgtggcacagttgaaattttggtagcaacagggggagggagagggaaaagttctctcgcttgcgattccggtctttccgtgtgggccacgggctttccctcccggggaggcaccggcagattgcaagtatcccggtaattgtgggggtggggggagcacaaatgttcagacttcttaaatacggacggtctctgagccttcttagaaagcagagtgggccggggagatggtgcaggcagatgaaatcaagaatgcaggggagatggatggttgtgattgggtttggattagggcaaagttcaaaagagtttagggaagattgtaaacttgaagtagtaattatcacttgggaattcccatttcttagtgactggtaaggtagtcataaagcagcgaacagaagctattgtactagagctgtgcttttacaacaagtacatagcagtgctttctacatagaaggctgttcatagcaggctttgcagattctttttttttttttttttttttttttggtggggggcacaccaaccatccaaaaaagttgcttctgtttttactgtagttcaattacaggagttgggttttccactttttaaagggcatggcttttatttctaacttctgatttttttctaatttacctaaatctttattttacttaaataatgttaaaagtgtcatgcttcatcagccagtgtgtcatgctgcagatgttcttttggttcattagaagaaaatcttaagaagagcttcagaaagttgattttttaaaaaagaaagaaaactggctcgccgtttgtgttcataaaatggacccaaatttttattaaattcctactgaaagtatttgtggtggcccggtaaactttcgctcacacaccaccttttttttttttcttttttagagctaaaaaaattattgccaattacttgctctgttctaagaattcttataataactgttttaccctcttttctttttctttttgaacaaaaaccccaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttctacaa

SEQ ID NO: 187562 - DNA, 2072 bp, Homo sapiens
  Payload ID: 16916
  Gene Symbol: SOCS2
  Gene Name: suppressor of cytokine signaling 2
  Uniprot ID: O14508
  ENST ID: ENST00000549206
  CDS Start-End: 481-1077
acctgatcaaggggaccgcctccggtccccggccgtgggcaccgggacgagcacggcgtccccacgccatcgatgtgtcttagagccggagagtctggtttccgaggacccacagtcgctcctgcacgcccaccccccgcaaaagtgcggccaggagggtcgcatcgagggggcgccgccgggatgtttagaggaacccacccccgtggcaggccaagggccaaggatcgctatccttccctgaacccgggcgctcagctggcccgggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaa

SEQ ID NO: 187563 - DNA, 1716 bp, Homo sapiens
  Payload ID: 16916
  Gene Symbol: SOCS2
  Gene Name: suppressor of cytokine signaling 2
  Uniprot ID: O14508
  ENST ID: ENST00000551556
  CDS Start-End: 993-1589
gaggtcgaggtaagagcgcggcgttggtggtttgcattttccgcagcgctcgcgaccgcccgctcggccccggcctcgcctcggagccccgcgagggctgcgcgctcgggccgattcctcgacagcgcccgcggcggcgagaaccaccgcagccatcctggtccgggagcgaccgccgcggcacccccaaccccgccagagcgggcaccaggaagcggggggaggggagcgaggagcctcccgggcggagatgcggcagctcccgcacctccgcaccccgggttggtgcctcggggccccgcagcgctttagggcggagaaccaagtttgtgtgggtgcttcttcctgggggccctcgggctgcgccaggtgtgagaccggaatgccaatttggggaatctctcctgttctttcctttttaattttttctacttgtccttgacaagggcctattcccactggatctgcaggtgactatttgctcttcctaggtcgccagtctttgatttcagctagtgaccctgggcgggaagacaccctgttcaccctcctcctgacctccgccccccacctcttcagccaactttatcttggatctctgctctctttatcttttctctagagctgggccagggcgctaactggaagcttggggttaaatggtgcaggaacgtagaggcggaggagtccctgggattttccacgtctatttccccacccccaccccagccgcaggggtccagtttggactgacccaacctcccgctttctctttgtaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatc

SEQ ID NO: 187564 - DNA, 462 bp, Homo sapiens
  Payload ID: 16916
  Gene Symbol: SOCS2
  Gene Name: suppressor of cytokine signaling 2
  ENST ID: ENST00000547229
  CDS Start-End: 455-462
cgaggagcctcccgggcggagatgcggcagctcccgcacctccgcaccccgggttggtgcctcggggccccgcagcgctttagggcggagaaccaagtttgtgtgggtgcttcttcctgggggccctcgggctgcgccaggtgtgagaccggaatgccaatttggggaatctctcctgttctttcctttttaattttttctacttgtccttgacaagggcctattcccactggatctgcaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccct

SEQ ID NO: 187565 - DNA, 719 bp, Homo sapiens
  Payload ID: 16916
  Gene Symbol: SOCS2
  Gene Name: suppressor of cytokine signaling 2
  ENST ID: ENST00000551883
  CDS Start-End: 1-350
actatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaa

SEQ ID NO: 187566 - DNA, 581 bp, Homo sapiens
  Payload ID: 16916
  Gene Symbol: SOCS2
  Gene Name: suppressor of cytokine signaling 2
  ENST ID: ENST00000549510
  CDS Start-End: 1-140
cagcaccatctctgcagcatctctgtaggctcaccattaacaaatgtaccggtgccatctggggactgcctttaccaacaagactaaaagattacttggaagaatataaattccagccagctgttttttatcctggttagaagaattttgtgttttcttttagctatggatctttgaacattaccctatgatcgaagagttttgagttgggtttttagatgttggttgtcatggagaaacaggaatctggtgtatgccagccatcatcatcatcatcataaccctttggatgaattttcattatcaagggatctggaaggctgtcttcgctctgcttcccagctaacaaacagatgtgttcccagaagatgatgggcatagggtgtgtttttgcaagtcatttttcccatttacgtagattattcttatttccaattgatcctcaatagataagagtgccattgagctttattttcatctgtcaggcaattaagaaaaaagtaaaggaaacaaaaaagctataatatactaaggaaattcttagattctttggtaaaattaaaagaatcttggtgcatgaa

SEQ ID NO: 187567 - DNA, 2881 bp, Homo sapiens
  Payload ID: 16916
  Gene Symbol: SOCS2
  Gene Name: suppressor of cytokine signaling 2
  Uniprot ID: O14508
  ENST ID: ENST00000622746
  CDS Start-End: 720-1316
gcttttgtgtgccctctgcgcacggaactccgaccgccgcctccgagcgcggggctggttgcatccccgggcatctcgttcccaaattaaacgttaacgggggaaacaagggcagacgcccctcctctcccgggcccctcccacctccccttttccccccacccccccgccccatgtccgctgaggaggctgcctggtgcggaggcggcggcggcggccgcggccgaggtcgaggtaagagcgcggcgttggtggtttgcattttccgcagcgctcgcgaccgcccgctcggccccggcctcgcctcggagccccgcgagggctgcgcgctcgggccgattcctcgacagcgcccgcggcggcgagaaccaccgcagccatcctggtccgggagcgaccgccgcggcacccccaaccccgccagagcgggcaccaggaagcggggggaggggagcgaggagcctcccgggcggagatgcggcagctcccgcacctccgcaccccgggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttctacaagttgcacttattgagttctagagaacgtacactttcatggtaatagaggattgccataaaaacttacgtcaagtgaaataagccaattattcaacaaaaggtagaacattacttgccattctgtaaagttatgggctgtacctgccccctttgcaatttggaaagcatggtttagaaactacaggcattgtcaagtggccgggtcttttataatttgaataggcataacactgatgtcctctgtgtttccaaaaacatggtttagaaactacaaacattatgacatggccagtcttttacaagttgagtaggcataatactaaagaaaaatacaaagttttgtggccacttattttttgctatgttagtctgcataactgttataaatgtaccatcttttctagagtccagacattatttattttatggctttaaaattttcctgcatagctacaatcctgtggtgtgtcaccataaaggtggaccctgtgtgaatgagaaaattcagttataaattgtaataaaacctgcttactgg

SEQ ID NO: 187568 - DNA, 2734 bp, Homo sapiens
  Payload ID: 16917
  Gene Symbol: SOCS3
  Gene Name: suppressor of cytokine signaling 3
  Uniprot ID: O14543
  ENST ID: ENST00000330871
  CDS Start-End: 417-1094
ggctccgacttggactccctgctccgctgctgccgcttcggccccgcacgcagccagccgccagccgcccgcccggcccagctcccgccgcggccccttgccgcggtccctctcctggtcccctcccggttggtccgggggtgcgcagggggcagggcgggcgcccaggggaagctcgagggacgcgcgcgcgaaggctcctttgtggacttcacggccgccaacatctgggcgcagcgcgggccaccgctggccgtctcgccgccgcgtcgccttggggacccgagggggctcagccccaaggacggagacttcgattcgggaccagccccccgggatgcggtagcggccgctgtgcggaggccgcgaagcagctgcagccgccgccgcgcagatccacgctggctccgtgcgccatggtcacccacagcaagtttcccgccgccgggatgagccgccccctggacaccagcctgcgcctcaagaccttcagctccaagagcgagtaccagctggtggtgaacgcagtgcgcaagctgcaggagagcggcttctactggagcgcagtgaccggcggcgaggcgaacctgctgctcagtgccgagcccgccggcacctttctgatccgcgacagctcggaccagcgccacttcttcacgctcagcgtcaagacccagtctgggaccaagaacctgcgcatccagtgtgaggggggcagcttctctctgcagagcgatccccggagcacgcagcccgtgccccgcttcgactgcgtgctcaagctggtgcaccactacatgccgccccctggagccccctccttcccctcgccacctactgaaccctcctccgaggtgcccgagcagccgtctgcccagccactccctgggagtccccccagaagagcctattacatctactccgggggcgagaagatccccctggtgttgagccggcccctctcctccaacgtggccactcttcagcatctctgtcggaagaccgtcaacggccacctggactcctatgagaaagtcacccagctgccggggcccattcgggagttcctggaccagtacgatgccccgctttaaggggtaaagggcgcaaagggcatgggtcgggagaggggacgcaggcccctctcctccgtggcacatggcacaagcacaagaagccaaccaggagagagtcctgtagctctggggggaaagagggcggacaggcccctccctctgccctctccctgcagaatgtggcaggcggacctggaatgtgttggagggaagggggagtaccacctgagtctccagcttctccggaggagccagctgtcctggtgggacgatagcaaccacaagtggattctccttcaattcctcagcttcccctctgcctccaaacaggggacacttcgggaatgctgaactaatgagaactgccagggaatcttcaaactttccaacggaacttgtttgctctttgatttggtttaaacctgagctggttgtggagcctgggaaaggtggaagagagagaggtcctgagggccccagggctgcgggctggcgaaggaaatggtcacaccccccgcccaccccaggcgaggatcctggtgacatgctcctctccctggctccggggagaagggcttggggtgacctgaagggaaccatcctggtaccccacatcctctcctccgggacagtcaccgaaaacacaggttccaaagtctacctggtgcctgagagcccagggcccttcctccgttttaagggggaagcaacatttggaggggatggatgggctggtcagctggtctccttttcctactcatactataccttcctgtacctgggtggatggagcgggaggatggaggagacgggacatctttcacctcaggctcctggtagagaagacaggggattctactctgtgcctcctgactatgtctggctaagagattcgccttaaatgctccctgtcccatggagagggacccagcataggaaagccacatactcagcctggatgggtggagaggctgagggactcactggagggcaccaagccagcccacagccagggaagtggggagggggggcggaaacccatgcctcccagctgagcactgggaatgtcagcccagtaagtattggccagtcaggcgcctcgtggtcagagcagagccaccaggtcccactgccccgagccctgcacagccctccctcctgcctgggtgggggaggctggaggtcattggagaggctggactgctgccaccccgggtgctcccgctctgccatagcactgatcagtgacaatttacaggaatgtagcagcgatggaattacctggaacagttttttgtttttgtttttgtttttgtttttgtgggggggggcaactaaacaaacacaaagtattctgtgtcaggtattgggctggacagggcagttgtgtgttggggtggtttttttctctatttttttgtttgtttcttgttttttaataatgtttacaatctgcctcaatcactctgtcttttataaagattccacctccagtcctctctcctcccccctactcaggcccttgaggctattaggagatgcttgaagaactcaacaaaatcccaatccaagtcaaactttgcacatatttatatttatattcagaaaagaaacatttcagtaatttataataaagagcactattttttaatgaaaaa

SEQ ID NO: 187569 - DNA, 361 bp, Homo sapiens
  Payload ID: 16917
  Gene Symbol: SOCS3
  Gene Name: suppressor of cytokine signaling 3
  ENST ID: ENST00000587578
  CDS Start-End: 315-361
tccgacttggactccctgctccgctgctgccgcttcggccccgcacgcagccagccgccagccgcccgcccggcccagctcccgccgcggccccttgccgcggtccctctcctggtcccctcccggttggtccgggggtgcgcagggggcagggcgggcgcccaggggaagctcgagggacgcgcgcgcgaaggctcctttgtggacttcacggccgccaacatctgggcgcagcgcgggccaccgctggccgtctcgccgccgcgaagcagctgcagccgccgccgcgcagatccacgctggctccgtgcgccatggtcacccacagcaagtttcccgccgccgggatgagccgccccct

SEQ ID NO: 187570 - DNA, 6667 bp, Homo sapiens
  Payload ID: 16918
  Gene Symbol: SOCS4
  Gene Name: suppressor of cytokine signaling 4
  Uniprot ID: Q8WXH5
  ENST ID: ENST00000339298
  CDS Start-End: 223-1545
tctggaaaagaaggcgagatcttctagagcctctaatcttggcatccttcgtgccctcaccttgtcgcttctgtagagataaagaaggaatgacttaatttctgttccggttggttctcttggtacctgaagatacatccagaaagtgcccagaagaaacttcctgctggaaaaaatgaaaaagcagtatttataacattagaatctggataatttgttaacatggcagaaaataatgaaaatattagtaaaaatgtagatgtaaggcccaaaactagtcggagcagaagtgccgacagaaaagacggttatgtgtggagtggaaagaagttatcttggtcaaaaaagagtgagagttattcagatgctgagacagtgaatggtatagagaaaaccgaagtgtctttaaggaaccaagaaaggaagcacagctgttcatccattgagttggacttagatcattcctgtgggcatcgatttttaggccgatctcttaaacagaaactgcaagatgccgtggggcagtgttttccaataaagaattgtagtagtcggcactcttcagggcttccgtctaaaaggaaaattcatatcagtgaactcatgttagataagtgtcctttcccacctcgatcagatttagcctttaggtggcattttattaaacgacacactgctcctataaattccaaatcagatgaatgggtaagcacagacttgtctcagactgaattgagggatggtcagctaaaacgaagaaatatggaagaaaatataaactgtttctcacataccaatgttcagccctgtgtcataaccaccgacaatgctttgtgtagagaaggtcctatgactggctctgtgatgaacctggtttcaaataacagtatagaagatagtgatatggattccgatgatgaaattctaacactttgcacaagttccagaaaaagaaacaaacccaaatgggatttggatgatgaaatcctgcagttggaaacacctcctaaataccacacgcagattgattatgtccactgtcttgtaccagacctccttcagatcaataacaacccatgttactggggagtgatggataaatacgcagccgaagcactactggaaggaaaaccagagggtacctttttacttcgagactcagcacaggaagactatttattctctgttagttttagacgctatagtcgttctcttcatgctagaattgaacagtggaatcacaactttagctttgatgcacatgacccctgtgtcttccattctcctgacattactgggctcctagaacattataaggacccaagcgcctgtatgttctttgaaccacttctatccactcccttaattcggactttccctttttccctgcagcatatatgcagaacagttatttgtaactgtacaacttatgatggcatcgatgcccttccaattccttcttctatgaaattatatctgaaggaatatcattataaatcaaaagttagagtactcaggattgatgcaccagaacagcaatgctagtaacaggatgggaacatgggaatgataatatatattttttcttttaatattttatttttctttttatgccactttggatttttctacaaaggcagtggtgtccaaaataaaatctctgccctaaattttactaataaatccatttttctagtgatacacaaattgtttaaggttatacactcgagcttaaatagatatttttaaccaggtgtttggtttttgtttttaccgtgtaggttgtatacttacattttttctttccttaatttatacatgatcctttttccttaatttatacatgatccaggcacatttgaaatttggtaggcattgcaaacacatttgaatattgtgtatttcatactattctttaaaagtaatcttatgtcctttcctacatgtaaaatattttgttaatctatgccattagtagtattatatataaaatatagttccccgtcccccttttcattgagtttgatattcttcagtaaagctgaatgttgtaattcaccattcatactaatgttattgacttttgtaacttactaatagggatgttaaaagtaacaaaaccaagtcaaacttggtgtatttttattttaaatattaactctaaagcaggattactaaatttgattaatctggtcaatgagaatcaaatggaaacatatcattctggaggtgcacttactcttctacaatgtggccggatcatttgtcattcctgaataggtctttctctcaacctgcaagagctaaaccatcttcaaaacataaatcttgttcctttctcattggaagctttgaaaataatgataacactattagtagctagtagttactaaagtgctaaagtaattgtggggtttttctgtattagcttatgaactgttgcttctacttagcccttttatagaaactctgagctgttactttggggaaattccacaatgtattagcagccacaaatttccactggtaaccaaagagtacctaagtagtttttcattattttaagttgaatttgaataaagattccagaaataaacatggagctcagtattcaggaagcttaatactgtttttgatctacaagatccaaataattatccctatcttcagaattaacttagtctgtaatgtggcttcaaaaaaagaaagccttttgacagctacatgacttacaccatacagaacagtactggacaaaaggggtgatattttaaatttactatcccagaaacagggcaacgtttttagaaacatctttagcccaaagtaactagtaaaaataaatggagtggtatcctatcttctttttttaaggaatcaatgaataataaatgtagatagacaattttcttctggtgagctgtctaaccctttgtacacattgacatttttaatatcgtaactgatttcttgatgctagtttagctatattaggaaactgcttctacctagattgaaagaaatttgactcataaacttccaagttagaacaaatatttcttcattattgttgcttttatgtgagtagcatttccctatcttgcagttctgttaacatgaaaatggcatttttccataatagctttaaaataattttttagtaattattacaaaattaaggaaaatctctattaccgttatcttttagcattttttttttcctcagtgatctcaagattgtcttagtctcaatgagatgtagctacaaaaatggcacctcttagcagtgatgaggctcaggatatcggatatcataacaccaatgtcaggataaatatctcttctaaagacgatatttaccttttacaaggttagaaaagtctcatactacctcatctttattgtggcgcttttgtagatcactgagaagcttatcttattaaccaatataccacttcctaaatatccatctttggtgaaagaaaatagtgtggtaagagtacccatgattatagttttttatcagaatttgataagattttctgtttctgtgaaacaattattttaaatatttttcttttaaaaataactttttatcagtacagaaaaacctaagggatgactagcttacaaatattctgttaaggggtagttttataaagaaaaatgatatatagttatgttgtcttttatagtgttaaaattagtatttatatgaaagtcaagatctaagtaccttttcatataattcaaactgattgcttgtgatatgttttctctggcttttttattttttcaacttcaaggtattaacagctgttaacacttaaaaagtactgccacatatgtagccttgaagtagttgatctaataaatgagagcagggaggagattcattgactctgaaatgatttttatttttcctttggtatttgctacagtgaaaagaagtttggaaagtagatacataaagacttgagaagggaattgtttaagggaaaagaaaagagtaataattttttttaaaacattaaggaattggaattcagaaaggttacccccttcctctgtgtctttgtaaggatacatttggaagaacatacagtattcagaaactaacctatataaaatgtaaacaatatattgattgcactatataaatgagtaaattttgagaggaacaatgtgggaatgtataaatttgtctaaaattttataactgttgaacaaagggaagatttgaacagtgtaaattccagagttgagaaagcatttagcatggtggaaatgtggagagcttattggtgagagaggatggagctaagagaaataagatcaaatattaaaattaggaatttaggcattacctcagggaaaagccttgacagtgaaaagaaactacttaatcgctaatagctagtctggaccagacacttaactgcgctttgggaatcatcctgggctaatcaggaaataaacttgacttttctatttttctctgaagctttacaggacatactcccactcccatttttttctaagcctacagcatcttgattcatagtataattcctgaagtatgctgaatggactttttaaggttcctttagcatttttgtatagagttatatgtgatctttctataaccatgccattcacttaaataattcatgaagggaatggtttaatttaaaggaagacctaataggaagaagattaaaggaagcttttagtcagcctgtggctagatttattgatttggtgatcaaacctgtgctatttcctgaatttcagctaatggccaactgtggtcaaagaatggctttcagttaaagttttgacttcttattataaataatataaagaatgtctcagtaattagaaatcccttaataagtagaacaaatgtggcaagtaggactcctatcggtatacaaattccatttctttttataagaaaaacacataaaccattatcatttattcatgagccaaagccattaagaagataaatccagttatcagcttcctgtctctgaagtttggatcattttatagatccacgcaatagagagcttccttcctatgaaacaaaaaccttgagatctctttttttttgagacagagtctcgctgttgtcagcccaggctggagtgcaatggcgcaatctcggttcactgcaacctctgccttccaggttccagcaattctcctacctcagctcccaagtagctgagatgacaggcgtgtgccaccacgcccagctaatttttgtatttttagtagcgatggtgtttcactacattggccaggctggtctcgaactcctgacctcaggtgaccacccgcctcagcctcccaaagtgctgggattacaggcatgagccactgtgcccggccaagatctaactcacgcttacttttcattaaaatatttcttgtcgcttttagctattgtcagaatccaataaacagcttacgcattcattttggtaaagcaaatttcacaggaaaatagacaaaattataagagattcctggagacaacacaaggaaaacaatgtttaaaagcaaaatagcctgtgtaatgttaggtaatgtaatgcccaagtgaataaaagatttttcgtcaagcaaactactgtttctactttgggggaaaaaagtcagttttacatttgtaatttaaggaaagaacagaaagcacaaaggtttttcttttctttattaatggcctactagaaatgagcagtgcaagagtctacctgtactattctaatacagtaagatattggacacaaaatggaggtaactttttaaaatagattggcttggaagttgaaatgtagattaatggatataacccaatagaaagggattttcaaataaaaccaaagtctatttttttatttactttctaattttgaacagatgactcagtcctaaatctttgcctttatttcctataaaatgtaggtgatacttgtaactcgacttcctggagttaattcttcagcaagaggtgaccctgggagcgtactttaaaataattgctgtacagccattgagtactaacatgatgataggttttcaaaatatctttgtagtggatgctgcataattacattcacttctcttagactgtaaaagactttcttgacttgttttaacagtagagatagcagtacaatttgaatttatggtttaggctctgcaattagaggaacaattgcagtttcctcctacccttcatatggtctgtgtaaaactgatgtttgcttaacttattttaaaagttgattacgttttcagaaaataaagataatcacttttgccatggttataatcaaatctaagctttcagacttgagagccatggtgtaaaactcaaggaggtttatttaaattatgctgactttgctagaattggataaattctgtataagccaagtatgagttcacatgtactcgaatatacagttttcacaaagctattactctcatcagtcaggcttgtatgatctattccttaccacaaaagaagtagacaattgccacttttatttctaatccttaagttgaatgtttcttcttggatgtaagttcaaataaattgatctggataaattttcatttctacttaattaaaacttcctatgtaaaatcc

SEQ ID NO: 187571 - DNA, 6779 bp, Homo sapiens
  Payload ID: 16918
  Gene Symbol: SOCS4
  Gene Name: suppressor of cytokine signaling 4
  Uniprot ID: Q8WXH5
  ENST ID: ENST00000395472
  CDS Start-End: 333-1655
ctgaacacggaagtggtggcggcgcccagggaaccggcggaggcgatgaccgtgacggctgggttgggaccggaacgccgaagcggggttgggggtggcagaaaagcatctgctttgtaagacctacacgaggtgcaggagtggttgggcctcccctctccacttaagcaagcgcccagactgatggcgatggtgatggcagcagttactcgcacaaccccagttaagctgcgctccgggagatacatccagaaagtgcccagaagaaacttcctgctggaaaaaatgaaaaagcagtatttataacattagaatctggataatttgttaacatggcagaaaataatgaaaatattagtaaaaatgtagatgtaaggcccaaaactagtcggagcagaagtgccgacagaaaagacggttatgtgtggagtggaaagaagttatcttggtcaaaaaagagtgagagttattcagatgctgagacagtgaatggtatagagaaaaccgaagtgtctttaaggaaccaagaaaggaagcacagctgttcatccattgagttggacttagatcattcctgtgggcatcgatttttaggccgatctcttaaacagaaactgcaagatgccgtggggcagtgttttccaataaagaattgtagtagtcggcactcttcagggcttccgtctaaaaggaaaattcatatcagtgaactcatgttagataagtgtcctttcccacctcgatcagatttagcctttaggtggcattttattaaacgacacactgctcctataaattccaaatcagatgaatgggtaagcacagacttgtctcagactgaattgagggatggtcagctaaaacgaagaaatatggaagaaaatataaactgtttctcacataccaatgttcagccctgtgtcataaccaccgacaatgctttgtgtagagaaggtcctatgactggctctgtgatgaacctggtttcaaataacagtatagaagatagtgatatggattccgatgatgaaattctaacactttgcacaagttccagaaaaagaaacaaacccaaatgggatttggatgatgaaatcctgcagttggaaacacctcctaaataccacacgcagattgattatgtccactgtcttgtaccagacctccttcagatcaataacaacccatgttactggggagtgatggataaatacgcagccgaagcactactggaaggaaaaccagagggtacctttttacttcgagactcagcacaggaagactatttattctctgttagttttagacgctatagtcgttctcttcatgctagaattgaacagtggaatcacaactttagctttgatgcacatgacccctgtgtcttccattctcctgacattactgggctcctagaacattataaggacccaagcgcctgtatgttctttgaaccacttctatccactcccttaattcggactttccctttttccctgcagcatatatgcagaacagttatttgtaactgtacaacttatgatggcatcgatgcccttccaattccttcttctatgaaattatatctgaaggaatatcattataaatcaaaagttagagtactcaggattgatgcaccagaacagcaatgctagtaacaggatgggaacatgggaatgataatatatattttttcttttaatattttatttttctttttatgccactttggatttttctacaaaggcagtggtgtccaaaataaaatctctgccctaaattttactaataaatccatttttctagtgatacacaaattgtttaaggttatacactcgagcttaaatagatatttttaaccaggtgtttggtttttgtttttaccgtgtaggttgtatacttacattttttctttccttaatttatacatgatcctttttccttaatttatacatgatccaggcacatttgaaatttggtaggcattgcaaacacatttgaatattgtgtatttcatactattctttaaaagtaatcttatgtcctttcctacatgtaaaatattttgttaatctatgccattagtagtattatatataaaatatagttccccgtcccccttttcattgagtttgatattcttcagtaaagctgaatgttgtaattcaccattcatactaatgttattgacttttgtaacttactaatagggatgttaaaagtaacaaaaccaagtcaaacttggtgtatttttattttaaatattaactctaaagcaggattactaaatttgattaatctggtcaatgagaatcaaatggaaacatatcattctggaggtgcacttactcttctacaatgtggccggatcatttgtcattcctgaataggtctttctctcaacctgcaagagctaaaccatcttcaaaacataaatcttgttcctttctcattggaagctttgaaaataatgataacactattagtagctagtagttactaaagtgctaaagtaattgtggggtttttctgtattagcttatgaactgttgcttctacttagcccttttatagaaactctgagctgttactttggggaaattccacaatgtattagcagccacaaatttccactggtaaccaaagagtacctaagtagtttttcattattttaagttgaatttgaataaagattccagaaataaacatggagctcagtattcaggaagcttaatactgtttttgatctacaagatccaaataattatccctatcttcagaattaacttagtctgtaatgtggcttcaaaaaaagaaagccttttgacagctacatgacttacaccatacagaacagtactggacaaaaggggtgatattttaaatttactatcccagaaacagggcaacgtttttagaaacatctttagcccaaagtaactagtaaaaataaatggagtggtatcctatcttctttttttaaggaatcaatgaataataaatgtagatagacaattttcttctggtgagctgtctaaccctttgtacacattgacatttttaatatcgtaactgatttcttgatgctagtttagctatattaggaaactgcttctacctagattgaaagaaatttgactcataaacttccaagttagaacaaatatttcttcattattgttgcttttatgtgagtagcatttccctatcttgcagttctgttaacatgaaaatggcatttttccataatagctttaaaataattttttagtaattattacaaaattaaggaaaatctctattaccgttatcttttagcattttttttttcctcagtgatctcaagattgtcttagtctcaatgagatgtagctacaaaaatggcacctcttagcagtgatgaggctcaggatatcggatatcataacaccaatgtcaggataaatatctcttctaaagacgatatttaccttttacaaggttagaaaagtctcatactacctcatctttattgtggcgcttttgtagatcactgagaagcttatcttattaaccaatataccacttcctaaatatccatctttggtgaaagaaaatagtgtggtaagagtacccatgattatagttttttatcagaatttgataagattttctgtttctgtgaaacaattattttaaatatttttcttttaaaaataactttttatcagtacagaaaaacctaagggatgactagcttacaaatattctgttaaggggtagttttataaagaaaaatgatatatagttatgttgtcttttatagtgttaaaattagtatttatatgaaagtcaagatctaagtaccttttcatataattcaaactgattgcttgtgatatgttttctctggcttttttattttttcaacttcaaggtattaacagctgttaacacttaaaaagtactgccacatatgtagccttgaagtagttgatctaataaatgagagcagggaggagattcattgactctgaaatgatttttatttttcctttggtatttgctacagtgaaaagaagtttggaaagtagatacataaagacttgagaagggaattgtttaagggaaaagaaaagagtaataattttttttaaaacattaaggaattggaattcagaaaggttacccccttcctctgtgtctttgtaaggatacatttggaagaacatacagtattcagaaactaacctatataaaatgtaaacaatatattgattgcactatataaatgagtaaattttgagaggaacaatgtgggaatgtataaatttgtctaaaattttataactgttgaacaaagggaagatttgaacagtgtaaattccagagttgagaaagcatttagcatggtggaaatgtggagagcttattggtgagagaggatggagctaagagaaataagatcaaatattaaaattaggaatttaggcattacctcagggaaaagccttgacagtgaaaagaaactacttaatcgctaatagctagtctggaccagacacttaactgcgctttgggaatcatcctgggctaatcaggaaataaacttgacttttctatttttctctgaagctttacaggacatactcccactcccatttttttctaagcctacagcatcttgattcatagtataattcctgaagtatgctgaatggactttttaaggttcctttagcatttttgtatagagttatatgtgatctttctataaccatgccattcacttaaataattcatgaagggaatggtttaatttaaaggaagacctaataggaagaagattaaaggaagcttttagtcagcctgtggctagatttattgatttggtgatcaaacctgtgctatttcctgaatttcagctaatggccaactgtggtcaaagaatggctttcagttaaagttttgacttcttattataaataatataaagaatgtctcagtaattagaaatcccttaataagtagaacaaatgtggcaagtaggactcctatcggtatacaaattccatttctttttataagaaaaacacataaaccattatcatttattcatgagccaaagccattaagaagataaatccagttatcagcttcctgtctctgaagtttggatcattttatagatccacgcaatagagagcttccttcctatgaaacaaaaaccttgagatctctttttttttgagacagagtctcgctgttgtcagcccaggctggagtgcaatggcgcaatctcggttcactgcaacctctgccttccaggttccagcaattctcctacctcagctcccaagtagctgagatgacaggcgtgtgccaccacgcccagctaatttttgtatttttagtagcgatggtgtttcactacattggccaggctggtctcgaactcctgacctcaggtgaccacccgcctcagcctcccaaagtgctgggattacaggcatgagccactgtgcccggccaagatctaactcacgcttacttttcattaaaatatttcttgtcgcttttagctattgtcagaatccaataaacagcttacgcattcattttggtaaagcaaatttcacaggaaaatagacaaaattataagagattcctggagacaacacaaggaaaacaatgtttaaaagcaaaatagcctgtgtaatgttaggtaatgtaatgcccaagtgaataaaagatttttcgtcaagcaaactactgtttctactttgggggaaaaaagtcagttttacatttgtaatttaaggaaagaacagaaagcacaaaggtttttcttttctttattaatggcctactagaaatgagcagtgcaagagtctacctgtactattctaatacagtaagatattggacacaaaatggaggtaactttttaaaatagattggcttggaagttgaaatgtagattaatggatataacccaatagaaagggattttcaaataaaaccaaagtctatttttttatttactttctaattttgaacagatgactcagtcctaaatctttgcctttatttcctataaaatgtaggtgatacttgtaactcgacttcctggagttaattcttcagcaagaggtgaccctgggagcgtactttaaaataattgctgtacagccattgagtactaacatgatgataggttttcaaaatatctttgtagtggatgctgcataattacattcacttctcttagactgtaaaagactttcttgacttgttttaacagtagagatagcagtacaatttgaatttatggtttaggctctgcaattagaggaacaattgcagtttcctcctacccttcatatggtctgtgtaaaactgatgtttgcttaacttattttaaaagttgattacgttttcagaaaataaagataatcacttttgccatggttataatcaaatctaagctttcagacttgagagccatggtgtaaaactcaaggaggtttatttaaattatgctgactttgctagaattggataaattctgtataagccaagtatgagttcacatgtactcgaatatacagttttcacaaagctattactctcatcagtcaggcttgtatgatctattccttaccacaaaagaagtagacaattgccacttttatttctaatccttaagttgaatgtttcttcttggatgtaagttcaaataaattgatctggataaattttcatttctacttaattaaaacttcctatgtaaaatccaa

SEQ ID NO: 187572 - DNA, 4110 bp, Homo sapiens
  Payload ID: 16918
  Gene Symbol: SOCS4
  Gene Name: suppressor of cytokine signaling 4
  Uniprot ID: Q8WXH5
  ENST ID: ENST00000555846
  CDS Start-End: 444-1766
gcggcgcccagggaaccggcggaggcgatgaccgtgacggctgggttgggaccggaacgccgaagcggggttgggggtggcagaaaagcatctgctttgtaagacctacacgaggtgcaggagtggttgggcctcccctctccacttaagcaagcgcccagactgatggcgatggtgatggcagcagttactcgcacaaccccagttaagctgcgctccgggaggagttcatctgttgtctgctctccagtgacttccgtttgtggagcctaagtgtttctacagaatccaactcaaatatcaaggactatgatcagaatgctttcaaggagtttttgggcacatgatggcagatacatccagaaagtgcccagaagaaacttcctgctggaaaaaatgaaaaagcagtatttataacattagaatctggataatttgttaacatggcagaaaataatgaaaatattagtaaaaatgtagatgtaaggcccaaaactagtcggagcagaagtgccgacagaaaagacggttatgtgtggagtggaaagaagttatcttggtcaaaaaagagtgagagttattcagatgctgagacagtgaatggtatagagaaaaccgaagtgtctttaaggaaccaagaaaggaagcacagctgttcatccattgagttggacttagatcattcctgtgggcatcgatttttaggccgatctcttaaacagaaactgcaagatgccgtggggcagtgttttccaataaagaattgtagtagtcggcactcttcagggcttccgtctaaaaggaaaattcatatcagtgaactcatgttagataagtgtcctttcccacctcgatcagatttagcctttaggtggcattttattaaacgacacactgctcctataaattccaaatcagatgaatgggtaagcacagacttgtctcagactgaattgagggatggtcagctaaaacgaagaaatatggaagaaaatataaactgtttctcacataccaatgttcagccctgtgtcataaccaccgacaatgctttgtgtagagaaggtcctatgactggctctgtgatgaacctggtttcaaataacagtatagaagatagtgatatggattccgatgatgaaattctaacactttgcacaagttccagaaaaagaaacaaacccaaatgggatttggatgatgaaatcctgcagttggaaacacctcctaaataccacacgcagattgattatgtccactgtcttgtaccagacctccttcagatcaataacaacccatgttactggggagtgatggataaatacgcagccgaagcactactggaaggaaaaccagagggtacctttttacttcgagactcagcacaggaagactatttattctctgttagttttagacgctatagtcgttctcttcatgctagaattgaacagtggaatcacaactttagctttgatgcacatgacccctgtgtcttccattctcctgacattactgggctcctagaacattataaggacccaagcgcctgtatgttctttgaaccacttctatccactcccttaattcggactttccctttttccctgcagcatatatgcagaacagttatttgtaactgtacaacttatgatggcatcgatgcccttccaattccttcttctatgaaattatatctgaaggaatatcattataaatcaaaagttagagtactcaggattgatgcaccagaacagcaatgctagtaacaggatgggaacatgggaatgataatatatattttttcttttaatattttatttttctttttatgccactttggatttttctacaaaggcagtggtgtccaaaataaaatctctgccctaaattttactaataaatccatttttctagtgatacacaaattgtttaaggttatacactcgagcttaaatagatatttttaaccaggtgtttggtttttgtttttaccgtgtaggttgtatacttacattttttctttccttaatttatacatgatcctttttccttaatttatacatgatccaggcacatttgaaatttggtaggcattgcaaacacatttgaatattgtgtatttcatactattctttaaaagtaatcttatgtcctttcctacatgtaaaatattttgttaatctatgccattagtagtattatatataaaatatagttccccgtcccccttttcattgagtttgatattcttcagtaaagctgaatgttgtaattcaccattcatactaatgttattgacttttgtaacttactaatagggatgttaaaagtaacaaaaccaagtcaaacttggtgtatttttattttaaatattaactctaaagcaggattactaaatttgattaatctggtcaatgagaatcaaatggaaacatatcattctggaggtgcacttactcttctacaatgtggccggatcatttgtcattcctgaataggtctttctctcaacctgcaagagctaaaccatcttcaaaacataaatcttgttcctttctcattggaagctttgaaaataatgataacactattagtagctagtagttactaaagtgctaaagtaattgtggggtttttctgtattagcttatgaactgttgcttctacttagcccttttatagaaactctgagctgttactttggggaaattccacaatgtattagcagccacaaatttccactggtaaccaaagagtacctaagtagtttttcattattttaagttgaatttgaataaagattccagaaataaacatggagctcagtattcaggaagcttaatactgtttttgatctacaagatccaaataattatccctatcttcagaattaacttagtctgtaatgtggcttcaaaaaaagaaagccttttgacagctacatgacttacaccatacagaacagtactggacaaaaggggtgatattttaaatttactatcccagaaacagggcaacgtttttagaaacatctttagcccaaagtaactagtaaaaataaatggagtggtatcctatcttctttttttaaggaatcaatgaataataaatgtagatagacaattttcttctggtgagctgtctaaccctttgtacacattgacatttttaatatcgtaactgatttcttgatgctagtttagctatattaggaaactgcttctacctagattgaaagaaatttgactcataaacttccaagttagaacaaatatttcttcattattgttgcttttatgtgagtagcatttccctatcttgcagttctgttaacatgaaaatggcatttttccataatagctttaaaataattttttagtaattattacaaaattaaggaaaatctctattaccgttatcttttagcattttttttttcctcagtgatctcaagattgtcttagtctcaatgagatgtagctacaaaaatggcacctcttagcagtgatgaggctcaggatatcggatatcataacaccaatgtcaggataaatatctcttctaaagacgatatttaccttttacaaggttagaaaagtctcatactacctcatctttattgtggcgcttttgtagatcactgagaagcttatcttattaaccaatataccacttcctaaatatccatctttggtgaaagaaaatagtgtggtaagagtacccatgattatagttttttatcagaatttgataagattttctgtttctgtgaaacaattattttaaatatttttcttttaaaaataactttttatcagtacagaaaaacctaagggatgactagcttacaaatattctgttaaggggtagttttataaagaaaaatgatatatagttatgttgtcttttatagtgttaaaattagtatttatatgaaagtcaagatctaagtaccttttcatataattcaaactgattgcttgtgatatgttttctctggcttttttattttttcaacttcaaggtattaacagctgttaacacttaaaaagtactgccacatatgtagccttgaagtagttgatctaataaatgagagcagggagg

SEQ ID NO: 187573 - DNA, 4771 bp, Homo sapiens
  Payload ID: 16919
  Gene Symbol: SOCS5
  Gene Name: suppressor of cytokine signaling 5
  Uniprot ID: O75159
  ENST ID: ENST00000306503
  CDS Start-End: 173-1783
ggcagccgcgcagagcgcgcacccaagcggccggacctccccgactcccgggccgcccccgtctcgcgccctgcctccctccttcggccttcacctacccgcctccggattggccgctaggaatcccgcccctctaaagccctgcctgctattggtcacgattttataatcaatggataaagtgggaaaaatgtggaataacttcaaatacaggtgtcagaatctcttcggtcatgagggaggaagccgtagtgaaaatgtggacatgaactccaacagatgtttgtctgtcaaagagaaaaacatcagcataggagactcaactcctcagcaacaaagcagtcccttaagagaaaatattgccttacaactgggattaagcccttcgaagaattcttcaaggagaaatcaaaattgtgccacagaaatccctcaaattgttgaaataagcatcgaaaaggataatgattcttgtgttaccccaggaacaagacttgcacgaagagattcctactctcgacatgctccatggggtgggaagaaaaaacattcctgttctacaaagacccagagttcattggatgctgataaaaagtttggtagaactcgaagtggacttcaaaggagagagaggcgctacggcgtaagttctgtacacgacatggacagtgtttccagcagaactgtaggaagtcgctctctaagacagaggttgcaggatactgtgggcttgtgttttcccatgagaacttacagcaagcagtcaaagcctctcttttccaataaaagaaaaatccatctctctgaattaatgcttgagaaatgcccttttcctgctggctcagatttagcccaaaaatggcatttgattaaacagcatacagctcctgtgagcccacattcaacattttttgatacatttgatccatctttggtttctacagaagatgaagaagataggcttagagagagaaggcggcttagtattgaagaaggggttgatccccctcccaatgcacaaatacatacatttgaagctactgcacaggttaatccattatataaactgggaccaaaattagctcctggaatgactgaaataagtggggacagttctgcaattccacaagctaattgtgactcggaagaggatacaaccaccctgtgtttgcagtcacggaggcagaagcagcgtcagatatctggagacagccatacccatgttagcagacagggagcttggaaagtccacacacagattgattacatacactgcctcgtgcctgatttgcttcaaattacagggaatccctgttactggggagtgatggaccgttatgaagcagaagcccttctcgaagggaaacctgaaggcacgtttttgctcagggactctgcgcaagaggactacctcttctctgtgagcttccgccgctacaacagatccctgcatgcccgaattgagcagtggaatcacaactttagtttcgacgcccatgacccgtgtgtatttcactcctccactgtaacgggacttttagaacattataaagatcccagttcgtgcatgttttttgaaccattgcttactatatcactaaataggactttcccttttagcctgcagtatatctgtcgcgcggtaatctgcaggtgcactacgtatgatggaattgatgggctccctctaccctcaatgttacaggattttttaaaagagtatcattataaacaaaaagttagagttcgctggttggaacgagaaccagtcaaggcaaagtaaactctccggtccccaaaggttgttaactaggtccgctttcatgtgcatcagacagtacacctatagcaagcacacgtagcagtgttaggctttttcatacagtatgtaagcttagtgttagtatctgtcagatgctacctgctgttacttattcagataaacatggtgcctattggaacaatagcggatagagctacaggtgttcagtaagactacaaaaacattttgcctatttcgctaacagtttggtttttaatggctgtggtatttgagtgaggcaactctggggcatttgttatgaagaattctatttcttactgaagaacaaattattaatattggatgagtatttcaacagtgtgactaatgtttgaaattattttttctaagagtttttctataaccttccaaaagtcgtgatgtttgtagttactataaatcaagctttggaagtccaaaaagaataaaagactgccttccttttagaaaaaaatgcaattttctggccacaagggcatagtgcagttcacttacgtgttgatgtagtttataatcagacgccttttctcttctgcaaaaggtactgttaagtaaaccagattttctaaataggcattcttaaaatttcagacttacaaagctagtagtagaattttattgaaaggcctaggtattaattttttaaatgagtgctttaacttaaaacaggcgtttggaatagctgctgcaatgtagtcttgtgtgtgatttttttttaagttgatgtgcagtctaattgttgtttcataaaagttggatctgttcctatgcccaggatgattttgtgaaccgtgaagtacgtgagactagaagacgcccaaacaagtcagataatagtaactacaatggttgctgatgttgagattattgttgaactataattaataatttggatggcagaatttatctcttttttgtaaactctcataactgaattgcttaagtataatttatagaatttcagtgcagttcattcttaatggaaaatctgaaacctaaattgcagatttaaaaggtactgtacaaccattatatctgtaaataacttagcacctttttgtcacttagaataatatgtactactacttgagtgagcgcttttggaagttatatcaagttctagtgtttgcttcttagtaactgaactgaatttacagttctgtcctagacattttgcactaaagtagccgaatccactctcatgtcttttcgttaatgtgctctgtaccactggtgagtgctccatagtttccttacctgctgctacagaatgttattttacatccctatggctattgccaaggctacaaaaaaggaaagctatatttgtatgcaacactaaccttttgactgctaatgtatgtttctgcttgctgtgccttgttatggctgctttttttgtgctaataaagtatgtttggtgttctccttgtatatctgctgttttatacatttgcaacaatttctcttgtaaatggaatggtttggggtttttaaataagcattaactaacaacctttctatagttaatgcagagttaatgaacagtctaatattgacttatcagaataagctaactctaaatttaatgctctacatcttatcagtcataattatatatactgtggaacagtatctgtagttactgcaaattactgtacagtttaggttataacagaaaactgacagagaagtaataaacctattgatttctctgcttataaatgaaagattgaaactatccaatgacatattatagtaaatgagtatctgtaacctcccactgcatcagaagcaggttaaatgaagtcttgtgaatttgtaatagatcagtaccatttattggtttggggaccatcttaattaaaaataaatgcccaaaatgtagaactttaaccaaagacttgtcccttttaaagcaaaatggggattgaagggacttataatttctgttgtttctaattaaagtccctgaagatcatataccaaagtgtttgagaacttcatccaaacctactttaaagcattatgtgcaattaagttgttatgacataattatattgcctaattgttgggtcttttttcttgagcttataatgtacctggaaaataaacctcttgagaaaaagaaaagttcatactgattattggaaaaggactatatatgtgagcaagattgtgttttagagaggaaacttgaaactccaagaaagcacttgatgtttttatatgcttgtagcaaattgatgttctaactgtagttttatagaaagtattaatgcttttatgtatttcaaaactttcatatgttaaatggaaattgttttaaatgtgtttgagtttatgtaagcatgtatacactgtgctaaaagtcacatgtttcagtttgtgtataatattaatatgcaatttttggtttaaatttttgtcttaaaatattagtggcttacattttaaaaaagaaaaatcaccagcatgaacttgcacctaagtctatattcactgtgtccttttctgaatcccattgtagcctgtcaactaaatttgagtgttaacggtctttttaaagtgcatttaaatacaaaccaggaatttctttagaagttgagatacatctttatagttgaaataattaacccaagaaaaggttgctttgatttgtacccattctcattcattttcttcattcccttacacacacacacacacctctcccttccgcatacatataagtgtgtattatatatttatgtatgcacatatatacatttatgttgttaatattactttagatggcatttccacctgatacaaaaacatttagagatcttattctatagatattacctaaagagtattcttgtactattcgaattttattatctgcactaaaagtttagccttgctactttagccttgtttataatacagtcaccttacaaagagaaa

SEQ ID NO: 187574 - DNA, 4058 bp, Homo sapiens
  Payload ID: 16919
  Gene Symbol: SOCS5
  Gene Name: suppressor of cytokine signaling 5
  Uniprot ID: O75159
  ENST ID: ENST00000394861
  CDS Start-End: 276-1886
gggggttggggggaggggggaggggaaacgggtgaagaaggggaggcggcagggaagggggtgggggcctggcgggggcatccggcggagctggggtccccgggctccgtccggaggaagcgacgctgcgctcgctgggcagtcggaggggacgggacgcaccggagggcaggcggactcgccctgtcggtgactgcgccgtccgggcccgtcctgcctggccgcaggtgccctggatgaggccgccccgcgcgccccaaacgattttataatcaatggataaagtgggaaaaatgtggaataacttcaaatacaggtgtcagaatctcttcggtcatgagggaggaagccgtagtgaaaatgtggacatgaactccaacagatgtttgtctgtcaaagagaaaaacatcagcataggagactcaactcctcagcaacaaagcagtcccttaagagaaaatattgccttacaactgggattaagcccttcgaagaattcttcaaggagaaatcaaaattgtgccacagaaatccctcaaattgttgaaataagcatcgaaaaggataatgattcttgtgttaccccaggaacaagacttgcacgaagagattcctactctcgacatgctccatggggtgggaagaaaaaacattcctgttctacaaagacccagagttcattggatgctgataaaaagtttggtagaactcgaagtggacttcaaaggagagagaggcgctacggcgtaagttctgtacacgacatggacagtgtttccagcagaactgtaggaagtcgctctctaagacagaggttgcaggatactgtgggcttgtgttttcccatgagaacttacagcaagcagtcaaagcctctcttttccaataaaagaaaaatccatctctctgaattaatgcttgagaaatgcccttttcctgctggctcagatttagcccaaaaatggcatttgattaaacagcatacagctcctgtgagcccacattcaacattttttgatacatttgatccatctttggtttctacagaagatgaagaagataggcttagagagagaaggcggcttagtattgaagaaggggttgatccccctcccaatgcacaaatacatacatttgaagctactgcacaggttaatccattatataaactgggaccaaaattagctcctggaatgactgaaataagtggggacagttctgcaattccacaagctaattgtgactcggaagaggatacaaccaccctgtgtttgcagtcacggaggcagaagcagcgtcagatatctggagacagccatacccatgttagcagacagggagcttggaaagtccacacacagattgattacatacactgcctcgtgcctgatttgcttcaaattacagggaatccctgttactggggagtgatggaccgttatgaagcagaagcccttctcgaagggaaacctgaaggcacgtttttgctcagggactctgcgcaagaggactacctcttctctgtgagcttccgccgctacaacagatccctgcatgcccgaattgagcagtggaatcacaactttagtttcgacgcccatgacccgtgtgtatttcactcctccactgtaacgggacttttagaacattataaagatcccagttcgtgcatgttttttgaaccattgcttactatatcactaaataggactttcccttttagcctgcagtatatctgtcgcgcggtaatctgcaggtgcactacgtatgatggaattgatgggctccctctaccctcaatgttacaggattttttaaaagagtatcattataaacaaaaagttagagttcgctggttggaacgagaaccagtcaaggcaaagtaaactctccggtccccaaaggttgttaactaggtccgctttcatgtgcatcagacagtacacctatagcaagcacacgtagcagtgttaggctttttcatacagtatgtaagcttagtgttagtatctgtcagatgctacctgctgttacttattcagataaacatggtgcctattggaacaatagcggatagagctacaggtgttcagtaagactacaaaaacattttgcctatttcgctaacagtttggtttttaatggctgtggtatttgagtgaggcaactctggggcatttgttatgaagaattctatttcttactgaagaacaaattattaatattggatgagtatttcaacagtgtgactaatgtttgaaattattttttctaagagtttttctataaccttccaaaagtcgtgatgtttgtagttactataaatcaagctttggaagtccaaaaagaataaaagactgccttccttttagaaaaaaatgcaattttctggccacaagggcatagtgcagttcacttacgtgttgatgtagtttataatcagacgccttttctcttctgcaaaaggtactgttaagtaaaccagattttctaaataggcattcttaaaatttcagacttacaaagctagtagtagaattttattgaaaggcctaggtattaattttttaaatgagtgctttaacttaaaacaggcgtttggaatagctgctgcaatgtagtcttgtgtgtgatttttttttaagttgatgtgcagtctaattgttgtttcataaaagttggatctgttcctatgcccaggatgattttgtgaaccgtgaagtacgtgagactagaagacgcccaaacaagtcagataatagtaactacaatggttgctgatgttgagattattgttgaactataattaataatttggatggcagaatttatctcttttttgtaaactctcataactgaattgcttaagtataatttatagaatttcagtgcagttcattcttaatggaaaatctgaaacctaaattgcagatttaaaaggtactgtacaaccattatatctgtaaataacttagcacctttttgtcacttagaataatatgtactactacttgagtgagcgcttttggaagttatatcaagttctagtgtttgcttcttagtaactgaactgaatttacagttctgtcctagacattttgcactaaagtagccgaatccactctcatgtcttttcgttaatgtgctctgtaccactggtgagtgctccatagtttccttacctgctgctacagaatgttattttacatccctatggctattgccaaggctacaaaaaaggaaagctatatttgtatgcaacactaaccttttgactgctaatgtatgtttctgcttgctgtgccttgttatggctgctttttttgtgctaataaagtatgtttggtgttctccttgtatatctgctgttttatacatttgcaacaatttctcttgtaaatggaatggtttggggtttttaaataagcattaactaacaacctttctatagttaatgcagagttaatgaacagtctaatattgacttatcagaataagctaactctaaatttaatgctctacatcttatcagtcataattatatatactgtggaacagtatctgtagttactgcaaattactgtacagtttaggttataacagaaaactgacagagaagtaataaacctattgatttctctgcttataaatgaaagattgaaactatccaatgacatattatagtaaatgagtatctgtaacctcccactgcatcagaagcaggttaaatgaagtcttgtgaatttgtaatagatcagtaccatttattggtttggggaccatcttaattaaaaataaatgcccaaaatgtagaactttaaccaaagacttgtcccttttaaagcaaaatggggattgaagggacttataatttctgttgtttctaattaaagtccctgaagatcatataccaaagtgtttgagaacttcatccaaacctactttaaagcattatgtgcaattaagttgttatgacataattatattgcctaattgttgggtcttttttcttgagcttataatgtacctggaaaataaacctcttgagaaaaagaaaa
